United States Patent 7,365,185 (GENOMIC PLANT SEQUENCES AND USES THEREOF) - sequence listing, part 52

SEQ ID NO: 67329 - DNA, 28549 bp, Oryza sativa
cccccccccccccccccgggcttgacaagttcagcaaaaccgtagagaaagtgggctacacctagcttagcctatccaatatccgattcaaaaagagcttggattgctaccttttctatctctgtataaagtcaattagtcccagtgttgggaagagcccactgtcaaaagatcgttttgctaggatgcttgcttgaatctagttacttccaaaaaaaggcatttggaactctatacggtatggctacaaaccgaatgaagaagtcgtaatcaggatttgatctatctggatcagcacattttattacaacttctttaggagtatgacatagcccccctccctcccagatctggccgaaggagggaggggggaggctggccacagcgaatacggcacggggcagcggcggcggccacgacgacgggtcggggcggcggcggcagccacgacgacgggtcggggcggcggcgacgacaacgcgcggggccgcggcggcggctcccctcccccctcccagatccggccggaggagggaggggggaggccggtggcggtgactacggcgcggggcggcggcggcgacgacgacggcgcggggcgcggctcccctcctttcccctccaaaatccggccgaaggagggtggcggcagcgaggcgcgtggcggcgtcggcgagccgccgccgtgattttttttgttcgtttcatggatttttgcaggagggctgttgtcccgactgtgaaaatcgttgattttcaccgttgttgtgctacaagtggtccaacccttcgcttgcaaaattcacttttgtctgtctgcgaaaatactttttctagtagtgaatgttgttctttggatggatatcaccaaggacatattactcgaaaatggaaaggcatttgggcaattgggcttgggatagtcagtgagtgctggcctgctgggtagatcaggggctaagggcatctgcctcaggttattggacgttgttccaagttccaacaacgaccaaagcacgatgttgttattaacagcatccacatctggatgccctgcaacatatacatagcacccatcccatttttccaaattacttcctccataagaaagtatatgatgtacttttataaaaataaaaagtataaatcttgaccaacaattaatatgattacaaacacacttaccaacagttaatcagactattcacatatctctggatgccctcactctgcctcccaccccacctgccatcgaatgctccccctcaagttgcatcgccccacacaaccactcaagccaagtttagttccaatttttttctttaaatttctaacttttccatcacatcaaaacttttctatacataaaaacttttaacttttccgtcacattgtcctaattttaaccaagctttcaattttagcgtgaaccagtccattgatagctccctcctcttggactacctccacaaaacaataaaggccgtggctgccaacatactggcctcgcgccaccccaagtaacattgcttgccttcctcggctcaaatgaggcgagcagaggagaggagcactgctggggtgatagttttgacgatggaatagcaacggtgatatgcgcaggacgcatctcatggtgcggctcacaatggtaggccactcccaatgcagggaacaacggaaaagtggagaacggtgtggcgaagctcgagatccggcattggaaagtacctttacccagtctttttacagcacagctctagcaagcaatggcgtgtatgtcaaccatggaccaaaagtccctgaagtagtcggggatttcgaagccgttggtagagaagagcgcaacggcgagcccgccactgctgtgaaacaacaacttcggagacgtcgggacaagaatcaggcagcagtgcagcaccagggcatcgactggcttggtgttcaggcgatcaaaccgtcgagcacctggcgtgcgtcggtgcgtggcgaaacaacgcctctctccgcggccgctccggcgccatctcgagcgcgcacaaagagtacagctcaggaggcggtaagatccaggttaggagacgcagtgacgtgtatagcaacagctcaggaggcaggcgggagatcgggagcacggaatatagttgaacgacggcgcagagagcgcgcgcaagcgcgaagggccgtgcgatggatttgcattgcacgtgaaccacaaccctgttctggcccaactatattaggcctgcttgttagccacaataccgatccggcccatcgagccgagcagacacagaagttgaatttctacaccgatgtatgcaagtgattgaaattgttgtataaaaaaagtatataatatgagaatatagattctgatgatataatacatcacacaaatatatagtctaaatttaatctacacaggaaaaaataaaaataacaaaatttatctatgttgtatacgtactattaactgtctgattttattatattactttagccttgcatgtttgtttatagacttatctcatttcaattgatactactagtattattttttattttttttccataactattctaagtcgtatgaaaataacggatgcacaccttacccctcgtaccataccacggtccaagtaaaaacatttttttttcaaaatgtagacccaggcaatagagatgaacgaactcctcacaagttcacaacgaggtaacatcctgcataccaaagctaaagctgacaacaacatcactgagatcaggcatagtttcaagccaacaacacacatcaatcccggaagaaaatcaggtaacggatcggatcgacacagctgcaactcctgcacggatggtgttcgacagttcgaggatcgagacggccagccgtcccggccggcgaggtgctagctttgctctagcagtttcgctcacgcgctgccgcgggagaagccgaagcaggagcaaccctgggaggcgtgctccgggacgggggtcatgccgcccttgccgcgcgaggtgtcgatcttctccagcagcgccaccacctccgacatctccggcctgttgtccgggttcgcgtcccagcacctcgccatgatgtccgccatcgccttcgggcagcacctcggtatgtccggcctgatcccctgtcacccatgatccattgatcgacaagaagcaaaatcaatcaatcgacaagaatcttggggaggcgatttatcatggcgagatgtgtctatctaccagcttgtcgacgtggtaggagatgtcagcgaggctgtagttggggtaggccatggcgcagcagtaggtctcccagaggaggacgccgaagctgtagacgtcgcacttgtggtcgtaggcgcggccctggagcacctcgggcgccatgtacccgatggtgcccgtctgcccggtcatgtcgtcgccgtcggcgccggcctccacgcgcgccacgccgaagtcggcgatcttgagcgtcttcttcctgtcgagcagcatgttctccgccttgacgtcgcggtgcacgatcttctccccgtgcaggtagcgcagccccctcgccatgtccagcgccagctgcaccaccttcttgtacggcagcttcttgtcccggtgcttgtacagcagcgtcttcagcgtcccgccgtgctggtactccaccaccaccacgcaacgctgccccccgccgccgccggcgctgccgccgccgacgctgctggaccgcgactccgccttcgccgacgggatcttcagatgcgacgtccccatcgacgcgcccacgaactgcacgcatgtacacagacagatcgatcgatcagacaccgtacacgacggattcaacggcgtggattgattgctgctcaccttggtgacgttggggtgatcaagcttctgccagacggcgacttccttctcgaaggcttcccggtgcttcgccgtcgactcctgcccctcctgcccccagtccagcaccttcactgcattgaacacacattgagcaacaaatgtaaatattagtgcatactccctccgtttcaggttataagacgttttgattttgatcaaagtcaaactgttttaagtttgattaaatttatatacaaatatagtaatgtttataatacaaaattagtttcattaaattaataattgaatatatatatatatatatatatatatatatatatatatatatatatatatatatatatatatatatatcttcataataaatttgtcttgggttaaaaatgatactacttttttctacaaactttatcaaactcttaaagtagtttgactttaaccaaaatcaaaacatcttataatctgaaacggatggagtattttttatattgatgtttgtcatctggatcagtgataacatctagcaacaaattgtttacaggcaataggtcaattaaattacaaacgaccttgtgtaaatctgtaatgtaataatgggtccgttctttgggggaaaatgatatctatttactactagctagaaaaatatgtacccaaaattttactccatcaaggaacttgaatgtatgctagatagaggtgtactcccttgcataaagggtcacatacggctgatgtatatatggtactaatgtttgagtaaaagttactaaataatcttctttgcaaatggatgttatgggaccatcaacacctagatattatttcccttcttccatttcagctaattgaataagctgtaattaaatggtacagtgtgattaagatttttgcctcaatcaagatttgccacttttatacaagggaccttgaaaactcacaaataaaaatacaataaccgcactacaattaatgtttcacaactattttgtagaagtaaatcttgccaaaattgcattctgaatgttccaaatgacaaaattttaaataaaaagtttcttaggtctatgttagctatcattctatctaatgttgaatacacacatatatattcctaactagggagtatttatccccgagaaacactagaactttatgccataaattgaggtcacgtggatccgaggaattcacccttccgtacataattaatgtactaccacacagcttaccataggttaagaatccccaccgaccgttaccacatagcttgcatcacactatatcattgttgtcttgccctccacaccaattcatatctctactgacacgcggcaccaaaaacatccttagcaaacgacatctcctatcttctccaccacccgcaacagcctctactgacgcacgcacggcatctccaacagcctctactgatgcacacgccaactcacgtgtttactatacctcgctagagccaaaaaggtggtcaacaggagttcctcatcaccaaccttccacccctaccaaccaacgtctactgttcctcttcggcggagcctacaccggcctcgcctccccccctcctcctccttgatccgcttccgtccaccttcacctcccatactaacttccggcggtgcactgaccaccatcaccatcaccatcgtcatcaaccccaccaccgccgctcatcgttctcctctgtttcggttctcgcagctggctggccgacgggaagcaaaacctaatgtccagtaatggtaaggaaaacaacaaaaactaaccatcactacaaaggaaaacacaaagggctattttacaaaatctcttggtgacaaacgagccctcactgctcagacgacgattcaccgtatcaaaaagtgctatggtgcggcgtacgggcgtacggctagcaaagcgcgacatgcacgttcatcacggtgacagtctacgagtctaatactagtaatagcatgtatagaaaagagttgatcgacgcaagagatctgaaggttgatttgattcgattttttaccggcgacgtcatggccgtcgtaggtgccgcggtagacgacgccgaaggtgccgtgggcgacctggttctggatgtcgagcttggcgaggtcgatctcccactccagcagcggcagcggcgacgccgccgacgacgagcggtgctgctcgagccacaccttggaccgcgtcttctcgaactgcacgtccaggttcttgaggtcgatcttgtccgcccgcacgtacatctcgttgtccgccgcccggacgaacacgtcggcgccggcgccggcgccgccggtggccgcggcgctgctgatgccgctgaagctgtggctgcggctgcacccggcgccaccgctgctcgtcatggacttcgttctttgtcgatctcgctcctcggcaaagaacacaacggacgatctgcctgtggttgtgtgtgtgtgaaatggaaaggactgggtttcttctccttatatggcctcttcttcctggatgcgccaaattaaattttgtttctaatgcaggagaagatggatatgaaatcgtttctgccctcttttctgcttcaattaaagcccccaaatcttccaaggaaaccaaccacgcatgcaacgtgcctacaaccagatatcgatggcgaacacacgcaatgcatccatccgaaaatttgagcgaagcgcccccccccccccccctaacaccctccctcttggaacgtaaagcgcaaaatcaaatggaaagaaacagaaaagaaaaacaaaatctcagtcagaaatcaaccccgcgccgaaagtgtcaaaaaggaagtaaacaagatctctcaaaacaaaatatcaattcggagggaggaatcaagaactgccttaataaacagttaaaaaaattaactaatcaaccaagaaggaggctaatgccggatggaattagccccttcttgatccaacgacccaaacctacgctaagatggagatatttcctcccatgaacacaatctctcctctctcttgagatctaaatcgatagattaaaatgcgttcgaattggggggtgaggctcggaatggatggacgctgttgacacggagagatgcgagggaagggatcggaggaagaaaatattagcgagagaatcaagggaaggagacccattcctggcctcggcctgacagccagccaacgatgcgttacgaaaggaaacgaaacggctcatctctgctgcaggttttcgtcagtaaatggaagacgctgtagaatgtagatgcgactcgcaattcccactgacaagtggggtccactttttgacccagctcggttattgggcctccgcgacccaacggaggacgggccggcccaccccaaaaacgtccccgctaactcacaaacacgaactccacgtggttcatttttaacttatgttcgtggtttttatcccgataaaaacgagacaaatatgttcttaggtgacgtccctcgtagagttcaaaatatcgaacaaaattttctaaatttcggtactatcgcacccccgatatgaatcatatgatatcatttcgttcaaaatttttattcttttttttattttctgtgaattcggtaatattgtgtttagatttgaccaaattttattcgaaaatttcggtaaatcggcatcctccgatgccaacgccgaatactaaagattgaacccactccctacccgcttttaccccgagaaaaacgagacgtggcttcaccgtgtgccacgacacaacagaacagaacagccttcacagccgcaacacgtgccaagcgtgcagtcaaacgaagcagagttaacatcccagcagagcagcaggcgcagagcaaatctatcatttcatcgaaggcaaattacaacacaaacaaaaatcatatcagcgattacttattttacaggttaattagtcaagcgggcacaagcaaagcacaacaacagaaatctctcatccaagaagctttagatacacaagcaatctacgaatcggatgccctgaagagggtgaggagggagaggaagaggttgatgacgtcgaggtagagcgcgacggcggcccagacatactcgtcgtaggagtacctcttgatgaggttatccgtgtcgtacacgatgtagccgcagaacacgagcgcggcgaggccaccgtagatcatcagcgagaccctcccgagcgggaagaagacctggatgagcgcgaacaccatgaggatcatgacggcggcgaagaggaacgggccgaggaagctgaagtcgtggccgcgccgcgccgcccagaacgtgtacgccgtcaggctcaccaccaccgcggccgtcaggatcgccgactcgaggatcacctcgcccttggtgaacgcgcaggtgaggcccacggcgaagctgatcgccgccgtgaagagggccagcaggaggaggttcaccgggtggcgctggtagtagtagtagagcgggcaaagcactgcatcatcatacaatcggaatcgatgaaatgggggatgaaattgatgagaatggaattggggattgattggattggattggattggagagcttaccgatgaaggggaggatgatgaggaagatgtagagggcgaagccggcgggggtggagacgaagaagagggcgacggggcggacgaagacgacgacggaggcgacggcgatggtgagcagcatctggatggagaggatggcgtacaccttccggacgaacgcccaccgcagctgcgggctctccagcatcatcgggtacagcggcctcgccatccccgcctccgcatctccccccgcccactcgggccccttcggcggcggccggaaatacatcctctctcgctcctcttcctcgcgccggtgaggtttcttggcttctccgatctgatcctcctctctgctctctgcgcttgcgcggtggcgatggctggagaggcggcggcggcgggggggagtttttaaggcggacgagcggtggagaggagggcgcgagagaggaagtgaaggttccggacggttcagcggttggggatccgacgtggcggcgccgtggctggtatgtggggcccaggcgggagatgacggttctagcgccgtttcgttccgtttctggtggcgtctggaggggggcgagagatttgtgcgttgcttttgcttagtgacggggggtatcagtagtatcgttcgtgttggttggttttccgtgtcaagccaagacacattttatatcttgctgctttggggattttgtaagggagaagcaaagcatgaatgttagataagctagcaccaacaggaatggcagatggttctgtttggtagtatcccgttgtgaatgttaaaccaaccataaaaatgtgttggtcatgatctctgcagcactactcttgatggttgacagctctatcatttgtgtttttacttattaaggccgttgtcaaaattttaaattttaagactttcttgatgttaaaatcgtagttaggagttttaaatagttgagaacattgaggttttacagtgggaagtcttaaaataagcgttccgtgggactgtgtttctagcttcctgcttttctagagaacattgagttgcaacaggaattggatggtgtggttaatttgaattgaggtcagttcagtttgatcaagacatggatggtgggtgctgtaaggtcctgagaaatctggtcattgtttttctttttcgaaaaagagaaatctggtcattccgtcattgtatttgtaccgtaaaatattaccactaaaatcttgacttatacagcgagaatactcactcccgggcaaccaacgtgaggcgtcattatcgggcgctccccccggacgccacgtgccccctagcccaccatgtgtcatgctcccacctgtcatgtgtctcaaaaaaaagttttatctagtatactcacaatgtttcactatgcatagatctaatgttacagtgaattgaaaacattcttttgcaacaaatcaaccacatattttagaaaccctctattaaggaattcgtttcattttttgttacaccaaaaatgtttcacctagtgtacttacaatgtttatctaatattgcactaaacgaaacattttttcccaacaaatcatccacatattttagaaaccatctattaagggaatacgttttaattttttgttccaccaaaaatatttcacctagtgtggatcaaatgttgcagtgaactgaaacattctttcgctatttgctgaaacgttgtttttttatataaggtgaaacaacgtccgatttaaacgattgaaatattttcgatctacttagtggaacaattccgatatacctgatagaacatcgtgcaacatttaaaaataatttaataataagctaaaaaaatttcatcggaatatatccatgtatggtcttattttgaagatttaattacaatgaatttaatggtccaatcggatcatgatttggataaataatttaagagaaaaaatagtttaaagtgtttttgcacgcatcgtctgattttaaccccctctcatcgaacggagcgagagtcgcttcccttatacaacgatgagacagccagatatatttctcactcggaacccttctaatccgtttggttgggggagcttttagaggaccgaaagtttagaggatgggggtattacctattctgtttgattggagacatgagatttttctttatgaggctggaaaattgagggataaattcctacttttcaataacttgtaggagtggtatttggaagagaattcctccttgagaaaaaaaaagtgccgtcctgaaaataagcctgtcaaaaagggcgaaaaaaccgttagaaaaaactaaacagtctaaaaaaccggtatataccacgcaagataaaaaaaactacgcaatgcgggaaaaaaaaccagtccgattgcacgcaacgcaagaagaagcccatccgattctacgaataaacttaaaaaaaacacgtaaaaaatcgtttcacgaaatgtaaaaaagagtgattctcgggaaaaaaaccaccatcaaaaaaagttcacgaaaaaaactattttgcagcgttaaaaagaagtctgattctagaggaaaaaaatatcgtcccaaaaaaaacaggtttggcaccacaaaacattatatatatctctatttctttcaaaagcgaaacctgtttttttattcattaatatcttcttcggatcggtttctcgacgacgtactttttggatttttcatacatgcgtcaacgtatttttcgagtactgcgggtatcctcggggcatcaccaaatcagtttagatcaactgcgagtattttgtatgttggtagagatcacgtctattggcaaagatcaaccgcattggtgccgatcaaatacgacaccaacgacgcatcaaatactaacacggaacagaaagcagcagactgccggcacaaggatctctgttattacagtattactgatggactgattgttaagctccaaatagccacagacaacagaattttttttgaaacccgacagacaacagaatgcaacaggctgcgagacactggtctgaagaggcaaagcacttttaacttcagcttccttggcatccgccgaacgctccgcgacaacctttgacatcccaaacatctgagatgcgaaacatgaagcacaagaaatgcttcatcatcaaaatgtccaaaatgcagaaagagcaaagaagtgcagtatctgagtgtttgcacatctgaccttttggatggtgtttgaagcatgtcttgtgctcatccatggaggcatggatgaactcctcgatatggtctttcagatcttcgaggaaagtagcgccatcagtcctcttccggcaacaagtcatggatgggtttttgggaactgaataggcagaatcttgaggttgtgcattgctagattccatcttaagcctgaaaaagaaaagtcaaagggaagttgattagtatgagtctgaagaagacatcaacattgttagaataggtgcaaacacaagaacgcatatagtagtaagtatatagcagaaatgcagagtagcagcggcacaaaattaactgactgcacttcagttatcaaatcatagatgctactaccaaacagatttaaaggttcacatttatttttcaggtagaaacatcagtagctactactcagccaaccgtgtccaaactacgacggcctagaattacaaacaagatgacgcagcaaagaactactcactgatcgataagatctcacagctccaaaaattccaccatcgaatacctaagaggatttacacttgtctcaagttggttatgatcagatgcgagcccccttcactgagattcgactgccaccggagtcacctcccgcccttccctggagctgctgcatccttgaccatgggctcgaccttctttttgccaaacacctgaaacacatcacaggaaacctgcagattatccctcaagatccatcagaggaaacagcatgttataattagctatcaaattacaccataaagagaagattgaattaacttcaatctgaaagaacagagaacactaagtatagcaagaacagagaacaggagtactgccatccgttgcaactggcggacccagattgcaattagagtgtgttgctaacttgaattgcaaatgcttgtatacactactgcagttaactaattgtctatgtcaaatactcaggagatctcctcacaagctaatctataatttgccactaattcaacgtgactgctagcaacaaacagatctagatgtacgcacaggttaatagccaccaccaaatgactcgacaacaacaacaacaacaaaagcatcacaaatccacagggaaaaaaccgaatgcctctgctcctctactactcaaatagaacagcactgaaccccaccacaaacgacgattcaaatcgcgaacacaggaacccattcacgcaggccttcccataaacacaacgaaggcactaatcgaactcacattgctgcgttgttggtaaaacatcacacgcttgttaaacctcaagcactagtagagtttctacagaaacagagacttggcggtactaattgcaagcagaacagggtgcacgtagcgaagaaaactccaccaaatttgtagcaaaagagagatcctaatccttatgttcgcatgcgtagacaccgattcaatctaaaagaacatcacgatctaaggcgaattttttttaaaaaaaaaactaaatgcttctccgtttcaaataaatacaacactaaactcgcgaatgattcaaatagcgaaacactaacctattcgcgcagacttttccccctaaacaccgacaaggctttatgcaaaataggaactcgaaaaaaagatcaaatgcttgtcaaaataacaaccgctttggcactagaacctgcatgctaatcatccgttctcagaaaaacaaacggttgcagaagcgatcgatcacactacattccttccgattcaacactccaaccacgcgctacgaatagaacagcacagaacaaaacccccgagaggatgaactagtactacacacagcggccaattacactgagaaactcaaaagcaaaccgaaccgccaagaggaatcacggccaaaacaccaagaggatgaactgtacttactacacgcgcggccaaaatccagacatgaatccaagaggatgaactattaggccaaaacacagggaaactcagaagcgaaacgcgattcatcacaggtcggaaacccagcagcaaagttgtgcaggagggaggagagggggcgtgctcgggtgtaaactgggcttaccgagctgctcttctgtgagacgtagtcgccggcggcgcggaacttgtcctcgatgcagatccagtgctttctcggcggagttctccttgaactggctgtactagtccttgacgcgcgcgctccataaacgtcgccgcccgaacatcatccgctgttgccttgagaggtccggtaaatcaaccgtggtggtcgtcttctgaaaaacctcggcgatgaggactaatccctctgaattccttcctattcaacacggggaccgcgaagaaacgaatcctcctcctgcgcaaaaaagaacacacacacagttaacgacgaatcggagagaaggagcgagagagatgaacagaatggctcaccgctatgtcgaatccgacattgttgggggtggggggggggggggcagggagaagttcgaatctgtgggtggatgtggccgatcgagagagagagagagggagagatggagaggagaaggtgtgctctaatttatggaccacgttgcagtgcggtacacgttactgtggcggcgccgtgtgagtgtgagcaaatggtgcaacgacgggtggtgctagttgtgtactcaagcgatgtcgaaatgtacaactgcgggtggcggtgaacacacccgtggacctgtgcgtgtgtccggcacgttcgtgcaaattaaggatgtgtttggatggttttgcctgcgtaggagatggccgcccggtttttataggtgtttggttgttgggctggtataggatatggccaccccctaaggaatattcgcagtagatgccgaacagatgcatccggccgaatcgggcgaacggggcgatccagggacgggcgagcgcacgtaaaaggaaaaagtggcatgcgctcacctccttccccctcgttttctcttcctctcctcttcttttctttctttctcaccggtctgagtctctggagctctcaagtctgaaccctagcttttctcccttcctttccccttcatctcccctggtggcgcagccggaggcgccaacggcctcaagcgccggcgcgaagggctgcgtgggaggaggcacagggtcatgggaagaggcgcaggggcgcggcagacgcacgggtggaggcggtgggtgtcgttcagcggcggcggcggtaggcggcgtccagcggttcaggagcggcaaatggtatttgatgttcttcttgatggtcaaccaagcaatgcacagagacacaacagcaaaactcattggtttgtggatttagattcagattcgtcagttcagtttgttgaaacacaagtatagctgtgctgcttgtgcagtacctcaacaaccatcagaactttccgcaggatttttcattcaacttgaaaaccagtaaaatgattaagctatgagatgaaacaggtgctgataacgaaacttccaaaaataactagaaatggcacaaaatgtcattcacagataggagtgcattgcaatatcggatatgtagtacaagtgcttgtctttgaattgtccgatgaaaatctgctctataacattaataaaacttatttgcttacattatattgtaaaatcagagaaaaaaagatatttaggccatctacaaggagaaggaggtattctcaccatttcatccaaaaggtgatcacaacacccatccatcctaccaaacaaaaaattggctcaccatatccacctcttctccttccaaccaaacataaacttggctcatcctatccgtcgaaccaaacaaaaattggatggccatatccctgaaaatatggatggacatatcctatccatccttgaccaccatccaaacacaccctaaaggagccgatcgagcaagcgttctgacacaagggaggcgtagagcagcctagctaatgtgatccgagttgggtgcgattacatcaaaagttacgtgtcacatacaaaaaataatgggagtattaaaaaactaccataagatttttgagaaaaaactttcagatataactatagaataattgaagtgtaattacactttaattactatattatgagtggatgattttgtgtggatgtgacatccctactatgagtttgtattagttcccttttgcgattctagggttagggtctagggaaattgattttcagattttttttttgttatttttcaatttcgcagtcggatggcttaagtgtccgcatgcaaccgtctacgaaaatcgattttggccgcatgcaaaaaccgattttgtagtagtgtctcttatcaaacatttagtgtgatatgtaaaaatactagaacggtctcgcgcgctaagccgcgcgtgctcgaagcaggcgatttaatatagcgaaaacaaaaggaaatcagttcagtatagatattagtcctgtctatggcaagcagcaagcaatgcatgtttgaatactgaatcacgttatggaaccatgtttttattcgtgaatgtactttggtataatcagatgatgcaggtgtatggaaggggaagccgtttttctgttgtatgcttgtgacttgacctgagtgcactaagcttttgcgttgagtttttgcgttgagttatttttttaatacttgttcgaagtctgtatgcattctaaggacgtgaaattggattatttcaatggatatatgttcagatgctctcatatggacatcatcaaggtagccaacaaatcagcaatcagcaatgatatatttaatctcgccacacaacttgacaagctcatgtactcttagataaaacacggtaaacatataatactttcatatatttatcatttgagatgaccattaaacagtacggtatatacaggctcatatatttgtttgaggaatgtccgcagcgaccttttcaagatgagggaccatgactaacattatcttatatcatatttgctgggcctgtggaaaaacaaaacaagagccaaaaccaaactacagaccaataacaaaatgaattctatatctaaccactgtgagcatagtaacctcatattagtaccaaaaccttattatgcaaacacaatgatataagcaatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcctatatatatatatatatatatatatatatatatatattgagctcatctacaaacggtgttgtgcaatacaatgacctaagacgctaaggacatacaattgggttttaatatagcatatccagcaaataaaggtaagatgggtgtgtcatctttttcacttaatcttcatgtgtgaacaatgcgtagctttaacagagaaccattagaaaagatccatatgagtgcccaaaaataagtactgccagtaataggtcatgacagaagaaaaggaatcttgaatagatgcatagcatgtaagtatctaacattgtatgaaaatgctacctggcagatgcgctaaacttttattatgtaatctattataggcaattagctatattgcttccgagaacagaacgaaggtagtggcaccgtaaaatcacaggaaataataaattgaatagcatatcacctgctggagagaatgacaaaccctaagtacttgttgcttttttccatcacctgcacaagcaacacttgcatttaataaggagcaaagaacagtgaccacctcatggtagctcatagccacctactaacgtgagagcttattttaagaaaacgcaatactatggtcaccaacaaaaactattaaacccaaatcaaaagcagacataatatgtttaaataaaaagaaccaccttaggttcttcttgctaggttgttgccaactatcattttagtgggtttccttggtatctcatactgaatggataaattaacggatgctttgtgcggtctcctttccctgcatggacaaacgaagcaacatgatggaatcgctatggatgcagatgtgttattgaactagcaaccatcttaaacataaaagaggatagtaaaatagtaggtggagcttatgttaagaaggtgttactaatgctatgcatgtcagcccccaaaacaagcaggccaaaaaaaatcagaaatagcttctatgggttgagatgagaaggcagccacacaactcaggttctagcagaacacataaaaaaatagacgggattctcaagcatactcacgagagaatgaacaacagactggtttctcaagcatactcacgagagaatgaacaactctgaactaaaggggcaaaatgcaatcagggcaacaaactcaatggagaaaatcctagatcctttgcattctgagagttttttctggatgatctgtgaggttttccatgtggttctgatgcccaacgtgatcagcaaaaggcccttgatcattcctggcgtttgtttcctgctggaagaagtaggagaagaattagttggattcgatttcagcaatgtgagcagcagattgcttgctcccttttttcaaacaaaaattttactaagaaaaaaaaatcctatctttctgccatgggaggaggactccaaagaacataaattaccatcaaataagctggtagaaggattcattacctaaaagctcgccatatccagattcagcaaaacactgaacaagaactccaggtcagctcaatgattccccagaatttgggttttcgccaacaaatcaagaaccgcgtcttagctgaataggagccaatgcggttgccggcagcatgaccacatgtctgaagcgcacccccaacaatcaaagaaatgaagtctttattggaagcaagacataatgggaggagccatgtaagctatgcaacaggtccaacgagcaagttgcttcatgaccatgaagaaaaaccatgtaaatggaatctgcgggaataaaaacagaaggaactctgtagagctgacccacaacagaatagagttatcttttagaacattattcttttatttagaggcaacaacaaaaattatattgaactatctttctgaatttcgtcacacatcttaccatactcccccatattaagcatctaggatgctcatctagccaatataacaagataatagaatttgcccaaagcattgcatgtggttgttcttaaagaaagtaatagcattgcatagttgtttcactgggggaacaaaagctatcactgctgttgaacagccaagaagattgaatgtaaaaaggaaattttaccgccaacggttgaatatcaaataatcaggttcaattcatacaacaacccaaaggttatgcaagcagagcagtgacgggccaaaggttatgctgaatgacagcataaatcatttcattaagcgccacgttttcttaatactgtaacaatacttatttgtacagaaacatgtccggtggtcttttcacagcttcttactttaacagctattggctttgtttccccaaatctccaaaaatgtaaaatgtaaagtaacaaccatacatttgtaaggcctactgtggcaagcaaatataatcccatggcatgtaagtttctggacattgtatgtttagcaacctcataaaccagtgccgccacccctcaaaaaaaatttagtctagcagttgcaattctctctgctggaagtccagaacactgcaatctcgctctattcagcaagaaataaactcagagaaattggttgtgctgatcaatagcatgttctatacaaaacagttctcttgtttcatgttggacttcatagtgctcagaagtgagaacaatagaacataagaggcagctagctagcatcccatacctttgaggtagcaatctagctcaacataagagaccatatataatgcgtggtcctatgtaagaactatgtgctgcgctacttgatcccctaaaacctacttttattggtagcaaatactcaaatctggatactacacagagtaaattgtggttgaagtacaaaatttataggaaacccatacaacatccacataatttggtcgctagtcgcaataatccttcaccatgtcatccatagtcaactattgaaatttattttctttcgcatcgcactgtaataatccatacatatataaacatgtatcgtataaatcaagcaaatttgactgaaccaaatttagcggataaatgttgtgtatgatacctcataattgtcttgtccagctgcttttcgcaacaactttcgcagaggaaacactggaacctctttgtcaggttagtcccaaatgttattcaaaccgcttacatccctgcaatcctccaaccaaaatatatctttcttcgcctaatcaaccacacttcaatgtcatgttaacagtgcgaatgttgtattgcctccggccgcatcaccaccgagatcctcgtctccacccagaggcctcatcattgttcctgtacacaatcgtcggcagcgagatcagtgagagacagaggacggcgggaggaggataagggcgagggatagaggagttgagtaaggagtgacaaggggggacgctgacctttggtgtcgatgacggtgccgaggacgaggggactgtctggcgctgagacgaagaagaggacgaggtgcctccatatctagcggagtgggtgacacgggagctactgtacatcatcgccgtcatcgatgaagccagcagtgggggattttttgggaggaggatggggaggccaggacaaaggggaggacgttgccgctaccgctgagcaaggagagaccagatccagccatgacgatggccttcccctcctctctccctgaaaacaaacaaacaaaaatacactcaaaccaccagcaacagcagtgaaattaacctccgcgagacccctaatcgatctaccgaacaagccaaccgtgggttccgcctcggcatcgtcgtcgaactcgtcggcgttgaggccgcaccgctctagaaagcgagggcactccgtcgccgacgccgccgcgcccgaaggagccgcggaggacgccacggggagatggcgaacggggaggcggagggagggagacggccttagggtttggtggagaggggcgggagaaaggggggaggaagcaagcggtcagggagtcggggggagcgagcgggcgtgaggatgaggaaggggaagagacgagtgggcgacgtggagggctcggcgccaagcgatcccacgacgcggtaagcacgggcgttaggaaaaaacggatggatagatgtggcccatgcacaggatcgaatggtccacgggaaaggcatctaaaacccaaccatattcaatccatattagcgaggtgtctcaagcggattagtcaacaggagccaaatcgctttgggagcggcaaacgcaggcgctttaagatatctagtatgagtcatgtgctttgcaatgggtgaacttaattttaattgtgccggaaaaaaaccgttcattgcataatgaacattaaaaaataattgttttcattaacttagcacaaactaatcaaattgtaatatgcagtgcatcatagaaataacagtagtggcaacccatgggtgcaccaaaaactgcccaccccattggctcaatcaaaacctaaaaagcaccaatttcatgactccactacattactgcattatcactatataatcacttgtatatcagacatcacataagtgggacccatttataatatcagaattaaaaaatatacatgggacccatttgtcattaaaaagattgtaggacccactgacaggtggggcccacatgtcagtcaatcccttcacccatctctctccatctctcatcttgttcttactgggatgtctctgaagtgcacgtcccacaacacgtccatcatctcaacgtcagtgagcacggtggcgcggttgctgcggaaaccccaccctacacagctcacctcagccactctcttcccatcgatgctgacccgcacctccccctcgccaccgttgtcactgccgcgggtggcgtgcaccgccgcctcgtgctccaccccgccctcccggaacctacactgccggctgaggacaacggcgccgcgtggggctccgtcgctgtctccgaaccggcgagagaggtccaagtagaatgcaggcaatgaggggtagaaaggttatatggtgtgcgtggatgggtcaatagcgactaaggtggacagaaaacgatcgggaattgatggaagtgttcaaaatgtgaacgagtgaactttgagtactattaaagtaaaccgatatctttaagtgctataaaaaaacgtaaactttcgatgctatataaccaattttgcataaatttttagttaggttaagataagataagataattagattgagggagttaaatgcatatggactaggtacgttatgcatgagcctggactacgggcttcggcccatggttctatcgatagattgatcagataactcgttagagatagcatcggtttccaatatctcctagattcgtgccgcgatattattatttttttttctgaaccttccgcgcccttctggccgcgcgccacgcttcaattcgcctttcaagtctcacccgagaacctctccaccctccgccatcgtgccgctgctgcgtgatcagcgtatatatactgtgcgccgtcggaattaacttggtttcgtccttcgtcgaaatcaacttggtttggttagtttgcggtgctttaagcctaaccggtgcgtacgtatactgaagccattaaattttcgtttatttttcactgcacgtagatatatacgcgttgctaaagggcacaaattaagattaacttggttgcgttggattgattttgggaaaagctgatgcttacataagccaaataaaaatctggtatagccattcaactttcatatatatgtcgtatggcgattttaaaattttactcaattagttttctcttaattagtagtatacctacgttcttttaatatatatgatgccgtttactttttaaaatatgtttaaaaatttatcttatttaaaaattatggaattatcatttatttcgttatgatttaatttattattaaaagttattcaagcatgttatatatttttaacatttgtatataaaagttttaaacaagacaaataatcaaacctacgtcaaaagtcaaatgtatcgtatatttaaaaacacacggaatatcgaacatctatgtatatgcatgcaggcggtacatccacactagtaattcaacatgcctcgagatagaggagcgtcatcaaaaaccctcgccgagctcggatacgtggtcggcatggtcatcacgtgctacgtagagcgcgagttcattagggcaagacgtggaggccttctcgcataatacctgacaacattctatttgatgcccatgggattctacttctttgagttgaacagcatgttcttagtttgcgacttaataggagctccaggctggatcaggacccggggccgtttacgagtgctccttttattctgaagtgcacctacagtttgttaatcttattaataaatagatagtgcattttgtattttaatttattatattgtgtttaaatcttcccaacttccttgtcttttctttccgttttgtatttgcatgggttcatgaacccacaagctcatagaatataaatcaattgatgctctgaatttttttcaatatatggtgtatgtgtgttacacaatgaggaagagattgtagggagtcgtcacggccagttgctcgatcgggtgattaagccgatgatgtgggggctaaacggttaagaggaagaagccaaaggtggtgccgacattgaagacgtacagaggtcaacaatatggtgggcgacgcacacccaatctcttagggcttgtttaggttctaacttttttcttcaaacttttaacttttctgtcacatcgaatttttttttgcacacacaaatttcaaacttttccgtcacatcgttttaatttctttaaacttctaattttaacgtggaactaaaaacacccttagaagaaaaacaaacagtagagcagcaatactgtcgcaagcaaatagtagtgcaatacgtctcctagcatgcctcaatgttctatagaccaatgtccagaacaccacgaactctcaagtctcaactctatttatcaatggtccatattcatagcaccacaaattttggcatcttccttacttcctggaaatgtagcttatcttttcttttaaggtctttaaggttaaaggggcaactttattgattacggaaataaggattatattcttggtctaacaagtctatgatttttgcgggagcatacaatcttcacaccgcacaggacgtagagctcatagccatttcagctaaaactatgagcaactatgagctcatagtctatgattttggaggcaccggccgcatcatccctgcgcttcaagaatagtcgcagccaagatgatctcgatgaaccgtgcttatctctttaggtaaattttgatactccctccgtttcaaaatgtttgacaccgttgactttttagtacgtgtttgaccattcgtcttattaaaaaaaattaagtaattatttattcttttcatatcatttgatttattgttaaatatactttcatgtacatatatagttttacatatttcacaaatttttttgaataagatgaacggtcaaacatatgctaaaaagccaacgatgttaaacattttgaaacggatggagtacatgtcattacacatttataatattagaacatcatcgtttctatttgtgaaaccggctatgttccactgaaatttcctaaaatttgagccatgccattctcttcacttttttctatcatcttcccaaactccatccatcctcatcgggggaaccagcatcctgtggtggcagagcgtgtccgcggcggcggcggcaccaacatccggcaatgttgtcgagcacagttcgcaccatgtccttgatcaccacctccttgctgatccggtcgacggcgaggtgctcgcacgcggggcaaagagttgctcgcatattgatattgaggggatttagccagaaaaattaataatcctggtgaagattgagcaggattttgtggtttaattaattacttgcatattgcaatcctgccgaatctccgggacatgcgatgtgtgtcggcacacagctgcacggcgaggttttcgttggagaggccgagtgagtagaggaactcgacaaatgcttgcgcgtgacgtcgacggtggcagggagtttgaggcctggtacgtcgatgccgaacgaggcgaggaatgtggcaacgttggcacggagcagcggtgtggccacgctccatgtcaaggaggctggggacgcaggaagtaggggctattcagattatgatactttcaaccatattatttttttttaaagttgctaaaaaaatatatacgtttagtttgttatcacatttggtaaatacataaaaaattctgctaaaattttgacaatattatcaacttgataaaattttatcattaccaaaatttggtaaagtttattttagctacaatttaaataggtccgtagaggaaagaagaggccgcagaatgggatgtgaccgcgctccatgttcatcgagcagatggagaccgcccgcatgcagctccgccgccggcgacggctgctaggggacgggcagaatccggcgcatccagcacgcaccatgcggacgacgtctacgaccgctgcctggccctcctcgacttctcagatagccgccggcgcactactgcgttatactgctgcctttgcaggattttcgggagcaccagcgaaaacaaaatccgatcgattccagggaaaaactgacaaaaaaaaaccgcgtaaaaaaacgtttcacggaaagtaaaaaaaaagtgtctgattcccgaaaaaactgtcgtccaaagaaaatagttcgtgaaaaaaatattctgattccattgaaaaaacaccataaaaaacccggttcggcatcacacaaacgctttatatatctttatctctatcaaaagcgaaatatgttgttggttcgtcaatttattcttcggatcggtttctcggcgatgtaccttttggatttttcatgcacgcatcgacgtactttccgaatcccgcgggtgtcctccacgcatcactaaatcagtttgggccaggtttttccgcacgtatatatccagttcacgatcccaattagatttatctgtgtagatgcatttcgagatattttttttgtctgttggtagagatcacatccatcgccaacaagatcaaccacgttggtacggatcaaatacggcgcccacggcccacgaaattttccttgagccgagtatgtgccaaataaaaggagcaagcaaaacctcattgggacctaaacacctctcgtcgcctagctccttgttgccaccaagcggccaaagccaatcaccatgagcccatgatgtgctctcgacgatcatccatgtgaaactctcaaggcgagagaaagttttcatacatgtatccatgagatttagattggttcgaccaactacatggtcaaacccgactagctctttgcatcgtcaaaatagtgttaagtctaaggaaagatccaacatatgagagaggtccataaataaattaagaaaaatcaatagctctaactctcgttttggatcaattatcgatattgatttgactatggataaaaattaagaaaaatcaatagctctgtcattgcttttggggtgtaaattattctattgtgcagtgcacttatagtctaacataataaaactatttaattgatactttgacaggttatggacaggtaacatatttatttttatgtttttacatgttaattgaatataaatttttagttgaaaattaagatgtttctgacttcttttcaggtttaattgtaggctattaactatcgataaaattgagattggcagctttaaagccaaggatatatttttcatagattgatcgtagagaaaattgcattggtggtatacaaacttattaggatgatgcgatttagtacataaacttgtaaaatacctgtttcagtacacgaacttgtctagttcgtgagaacgaggaccaaaatatcattgcttggtttttttcaccttttttctactatcactgtatcgtattctattttttattagagaggtgtatatctaatagtaaccttctcaaatatacataatattctaatcagcccctgaatcaataagattagccatgaagtgtccttttcgccttcctccgcacgcatcagttaagttcatgcaccaaaatgagcattttacaagttcgtgcactagattgcactcacctgacaagttcgtgtaccggcgatgcaatttactcttgatcgtatgtattctttttatgtttccctttgcggtttatgtttatcttatattttggtaagctcttttacttcctaatcaatgacttggtgttaatagctatctataaatagtcaaatactaattagttagagcgattgccttcatctatatagtaaaatatagtaaagtaatgcaccacgctcacgctcaatatgcatggttccagctccgccactaatgcccatgacgccatcttaataaattcttaacttcacctcaagcttttacttgcaccgtgcgtactgcgtccgtgccactgtttgaaattcttcttgaggttaagaaggacctgttttagacttcctataaggagagcagaagttctggaacaaaacaaaagaaaaggtaatttcgaattggtaccaaaaattacattaccaattttttttagtaagttaaacagtaagagttcctttgaaacacctcactgaaaaaaaagtacggatagaaaaaggaaacacacgatttttatctattccataataatttcaaagataaggatagggtttcctataaattttcccctataataaattgaaagtatctcaaattctttttttttttacaaatcaatgggtgttaaatgtggtaggcttggatgaaggttaaacaggcgtaattggtagtgcctacgtttaatttggtcatattctagaagttcagtaccaattcaaacaataaccagataacattaccaaacaattgatgaggtagagaaccaaacttaatcgatctcaactaggagagttacttctctatctctacttctctactattataaaaattgaatatgtttttgccggtattttggtacgtcatccgtgtatgaatcggtttttaagttcgtttgcttttggagatacatatatgtatttgatttggtttttaagatcgttcacttttggtaatacagaaggaatcatataagaattctgtttaaaaaaactcgtatagtaacttgagacgattagacgtctaactgcagctcatgagggtaccgagctcgaattcgccctata

SEQ ID NO: 67330 - DNA, 15894 bp, Oryza sativa
ggcgtcatctattaaaaacggaggtagtatatcttttgatgattttccagatagttgtatgaatggacatttggttgattgacttgatatttgattttgaattcgatattcgaattggtagagacattacaaatttaaggaaaatatgtgtttgagatttttttatatttgatatgaggtttggatcttgaattgaatttgaataagtctagggggatggtgaactgggatgaaaattagattgaactttgaagagcggatgcatttgaattagatttgatattttggaggacttagctatggagagattaatagagagacttgaaaataggttttgcttttattttataaaatacctccttgagggatatcaattcctaaacatggttcttacataacctttagagcaattctacggtccttgaggaggtaccaaattttggtacctcatggtaccgaggtacttcatggtatctcctcaaggaccgtaaaattgctctaacctttaattcggatttagaacttggtggatgcacctggacagatttgtagggatttttgctttttgagaaaattttgtaaagaatggaatggatagagaattaaaaggatcaataaaggatatgaattcggataaaactctgaatagtggtttaggatgctattcgaatttcaaaattttgaacatgagaacttttatatgggagaggattttttttaatacaaattttaggatcataggaaagaattaatttggccattgatttttttagtggataaaaatggtagggaataaggagatttgattaaagcaagagttgaatcttagcaaaattgaggataaaaaaagaatgtgtacatgtgatacatttttatgagtaaagtataggaggactgttgattaatttttgtaaaggatttaattgcaaggacttcaactacaaaattcgaataccatgaatttaatttagaagaaaacaccaagactttgaggtcacaaagattgatctaattgagatcgtctttggcaaaaaaaacctagatacaatcaaagaaccataggatttcatcaaaatagttttcgatggttaaacgaaaaccgaggcttacacattagtatataattagttctggttttgctatacatttgttgaaaagaatttctccaacaaatttatcaaatgtaagtacatattgtaattacactgtagctttttttatataaaactttcatataattttgaaccattagattttcttcaagattcatgaaagcggggaagggaaaaaattatagtgcatgcatggatgaggtgattaatttggtcctccgacctccgctttgcaaaaacagtgtgttatgctcgatttttaaaagttacatacaagttatattatgggagaatagctaatatggtccctaaagtttcactcatgggtcattttagtccttaatctttcatattgtccaaacaagtcctttaaatttgtcatgtgggctaatatagtccttggtcccaccaaaatcgccacatggatatgccatgtcaccttcctatacaaaatctatatgatttgtccaacttacccttacgcataggaaaataaaaaacaaaaggaaaaagttaaaaaatatatggtatatgcaagagcaaaagtatacctcaaaatggtgaaaaaagaagtatttttttcctatggttatgtctaattcacccttatatttatttttctatgatatacgtaaggataaattggacaattcattatagattttgcatgaatgatgacatggcatatccatatgatggttttggtggacctaaggactattctaggtcttatgacaaaggttaaggatttctttggaccatttaaaaggttagggactaaactgatcctacagagaaactttagggactaaagtagatattctctcttatattatattgtaattacatgtgaattatactatatttatgtctaacaaattttatgaaaaaagatattgactagaccctatgtatcacctattacaaaattgaaaatgagttttctatttgttaaagaaagttctatctatatagaaagtttttttaagaaaatatgcactgtttagcggtttggaaaatatattaatggtaaataagaaagtagcaaaatcgaaataaaggaaagaacacacccttaacaatatgtgattattatcgaaaagggtagtacacaaacgttcgtggttacctaatccagcgaataactcagaagggacacgcgaaacaggaggacacgccattttcttccgttttcatctttttcccttctttttacgtgattattctgtaatccattgcatcttttacgtgattcttctataataagtatttctattttttttcttcacttctgtttatttctcagatttcttttttcgttatacatagtatattttaatatcttcttaacggaaattttctatacaaataatttccgtggaaactttctatatataatgagactttatatatgtaaactttatatacgtatatataggctttgtatatcatagaaagtttatagaaactttctatatatagattttatatagaaattacatcatagttagaaagtttagtgcagaaataacaaaatgctaatgggaaattttttaaatgaataatattcttggaaaatttctatatataggctttctatatagagagatcgattttatgtatgtaaactttatatatatggactttgaatatataaactttatatatatatatatatatattgtatatgtatactttatatatagactttgtatatgtaaactttatatataaattatatctataattcgaaagtttagtgcataaattttactagaaataaaaaaaactaagatatttttcaaaaaaaaaatccaatatgaacaaacctcctaacagaaaaacgataaaaggaaaagtttatcttttcccatcgcgtgataggtaaacgagaaaccggaaaacacctttttttttgtggctccgtttttctttttgtcgttttctgttcgctaggtttgtcgctagcgagcgttcgcgtattagacatacccgattattatggtagtagccattgaggcatgaaatcaatagcactaataaatttgttatactccgtacgagttaacggtgaaagaaagtacacgttaagagcaggtacaatagtgagctaatagcccgctttttagtacatgtggcatagagctaaactgcagagagagaaaagcgagcgactaaatagtcaccggctgagcacgcgcgcatatgtaaatctacatgtcgtggggcccatgcatgtcacagcaaccagtaaaaaaataggagagcaacatgcagcattagaacaagagaatagcacgattaaaaaattgaaagctaatagcctgcattgtatgtcaggtagattatttatctattgaatgagttggcaagtttttggagccatcagtcggcgccgttattaaacttgctctaagtgctagagctatactactactctgcctcgtcagcctcgacctcaccttagctgacatttgcataaaacctgaagctgtgaagaagacccatcctaaaggggaaactcttttaatcacacggtggacgtccacctgtttattatatgccatctaaataattattaaaaaaataagattgatcaatatgtaatatatccacaaacatacaagttcaaattcaacttctataaattgtaacaaaaataacaattaaaacttaaattagtataagtatatttgcagttgaatttattatttttgttacaacttatagaagttgaatttaaacttacatgcttgtggggtgatatattacatattgatctatcttatcaagtgttctgaaatttttttaaaactatttggttgacatgtaataaacgggtgaacgtccaccaagtgattagaaaccatcctaaagccactagatgcgagattgttaaggggcgatcgatcgcccctagcgggcccccctctcctccatatggtttctttttttggcaccgcattactttcctattttagtaaatttatacacctaaagtttacacatctaaagtttaaagacccaaagtttataaatcaaaagtttatatatccgattcaaatttaaatttgaattgaaatatttttaaatatagtatttatatacacctaaagtttatagatccaaagtttataagtcaaaagtttacatacccggttcaaatttgaatttgaattatatccgattcaaattgaatttgaattcaaatattttttatatatagtatttctatgcatctaaagtttatacacctaaagtttatagatccaaagtttataagtcaaaagtttacatacccgattcaaatttaaattcaaatattagtttataggtccaaagtttataagtcaaaagtttacatatataccgtttcaaatttgaatttgaatttaattttttttatatatagtatttctatacataatttttttcaactttatgttttttattttttttaaaattatggtgtagtaggaagagaaggagaggaggaaggaagagagtagtatataggggatgggaggtgattagccggcccccactagatgcccgaatctgttcccgtggaaaatcttaacccgagacgcacggagatgttggggtcgtccacgaccacgagtataccacgtaccatatactgattgtgaaacgaactatatatacgtacgctcctgaagtcctgatcactcctaaatgagcctgaatgtatatatatgtatagattgcaacgtacgctacgcatacacaagtcgatcgaggatccaatcgaaacaatgcgtcttcgcttcaagactacggtcgacatctcgctggcggcgtcgatggcctacgcggccttcggcgccgcggtggcctacccggccagcgctccagcggctctggcgcgcgccttcgcgctcggctatggcgcgctcctcttcctgctcccgttctccgtctacgcgctcgagttcctgcggccgccgtacccaatcgatcgcacgccgctgtcgatgatcacgtgcgccacggccaccccgtcgcgctatccgtcgccgtgctgacggtgctcaaccaaggaagagccggcggcgatgtcgccttcgccgcctgcgtcgtctggatcgccgacgtggccgccgtcctgtccctcgcgtggtgcctcacgcacggtggcaccatgggcgtggctttaaacaggagaggacagtacggggaaatctgcaaagtacaggagcggatgaaaaagtccaacaaccatgcccgccttgacgtccggtacgcgatccgggatgccaagattcgctttgcggtggccgtgtcggccgcggtcgcggtagctggcggcgttgtgatcggcggcgtttcattcaagggtctatcctacgccgccgtcttcttcgcgctccctacgaacctcttgtacttccgggacacgtacgcttatcctacggaccacatgccgaagcagctcgagtggtgctacgtctcggtgcctatggccgtcatgctgttgtcccgcctcatgttggcggcacggcaggcaaccacgctggacatcaggctcgtcgccgtcaccgccgtcatgttggcaatagactttaccgcaattggttttctcgaatggcacagcaggagggagatgccgaagcctcgtggtacacgtgcgagtgcggcggagatcgtcacgtcgtttgtgatggtttgcttgcggtattggttgtatctacacgttttctacgtcattggcaacggttctcagagatggttcaattaatcagcatatatacaacggtaaaagctgtatatatgctgatatatatagcttttaccgctgcgagttgctttcatttagacggtaatagtccacttgtaataactatgtaacccacacttctccttctaatatatgcggacatttacagtctcgaagactgtaaataatactcttgccactttcacgtaaaaaaaactattagtaacaaataatgtaataatgctctattgcttttgttttagagacattaccattagtcaacatttttttagaagaaactcttaatcagcatagcggtcgaggaaccgaattttattcaaattgatcaagtgatagcagaatcaacattgcgacacgtatgtactcctacaggtacacacgaaagagaacacgtcacgttccatgtagcaataatactcatggagtcatggtcattggatcaattgatcagttaattaatgcttagcaaatcataaagaggaagcaaccggcctttgtcttcgacgtggatccttaattagactggcaagaatttacttgaatcacttgtgctcactagaggaaggtctttttttctgatcgtcagaaccttcaagacaagcagaaatgatacaaatgtgacacaaggataaaagcttctaggaaactagcatttcaattgagatcgtttacaagtttgtactcttaaaagaaaatcacatatccttatctaaaaataagtaattttacaacccttgagaagatatcataaggtaaattttttttttatcatccttgagaaggtactagaggtactatatttttctactgtaaaactagaaaggtggcccgcgtgcatgtgcgggcacttatattattcaaaggtaaaaaattttattgtttgttcaaaaattttgtatcatagattaagggaaaactaaagttcggatactattattttgtaataatttaaggattctatttttcttaaggtatcttaaaaatccattcacaaacttttgagtagaagatggattaaatacttacgacttttgaatcatatttttttctcgagtaaataataaactattgcttgtagtatggctacaaatgaaaaatgcgagagcaaagatacttaaaattcttgtgattaaatcgtctcatgaaggcacatgatataatgagaaagggagggaattgtatacatggtgaaaaagaagaaagggaaaaatgaaaatgtggagaggaagcgtaggtacccacgtatagtaggtgcgtaccgaaggtggagaggtgggacctcgtagtatttagtttgtcctaagatcaatttaatctaatggcttataatattagacccaccgatttaagtaaaatctataactaatataaatatttggatttttccggtcatcacatcgcagtaatctcggtatttttcgtccgtaacccctttttcttcaccccgcgcggttttttcgtcccgtaaccttttttttttccgtcatagggtgatttttgtccgtcaccaccccatccccaagtcccagtcagaattccatcatcacacaaatagaatccacattgagcacatcttctctccaaatctcaaatcatcacaatccaaatcaaacacaaaaccccactccaaatctaaatcggaatcaccttataggtggtgggcgtggcatgtcacgaactcacggacgtttgttatgtggcggcgaggcgaggaggagaccgccgtttttgatcgtgacagggcggaggcggaacggagcagcaaagcgagcgcgaagagaaaaggtgaaatacccctcctccttcctcggcgggcaggaaaacgacgccacccaaccgaaacgaaacgcttctgctaactgctacgaccacgagttgttactgtaatatatctggctatctgattggtaattcatcaaacgttgtgtattgtgtggagaacaatcacataaaacgaagcactctttagcacataattaattaatattaatttaaaaccttaaaatgaaatactatggatgtatttttaaaaaaacactcataactactatgtaggttgttataaaaaccggcccatttgctagttttaataagaactggtatatatagagatttataagtgcggtttttaacttttgtcttttctaagaatcacatggatagaaaatgctctgtaaatgtcagttttaaatgaatcggcacctatatgggtatccctcattagtgttcctgtataatttaactcgccaataccatcgtatatacatgcaccgtatataataaggaattatacatttcggagtacactcatcaattatcccaatccaatacacacccaactattctatatacgcactaaccaaacatcgccgaccccaccaagggtagggcgccgctcgccacagaaggcgtcgtggactgtgacagagagggagggggagtgagagcagcagcgctgccgatgggggtgtgtgggtggagggaaagccgctgatggggaagagggaaggggtggcgatgaaggagagcaggtgcgtagcggaggagtgataggcgggcagaggagagaaggccgagaaaaacgaggagataagggtgacggaaggatcgaggcacgtgggggtatgccgctctctgttttttttacatgtgcgccacgctctcggttcgacaaaataaaattccataggaccacggtccttcgctcatgcaaaggactcttaggctttgctcttccccatctttcccaactcacctctcttgtgtttcacgcgcacgttttttaaactgctaaacggtgtgtgttttgcaaaaggtttctatatgaaagttgctttaaaaaaaatcatatcagtcctttttaaaaaaattaataaatacctaattaatcataagaaaatgtgtcgttccgttttacgtacacggcacatcccgaacacagccttaggttgtgttttgcttggacgctttacaaattgctaaacagtgtgtttttttcaaaaaaaaaagttttctatatgaaagttgcttttttaaaaaaaaatcatatttatctattttttaaaaaaataataaatacttaattaattataagaaaatatgttgctccgttttgcgtacgcgggagatgagttcccaaactcacctcctctcgaccacagcattagcctcttgcgcaacacgtgttaagttagaatctgaaagcaaacatttctccttttctctcatgtccccaaatcctgttagttgacaccgtgattgggcgtgaagcgcgtgcgccggcgtcggcagcggcagccgcatcagcgcgaagctgcgtgcctccattaatggcgtgaggagcagcagcagcagcaacctagccggcatgaggtgaagctgcaccgcgaccactgcatggctcgatccgatgcatgctttctggcgttcgctactcatggctgagtaccgggcatttacctggcgtggtgcaaaattgttgattgtgagcttggaattacatgattaattgcaagtttttagatggaacatggacatcattcttgctgctctgattcttgttcggatcatcttaacacgcacacatgtcaccactaagagactatgagtaaatatgcaaagtatttttatctgtcctgattattgttagttaattttatgatgaacttacctatttttaatacagatttttttcacaaagttcatatcatacatgtacacgtggaataattttccaaacaaaaaagaaaacttttgtgattattattatcatactagactgtttaaaaaatcgttcagttaaattttatccaacgtgacattacccgtgcaacgcacgtgtattttgctagtcaagtaatagatactttgcttttttttcttagaatttataatattttctctaatttattagagcaccacgtggcagcttgggggcattttaagaaattttaacggacttaccacatgtgattagaatattaaccatgtaatatatatgtatgggatatatgctaatattcgttccagcttagtccatgtttatatacatgtagagagaaattaatatgttgctagtaagctattagaagtctaattaatagcaattaattttgacacctatttacaattgttcatagtagctcttgcagattcatcttatgatcttaattatgcgttgatcaccaatttactaatcaccatgactcacatgaaaaaatgtgtactacttaggtttaggacaattgaaattgatgaattatctgatttatgtgatagctatttgagattataaacgaatgaattaacttcaaaaaattaaaaaagttttttaaaaaaaacaccatttaggaacttggaaagcgtggagcgtgcaaacaaaaatccaaaagatggaattatgaaaaaaaagaccttaaagtcccttataacactcttgtactagtaagagttctattgatatttattaatattgttcttgcaaccgtataaacaaataatataaaatccaaatacgacataacacaatacgatataattattatgtaatcaactctgggtttcagtttaaatagagctaaatgttggaaaaactcaacccacggtgcttaattcttctctctctacatcacacctttaattttcttttcatgttattaacaaaattaatcatctccatatatgatttgatatgtggcaaagcggtagcgctgcagtggtcgtgatcaccttagatgcctcagacatgacactttgtcacacgtgcgaaaggcaaagatgcaaatgtgcattatgcagcgggccaaaaaagagaacttcggacactttatttgttaacaatagatccgatgatttaaataatgggtccaccggttatagtgtaaatgtaaattagttaatatagattttaaattgttaatttaatgggtacacaatataataagtgtagagtttattttaaaaccgtgcattatttgataataatagtccaaagtaataaaaaatagatccgatgatttaaataatgggtccatatgtttaagtgcacgtataaatttgataggtacacaatataattgtgtaaactgtattttaaaatagtgcattatttgaaaataatagtacaataatgagtacactggtttaattgaaaattatcttacattattgatttaatgggtaaacgtataatggtgtaaattttattttcaaagattgtagagctaatttagttacctgtgtttataaagagttatatagagttatatgattgtatattctttctttgtaaaattttaaaaatatatatcaattgtataaatggaaaatataagaaaaaagaggaaaaaaaaacatgaaaggagccgtacgtactacatacccatgtgaaagaggagaggtgggacccatagtattttgtttgttttatgatcaatttcatctaataatgtataataatggactcaccaatttaagtgaaaattaaggggtagatgttttgtttttttcttagaatttctagggatttctctaatttattagagcaccacatggcaacttgagagtgtttgtaggaagtttaatagacttttagtatataatagaagatttgatacctctaggtacagtccttaaaaaagtacctaaggtacctaaattttatactaaaatttttgataccttgaaatacttagtacctagagatatcaaattttacagtagaaaaatatagtacctctagtacgtaccttcccaaggatggtaaaaattactcttataggatatattataggatatatgatcacctatatagggcttgaatttggtgtggtttctactctaatattggacaatattgaacttatctacaagctttattgaataaatacaaaattcagcatattcttgtaatccttaaacagaatagttactgctgaacagtttggtatactcagaaattgattgtttggattcatttatctaaatagttctcagtcacttgctaacattgattctctctcagattaagtatatggatcttgaaactttaagaaccaggttgaatgctatcgtcaattctgcatcatttcggggcagtatgtttcattggatttcttcagcagcttcatccaaactaaactcacaacagctgcctgtgatggagatgcccatctaccatgatagagttactcctggacctaataatctgccctcctgtgcatataatgtagtatcctccactcagggtgagttgagatgatgagttacctattttaacctcacaatgcaccttatttttttaaaattctttattggcttgattttggcaggatataaacaatatgagcactgtaatattggtgctgctaactttgctcattcattggctgataaacccaagcagatgcctaaaagattagcaaacaccatttttacctcatgtgcatcaactctaccgaaatgtagccctagtattgatgtactgcatactggccatataaaagaacatttctcaggtgagtttacatcccctttcttatgtctgaaactgagttgagctgaagttatttggcatcataaacactatggtcaaatttgccaggtgatgctgatgatactagaattttgaatgtcaagaagaatgaatgttgacgaattttgaatgaagtatataagagtaaaatacactgctggtccttcaatttaaccgtggtatcgtgcacatataatcttgtaaatttctcatctaggtatatatgtaattttggtgttatgaatcacttgagatccatagcccctttggcaagtctcgccccatgactttgttgtcatggtggcaaacattttgcatttagccctcctctaaaactaacaatggtaacaaatttgtatttagtcctaaatgagtaatttaccctagtctaatttaagaaccggtcatatatttcaatgaataggatgttgtcaccctatacttatttctacagaagttgacagcccatttttaagtcgcgccctaataaggctcttctgtgtttcgtcaatgaatctccgttttattgggggcaaggatcgatgcttgttgacattgtcgcattccatgcaggggtcctttccaagcaagcagattctctttaagcacacggcacgttgaattataagccttaaggcctctcacagtgcaagacactcaatgaggggcttagcccaaaaaagtgacccaaagacactcaagcccacagtgcagttattttttttgagtgacctaatgagatgaagctactattgaagtatacaaagtctacagtggacgtaccctaccacatgtggcactggcaggcaaaggaaattaattcctcacctacccttcctttctcgcgacccttctctttctcttagccgcaccgccccttcttcttctccctcccacgcgccgcgcctccttctcctcgaccgcgccgcctcctccccgttgacctcgccgcctcctccccgtcgaccacgccgcctcactcgcgcctcgccgcgcctcctccaccacggcgaccgcgagcagcggcggccgaggcctcctcccacgtctgtctccgtccaccgccgccgcagcttatccgtggcggtgttggcggcagagctcggcatctctccggccaagacggcggatctggtggcctcggcggttgtccgcgtgaggccctggagcggcgagcgattcgaggcggcggtgaagggccgcggccgagaaggaggtggagatggagaaggtggcggcggtccggagcagggcagactccgtcggcggtggctagcctcgtctagttcgacgacaacggcaacggccagatctcgtggctcgagagcctcggccacacagccaccggcggcgacggcttcatcagcctcgacgagttcgccgtcctcaacgccaccgccagcggtgacgctgccaccgtcaagacggtgggagccgacgcgccgatgcagcgcgaatcctgtgatgattttgctttctttttctttttcattttgttgaatccgatctgttcttctcttccaatcttcaagattttattgcttctctatcaatccgatttgtggcgggaggggattttggaagggcgaatcaggaattttgctgccgcgtgagggtattttgggcgctaggccatgcgagcacgaggctgcaccgcccacagcgcgcgtgacccgccttttctcctcgctgcgtgccctcgttttggcgaggctttgcgtcgctcaggtaggggacgacaaacctaactaaggcgcgggcgcttgctccacgtcggtgaaaatctgagctggcgcaactaggtaactcactagctcagtgcactgtgagaggcctaagtattgcatcaccctcttcttaacctcaaaccctttcatttccagtaggctcaaattatggtgcttgaaatctgaagttttccgtgtgacgttggtcttctcagcaccatactcgcattcgcatgcttcacacgtatgccggcataactgcattcaacaaatgttagacgttagaaatatatttacttcacatatatacgcatcaatcattttagatgaaatatagtgactccatttaacagaaatttcaaaaaaaaaactccctcattccctaaatgttcgatgccgttgactttttttaatatgtttgaccgttcgtcttattcaaaaacttttgtgaaatatgtaaaactatatgtatatataaaagtatatttaacaatgaattaaatggtaggaaaagaattaataattgcttaaattttttgaataagacgaacggtcaaacatgttttaaaaagtcaacggcgtcaaacattttgggatggagggagtatatataaaggtactacctccatttcatattataagtcgtttgtcttttttttaatcaaatttttgttaagtttaatcaagtttatagaaaaatttaccaacatctaaaacatcaaattagttttatcaaatctatcattgaatatattttgacaatatatatgtttgttttgtgttgaaaatactattatatttttctataaaattagttaaaattaaaaaaatagattaagaaaaaagttaaatgacttatactccctccgtttcacaatataagtcattctagcattttccacattcatatcgatcgatcgatatgaatgtcactagaacggataccctcatctcaatcgggcggtaagccccatctcaatcgggcatggcgtccgtcacaggctagaagtcactgatgtgaagagctatttcaatcgggcaaacggctgtcacggatgattctatctcaatcgggccctaagtaaagcccgtcaccgatagctttgacccagacgaccagtcaaactatagcccgtcacagatgacctatctcaatcgggctacaactagtgcttgtcacagatgacccttatctgtgacgggcattaactatagtccgtcacagatgagtaatctgtgacgggcattaattatagcccatcacagatgagtcatctgtgacgggcattaacttatgctagagttaatgcccgtcacagatgagtatattccaaaaataaataaattttattttttggctagccctcactcgtgtgcacacttaacgtcaaagttctttagagattggcttccggaaaaataattgtgacatgttggtatgagtattctattaatcctattatgccttaggccaggatgttaaattggggttattaaatgatttcaaatggaaaagtcaacaaaaccaaagttgtagaactcatcgaggtgcaaaatttttattttggtcatttctccatctgactctatttaaacaatttgaaatttgaaattcaaagtttgaaaagttcaaatagaattttagatcagtgaacgacttcaactgaaaaagtcatcaacaacaaagttgtataactcatcaaaatctataacttttattttggtcatttttctatataacattttttgaaccgtttgaatttg

SEQ ID NO: 67331 - DNA, 11932 bp, Oryza sativa
  unsure (1)..(11932): unsure at all n locations
gtgagtaaatgctagtaggaatgaataaactagaatttgattaatcggattaaaatccttttttaatagagcaacatgtgagtaaatgctagtaggaatgaataaactagaatttgattaattggataaaatccttttttaatagagcaacatctatttcccataacattatttcataaaaagcatattggtcatagtaaggataaacaagtgcgatgaagttacactcaaaactaaagatccattcggcgcatttcattatatgattatcccacactaatatgatgtatctcttagtttttgtctatctctaaatctacccataagtcatagcaagaagtatcaatggctccgtcgaaattggaattcagcaatgatgaaagagggtagcacacgagacctaaaagtaaatagatgcggagacaaggatttagatggatttagacaggttcagaccatctcaataagaggtacgtaagaccctactcttgtttggagattgtatctactgggtgtagtattgatctgacgatctaattgtggttatatgtgttcttgctcttgaaggactctcccagctcgtcttatataggttgggggaaggattacagaggagcctgccttttatataggctgggggaagaattacaaaggagaaacctagccggatacaacattagtttcctaatctattatatgatagtactcggtcggagctctatacctgccttaacatacaaggcaacataacaactgagcaactgagttctactctattatataatatatgaatccggtccacctactatctctagtcgaatatagaaaccgtgtggatgtccaatacacatattctctacagcctcatcgatgtttttagttttagtatatacgacattacggtgagtaataataagacttgcaaccttcaagttaaaagatgtaagataggagtgaattagcccagggcatggccttcaaatcgcaaccttatgaaacccctttcctaacccaaaataactctcggccttagctcctaccgtcactcccacgtgtgccgagcttgcgcagccaacgcatccaggacctgacacgtgcgtagttccacgtgtccttcttctccatgtcacgccggctgccaccaccacggtataaaatcttgcggcattgcacggcgcgcgctgcggcgagagccatggcgcaagttcaagcccgacgaccaagaggaggagaatgccaaggtcatcaggtagtacagcctgatggcggcgacggcgacgccgagcggcggctcatcgccccggcggacgcctcggggcaggccgcgcactgcggcggccccgtcgtggaggtcgacgacgcgtacgacagcaaggtcaagatcggcgaggcgctggaggcggcggcgagggcggtcggggaccagcccgtgcgcgggtccgacgcggcggcgataagctccgcggaggcgagcgcgggcgcgggcgtcgtccccggcggcgtcgccgagcaggcgcaggcggcggcggacgccaacgccggtgccgcgccgcccgcggaggacacggcgatcaccatcggcgacgtcctcgcggtacgtctcgtgcagcatcgatcaacccgccgcgccttctatttgcacctgatgatctcactcggccatggcatctgtgcctcgtttctagtggaacgcgacggcgatgctgccgacggagaaggcggtgacggcggaggacgcggcggcggcggcgggagcggaggtggagaaggaccccggcgaggggaccaggccctacggtgtgagcgcggcgctcgccgcggcggcgaagcacaaccgggaggacgccgagtgccagtcgaagaggagcgcgcagccacgggcagccgacgaatgtacacccgctctggccgagcagttcgaccaaatctagcgaatttagcatgcgtttgattatgtattagcgcgcggtttgccgaacgctaagcgaatttagcgagtgcttgaatccaataaaataattaataatatgcgtttgatcaagtattactaacacgcaagaattattagacttttttatcgtaaataaatggagaattacagggctgctaataaatcgtcttggctactcgagccatgttgcctgttgcgagagcgagaccagtgtgaccgatcggcacgacgtgccacgctcgaaacaaaggcggttgggagcgccgaactcggcatggcagcacacggtggtggcatgtcgtgtcgaccgctcccgatcccaatccgctgcgaacatgtctcgcgcgcgccttccaaaaaatctgtttcatggcacgttgcacgtagaaaatgggaaagtggttttatcccttaagatatctcctcattttatgcttacggatacctccttattctttacatatattatctaaatacttcaccttttcatattataaatcttataacttttctttgtcaaactattaaactttaactttaattatgtttgatcaagtttatagtaaaaatatacaaatatttttaatacaatacaaacatattatcaaaatatatttaatgataaatttattgagatttagtgttataaattttgctaatttttctatgaatttgattaaaacttatcaaaatatatttaatgttaaatttattgagattcagtgttataaattttgctaatttttctatgaatttgatttaaactaaagaactttgaataattgacctctaatataaaatggttagagtattatcttaaacagttatcaattttttaaaaagaataataagaaagattaatataaaatatatctatcatatatatgcaacttcaaattaaacttctaaaattataagaaaagtacgtcagtattatttgatattatatatttataaatgttccttctaaaaaagatttttttccttcaaaaataatatatatttataaaatgatatatgttatattaattattttttaaaaaatatatctatttaagcggtatgtaaaagacgaggcaaaagatgaaaaacccatctccatctctttcagctagctaacgcagcagcacaacgctcactgtgcatgcagtccgtgaagtggctcaagcactcgaatctaccagctagaatcaaaacacgccgcatctgccatacccataccctctcggctctcgctggttacccctttcgaccgccaccggcgcgctctggtgtaaaccccccacgacgccacgtactctcggtctctcgccccgcgccctcacgttgtcacgtacaaatactctcgtcgcgccgcgcgccacctcgccgccgaggcacgacgcgcacttgcgccacgagaacgtgccacgtcacgtgtgttcttttgacgcaagcatgagccaggggcagccgaggaggccgccgcccgacggcagcggggcccggccggtgatgtacggcgacgtgttcgacgtctccggcgagctggccgggcagcccgtggcgcccagggacgccgcgaagctgcagtcggccgaggaggccgtgctcggcgaggcgcagaagggcgggcccgccgccgccatgcagtccgccgcggcgatcaacgcgcgggcggggcacgtcgggcgcgcgcaggtcaccggcgccatcgccgacgagggcgtcgccgtcgccgtcgccgagaccgagctccccgggcgccgcgtcgtcaccgagtccgtcgccgggcaggtggtggcgcggctcgccaccccgccgcgggtggtggccacccagccgtccggctctctggacaaggacgccgtgacgatcggccgcgctctggagtggcggccgcgaccgccgcggcggcgggtaagccggtggaccagagcgacgcggcggcaatccaggccgccgagatgctcgccacggggcgcaccgtcaccgtccccggaggcgtcgccgccgcggcgcaggctgcggcggaccacaacgccgcgcccgcggcacgcgacgaggacaggatcaagctccgggacgtcctcacggtgccatccgccgcgctctgcgatgccaagtccgctttcttttgaccgtacagcagctatagctaaccttggatggtgtgtgtgtgtgtgtgcacgcagggggcgaggggcaagctgccggcggacaaggcggcgacgagggaggacgcggagagggtgccgtcggccgaggtgcggaacaggccggacatggcgacgacgccgggcggcgtggcggacgcggtgaccgcggcggcgcggctcaaccaggagcgcccgacccgtagcttttagcgagcatatgtgtttacggtgctaagtatgtttttcttttcgtttgttttattttttagcaaaaatgtgcgtgctaatatgttctatatactatgaataaaactgttatgtgtagcattctcctccgtataagagagtcgtcgcatgtgttaccgtaatccagagtgctaatagtttacaacgagcatatttgacatcaatcactactcactaatgatcgatcttctagacgaagcagcaatataatacatatatactccctccatccctaaatatattatataaatataaatataatagtactatataagagattttgtaagagattttggatgaatggtttgtattttagtactacaaactcctatataaacttctgtatagattcataatactaagatacgttcattcatccaaaatctcttaagatacgtcaattcatccaaaaattcatccaaaatctcttgagatacgtccatttatccaaaatctcttatagatatacgtcacattcatctaaaatctcttatggtttggttcatctaaaatctcttatagtttgggactgagggaacagtcattaacaaatatttatattcccagtcattaacaaatatttatatattaaaaaacccttatattttgagacgagggtgtagtcattaacaaatgtttatatattaaaaaaggagggattactagttacataatcctgacaatctattaagcgatatgtactgccaataagtgcagatataatcactccttagtgtatattcaccatatgctgtgaaaattgaactcattgaccaacaagatctcgccgctgcaagtattacaaaagaacgattcattgaactttgcatttaactttctaacaacagttgtgcactgccttcttttcaacttgaaacggagccagtgagacacatctacaagggggtcggtggtggagaatgcactttgagttgcaaacttgcaagagattttactctttcaatttgatgactctctaagacatacgcgactagtagcttgttgcagcatctaaacatctgtcagaattatcgatgatacaatcatgacatacgcgaggaagaagaacatgacaatctggatgaagaacttgggattgtccctcaagctcggagcggccactgatctactgcttgagaatacaagaataaattcagttatgtacagtcggtgatgagctaggtgtggtacaaaatgatgcattgcagcatatcttaccttgcaatgcgttgtgaaagccgatgaaagggtaggctctgtatgaagaccacgcctggtcctgtgagagatgctgtaagctggttacccccctgcatagccgatggttcatcagtgtaaggaaattagttattttcaacaagaaactttagttgataggcagtaggggggacggatgtactcacactgaagactactcttctcggttggttaggggttttcaactgaaagttgatggtggttgtcatagccacaatacaagcagcgtcaactgtaatcacctcacgaggggcaagaattttctgcatgactagcaaaagtgaagagcaaaatctgccagagttaggggctttgttggccagggttaaaaaataacttgcttatgtcaaaacaaaaacgatatgagttcaaaaggttccatgctaatttgaaacaaatcggagatttcatacttcactatctaacttatgacagaatatgtaaatatatagtgaattggatagtgccgcaggtattgccaatgttgacaacattaaaatcatgccagcataaactgtggcaccatattatgttcctttagcactagatagtatatatcctcaatgcatcctaaaaattttacagaacatcagaaccatagctcctaattatagtatgaacaataatatattctagtatttactccatagatcagaacagtattgcagtttcaaattccaaaatcaatctccagtccatgaaactgacacaaagggtgaaatgaattatacctgatccaccaccaacaaggaaagccatcccttgacccctaagcttctgtttgaggatcacctgtagagggaatgcacatctttcaattcccaacaaaaagttaacaagtactagcttgcaaagaactaacaggtcccacatgatctccaaagtacctaaataattagttaattaccctacctctgcaccaatttcaatgtttcgcggcctctgctcaactgtacttgtgactgacacatcattaactgagcagagaaaagcatctgcctgaaaggacaataaggtaatatgaggtttctgtgattgttttcagccaaacaactaacttcgcacataacttacctggcaaagaagttctccaccaaagtttgctagatccatctgtaatataataaacattttccatttatgactaagaaagcaggttggtcaataatataagtaccactttccataaaatttaatagagtaaattatatgaacactgaaccaggtattcattttcacggaaggcaatggtttgctggaataatatgataatatcacatctagtcatccagaacctacatctcatgcagcttactagattaactcatacatgttattatcatgctagtatgcacattacacctcattattaattgctacaggaccaaattctaatgtatgcacaatgaactgttgacctttttatctataggtaaaacatatggttcagattggaaacaactgagtgctggggagtgcatttgaaattttgaacaaaagaatgaagcaagtcctccaacagtctaaattctgaatcataattatagaagaatgatggaaatttgtcagtttgtcactaataagatatgtaatcttgctaattgtaagaggacaacagtgatgattacccatgagcgatatgctcatatgcagttctgtacagtaagtaaagtaatggtgcagagagtcaaagctaagctacaagtaggtgaaagatgatactagggatttgaatgacataatgactctattttcaaaaaagatactaacaggcagtattctcccaggaaatggtgcagaaatcccaacatatccatcatcagagccagggttgaagaaaacactgctgcttatgcttttcccaaaaatccactgccacacacctccatcattttcaggcaagtagttgttgtccgtttgaatattaccagacatgtagcacattgtacctgaagaatacaacaatgatgaaagctacacactaacaaactctaagaacatcacaggattcacagaagccatatgacaagcactagcagtaacaactgcatacatgtttttttcgagggagtagggcaggagctctgccattcatctaaagaagacaatttgaaatgtttacaacaacagttttggatttactattacaataaccgcataaatgtatgtttggctccgttgcctatctatgagcatgtaaatccttatccaaatttaggtactcctgggtaggtaaaggaacccacatagccccttaatttactaggaatttcaggacaagttacagtaaattgcactacaaaaccatgatagtaatgaaactactcatgtatattagatttatctggttttatcataacatacaactaaaagtatggtggtaatctatagttctgcaactgatcccaattattacaaagttaaccttaaaaacaacaggtaattcagcatctgaaacaaagagtattcataaatcgggcaagctgcagatatttcagctgcaaaagagaagttcaatcaagttactggagagtacctggtttcacggtcaacttttcctgtgacttaaccatcacctaaaatatcatttcgacacaacaattccgaatgagcagggttcgattcctcttaaggatcgaagattaagagctagcaaacaagaataaccaggagctacctgcaggacctgcacatcgccgccggatatctggaacgccgtcacagatccttcctggctctggaaccaacacacacgattcaaaccaggttagatcagaggggattccaatcagcaaccaaacgctacggatcgggcggatccagcccgacgagctcgaatctagccctaacatccacgccgggataagaccagaccgtgtgtgcgaagggaaaaattgaaggatcagatcgtgcagcggaggagccccacctggtagacgtagggctggaaaggcgtggagaagaagggcgcggccatggcggggggtcggagccttccggaagcttctagaagcgatcagtgagagccgactcggagcgtcgtcgtcgggttcgagggaggcggagttgccattcgacgacctctcggggtccttccggttcagggcttaatttctcgagtttttatctcctcttccttttgcagtcatacgacgtgggattatctgggccgtcgatcgagttctggacggtgggtgatgcaggggaggtgcttgcgtggctggtctcgtggaagccctgtgcacgtatgcgtccgtgtaatgttggccggtatggcctggcacgacttggcaggttaatgctcaggtgaatttttgggattgttggctttttttttttacacttacccaccactgcacacgaatttattcccgtttaaatgaatcttttattttcgtcataagttggtactcgtagttgagttctactgtaaatgaaaaagatacgatggtttttgttaacaccaaaaatttaacaccttgacacgaaataggaaatcattgtcagagtttgaaaagtacgtttctttcacatgaccagtctgaccgacgacttgtgactagtcagaccggctaagtccgagtctgagtctcgagtttcattgtttggtaatctattttttcgagtcctaattgatctctaccctaagttagacgtggaggaggtcttatagaaagcaagataaacctctttataagggtcaagaccagttcgattgaccacacaatctgtttctagcacaattagccaattgaatcactttttcaatgtcgcatatactttctgcctaattctagcctagttttgtccatttttgtcggtttgaactaactgtcatctatcctcgctgtaagagtgcaaatacccttttgtaaacttttcatttgcccatgagacgggtgtttatccctgtttcatctaaatcggctccactggccgatttaattttacaaaactcatcttgatttaggctgtgttctttgctcaatgttccacccctcttcctcgtgttccgcgcgcatgcttttcaaactgctaaacagtgcatttttgcaaaaagtttctatacgaaagttgcttaaaaaaatcatattgatccatttttttaaaaaaattaactaatacttaattaattacgcgctaatggaccgctccgttttccgtgcaaaggaaaggagttcccaatccactgaaaagaacgcagccttagctttgtttagatcgaggtggttggcgactccgtgtcaccatatgacgtttaggtgtttcgatcgtattttgtgacttgttcaaaaaagttgccaacaactttgaatcctaaaaatatggtaacacacatcgagtgaggtatagccttgaatctaatgtctaaatacaagatgcaacgtgtgagatatgcacttctttctaatgatagaaatccaactaaattgtatcgaacgggtgcaagtgcacaagattaagagacaagctaatagggttgctcatgtgttagcacaaatggcaacgagtactaggtcgtgtggggaatggaggctgtgcgcccccgcatcaatcctagacttgttaaatcaagaatgtaaccctctatttagtcattaataaagttctctcttgactaaaaaaaactacataaaacccaacggggttagacattataaaatccacttatatataagaacgctataccattactcatccaatcgctttatggcaaatatgcttcaagcttctgtcggttagcaagttccacttcatctaagatataattaaaattcaagacaacaaatggggttgatacctatcatgccttgccacactcggttagaagggctgaattttaaagtgtattgtcagactgttggtaacttgatcatactttttcctaaattgctttaatttgggatgttttatcttctcgttatatttttctgttgttagtagagaggtgcaaccccttaattttatacatatataacacacgtcttatatgaatctcggtaaaaataatgatggaagatgaaccttagcatcccatatcattaatgtcctcctcacctgagatcatgaaacatgaaccacccctattcgatttattcaaataactgaaatatgcataactctcaagaaacatgaaccgcccctattgagtttattcaaataactgaaatatacataacgcttaacacatatgacagtttaattaatataatgtaaccgctgatgtgataaagtggcaatactatggagaagttatatggcaataatagaccatgtaaatgattgtgctttattcttagtttattaccatattatacaaaagttcaatgaaataaaaacaattgtctttaatatgtccggctatacttaaaaataatttatgtcgtttttcagaaagtagtaaaactacattttgatctcacctttagcgggaaaacttgttgctaataccggacagaaggattggaaaaagaaagatgtaattacctaaacacaaataaacaaggtattgtgatttgttatgttaaaagatgaagagttatgataactatattttgtcgtatgcgagggttttataacatacgtcatgccatgttgactcattggaatccgaaacttatagcaacatcaaatgtgaaatgatccattagattgtttggaccttttgtttatttattattaccattaccattattattattttttagaaaataatatagatatgtgataaggtctatatcttttcagacttacctaatccaccatagactgccacatcataaattctacgtgtcgtcctccgattcaacctccacgacacccaaaaaccctctccatgtacaacgtggcggtcgcgccgtgccagctggaccgcgatgtggcagaccaagtccagccaaggcccaaccggcccatatcccagcattaactcgtgtccagttttagccaaactcaccgtctacgtacgtacgttacgtatacacatactccatacatacgcccaccgtatatgatattggtagagtagagatcagtagacctgaccaccagcctcccccacccccacccaacggagagagaatacggctactcccattctctctctctcgcgtcgcgttcgttggctcgttcgttcccctcctcctcctcctccacgctgctccacctctcgctacgcttcttcgctggtaagatcgcaccaacccaatcctgaatccttcctcctcatcccccctcgtctcgccgattgctgatctcggatccgttcgttaggtaaaccctagatggcttgatcgcgcaatcgctcggagcaaaggcggnggggggggggggggggggg

SEQ ID NO: 67332 - DNA, 3645 bp, Oryza sativa
gggggcgatgcgggcggcgacggtaacgtgggagacatgcgggggcttcttcagcgccaggacgaagtcggtgcccggcgggaacatcctcgatgaccggcggacgtcggggacggcggccagcataatccactcctgccgcggctgcgcgtctcctacctcctcctccaccaccaccgccgccgccatgtcacgctcacgcgaggtcggcgagctcgccatggctgtgtctgtgtctctgtgagcaggcccgtccctgagggcgtgcgacacgagcgctcgcacagggcccccattttcaaggggcccccaggctcatatacttgcccttccgtggttcagtcccattgatccaattgataacaacagaaaggcatggaggctgctggagcgtgagtgtgagctcaattaacgagggaatgacgccgcacgcgcacgaatgcacgacagttccttttttcagatcgatctcaccacctatccgccggcctgctgcccaatcacctagctccctcgctttgttttcttttctttttttttttatgttaagatctcaccgcctatccgtgggccgtcgcccgtgacggtagagctcactactcttgccgttgcctggcacaacgtcacctatgcccggccaccgactcggtctctgcgctagtgagctcgtccgcacgccattcccctgcttccgatgccggagcactactgcatctgcagtatgcacgatgaaaccatcacaccggaaaaattcacggttataggcgtcgtcttgtgcttttcaagtgaagattatgtgaaggtattagtttttttctattattttgttggtacgaaatatatcataagtataaattgttatcatcttttttattatcacttatgtttaggctgtgtttaaaattttgaacaggcccctaaattttacgggacggcactgctgtgagtggtcgggtcggtgcctggaggagaagttgggtgcgagtctgggatggtcgaggcccgcatagagcagggggtttggggcaaattgaccaatggggtgcgtaccaatgcgtattgggctttaggatgggttcttccagaagtttcccagcttgcaagagaaggaattttttttatttttaattttttttattaaaagttttacaaaaataattttccattttgaaaattggcggaagtagtcgcctaccgctctttgggagggcgatttttaaaaatcgccatcccagagggcggcgaaaatgacgtggcagacggccgttcgctctcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctccccctataaagcccagtcccccctctctgaaatttcattatattcactaaatatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatttggagaatgtaacctacttttagaattttggagaacaatattgcagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaatatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatagcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggccgcgttcgccagctcttcctctcacggagcgtcgatccctcgcccacacggtactttactttttattaatactattaaatacctgtatggtccttgtccagcaggatttgtagccgggatcttcggtactggggcctcttcgtctcacgccggtaggactggtcctactagccagttctacaacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacatactcccaggggcacattagggcgcagggtaggagggacaggggtaagaggcctcgtcagtagtgttctacctcttcagtccttatgtgaccgtttcttttggcttacaaacttgtaaagcagtactactgttgctattactactgtagtactacttgtgtttgtctcgtctacatagtccttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggtaaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacaacggaacccgtgcttacccacgtaatgaaacaagatcggactacctaaggcggaaggatgagcatgaacgtcgaattgctgctgaggctttagaatggcacgtaaatcccctaggactccccacgtggcgtgagcgtccggagtgtcgttgtggtg

SEQ ID NO: 67333 - DNA, 13894 bp, Oryza sativa
ctgccacccagttgtcgattagaatagcatcggagtttcagccgatcgtatctgatttaactataattatctctatttgcttcactgatatgttaaatctaccctttatgccaagatattgttgtatttgaatatattaggtttttgcttgatattctatatttgttttaatatcctgatatagagtagtatcggagtattagccgatacatgctagatctatatgatcggctatgctgtaaacttatatagtcctgttattaatatatatttcggtctaagtgatttatactgtctcggcatggcgaccgatctatcccaatcacttgatttaagtatatatcgatataaggagtatataccgttaacatctacagccgatcaagtaggtttagttttcttccttatttattcacgattgccgatcgatgcacagatgacatcggctaagatataaatgatatgtcatcggcctctggccgatcggctatcatttatagatttaactatggctcctttgtctttatttcttgttgattataggatcaaatcaactggcacgctcatacatccgaaggcgagttttggacctgcactggagttaagcagatatctcaggcctcatgttttctgtcaacacgcttttggcacgcccggtgggacctgattagaagttaggcgttagttcttcctcatggccgagaaacgagcaccactaccatcaagcccaggctccgttaaaggcaaattaccgaagccgggattgactgacatcattgatgacaatgtcctgccgatcgatcccgagaaattcacgcctgaccagaagcaaaaatttgaagcaatgatgcagcaagcacgggatcagtatctaagctcgttcatgcaaacccgcaagggaatgctggttcagaagtacaagttaaaactggttgctgacaaccctggaaccggttcttctaaagatggagaagtgaaacaagctccagatggctcggctcagccgagcaacaagggtgctaccagtggttctataggaaatcaaggcgataaccctcaagaagtgcacggagctccaggtgatgctgctcaagggccgcaaggaggaaatcttaatcagaatattgagctagcacaagattttttcaacaacttttaagatcgggttgattacgcggtgcatcatgctttgatcaatcaatccggggtcttagtcaatacactgtcgaacatgatgaaaacgatagccgatggctcgatagctgagcatcaggctacaggcccggcatacttgcaagaaggcatttttccgaattatcgaactttgatcactgatgctcagccagttgtgcaggcgactccatctgtcgaacccacgactcaaccaacagcgccagcatcaacgcccttacctgctacatcggccacggcgtcagcttagccgatcaaccctcgattgctaatgagggaacatccacagcttgctggaaaagcctcgaatcagccgactcaagatcaggttgctgctatgttttttccaccaccaccagttgttgattcagtgcagcagcagccgatccagcagacgtcatcaattcagccggttgtacagccgatccaacaacaggtcgcgcagccagctcagcaaacaccaccaattcagccggtggtacggccgatccaacaacaggtcttgcagccagttcagcaagcaccatcaacgcagcagcatctccaaccaatccagcaaacaccgccaaggcaacgccttcagccgatccaacggactccggtacgacagcaggtcgttcagccgattcagcacctggggccagccaatgcatcggctggatttgcagcacatggggggcaacctgcgcagcagtttgtgaatcaagttatcccggagcatttggttcatcatgcacaaccggatggcaccttagtaactcatatggttcctgagcacttggtgcacaacattcagccgaatctgcataactaccaagggggtaacttgaactatcagtatcagctttcatctccgcaagcccaatatcaaccagggggatcggcacagcaacagttcgctcctcagtttggtcagtacgagcccatgcaacagcaaccacaaggagcagctctgtcacaccccgaagttctttcccaagcctaaattgaagttataaatggtctcaagaaaataccagtgtaaagcaagagtaaaccttaataaattaatgcaagtaataatcggaattggcatgtggaatttttcttgagttctacatgtcgaaattcgctaacaagatttttagtggaattttcagagctctcgaaataattttaatcaattaaaattgagcacaggcaatatttaaatccctgggaattcctttcttcctttttcttttttctttttccttagtgggccgccggcccattccccctcctctctccccgcgccttgctgggccggccggaggccacggcccaactcagcccgcgccccctcctctctctcggggtcaccgacaggtggggcccacctgtcgggtcctcccccaacctccagccgctcgccgccgcacccgcaaccgccgtcgcgcctcgcgcccgcgcctcccgggccacgtcgtccacgtcgccttcgcgcccgcgcctcccgcgcccacttccccctctctcccgctcgcccgcgctcccgagacggccgggattcgattttcgaatcccgcctctctctcctctcccactcccccacgtcggccggcgattcccgcctctcccagccacgtccggccccctctctccctatttaagctccgccgccaccccctctctctttttttccccatttcgcctaactctctcgtgctccccatcgctcccgcgccgtgcacccatccgccgccgccgctcccgctactccggtcgtctctagccgccgctaggctcgccgccgcaccgtgccgtcgccgccgttgggttcgcgtggtcgaggtccacccagtccgcccctcctccatcgaggtccgtcgccggagcccgcatcccctcgcactccggtgagcaccacctccatcgccgccttcggccatggtttccgatcgccgtggttcatctccctccctctaatttctctcttttcctctcttagggcatctcggagctcgtccgtccgtcgccgccatcctcccatggctcacagtcgccgttcgccgtcgtcctcctccgcgccggccactctcggtgaggcatctctcctcctctattcccctccctctccctcctagccgcgccgggtcgagccgccgccccggtcgtgcgccgccacctttgcgccgccatctcccgtcgccggttgccgtcgccggcaacgcgcgcgcgccgccgcccttgccatggccggccggccggctttgtgccaagccgagccgagccgagccaggccgccaccgcaccgtccgatcggccccgggccgatccgggccgtcgatcccgtggaccggcggtggaccacccgcgtggtcccagtccacgttagaccgaccacccgtgcgccgctgccatatggggcccgcttgtcggcgccgccccctctctctctccgtgatttatttattgcgcaataaatcaattaaggatttttccgtttatagtaaaaaaacagtgtatcttctaaaattcataactaattcatccgtgctccgtttaagcccatccaagtctcagtaaatcaagaaaaatttgtccattaaaaatggttttgttctctgtttcagtagtcttatagcatgtttgtattgtttgcttcgtatgtcgcttagattttggttcttccgacgctccggtttacttcgagatagtcgccgaggttcctccagcagcagagcaaggcaagtcatgcctgtcacttgaatatgttgatcctatattgcaaatgctctattgtttttcttcaaatactgcattgttttataatgttactatgggatgttaacctatcgttacagccatgctatttcgtaccatgttcctttgttagcttgggatataacatgactagagattggactagggattccttagccatgcttagttcaactagcacacaatgagggagatcctattaatgtttagactgtaggttctaatggtaatgttggattagtaccaccgctttggtgttgattaactaaaatgaatcacatggtgggctatgggtgcatggttttgctagtcgcacccatggcaattaaggaccggttcgcgggaaaccctggaagaattcctcgtacttaccacaagccagcgtgggcaacggctggacttgtagtgtatctttcctctagctgacgcattcaggcaagggtgggcgtgatggagcgggacgggccctgcgacggcctctgtcgctttcggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcaccgaaacgtgtcgtggggctgtgtcttgtgggtacagttgtacacctctgatcagagtaaaactattcgaatagccatgcccgcggttatgggtggtcaaccagattcaccgtgattagtttcaccctagtgtagtctaatgaaattggatagtttaggtggatgattgggcctgttgcaacgtgggatagcattggacagtggatgattaatattaattaattattacaactgtttacttctttcaacttctgtttataaatgctcgctttatgcaaatgaaccactctagctctcctttgataattctctgcatcatatccctattccggtatgacttgctgagtacagtgggtagtactcagtcttgctctattttccccaaccccagagtatgagtatgtgtcagatggtggtttctccgaggagtaggcttcgtccgtgccgtcgagaatgcctgtggagtggtgttcccgccgcagatcaagtcaaggcttagctccagttatcttttgtttttccgctgcatttatgtaagacttttatgatatttgtaagacgtggatctgaatgtcaacattgtcgtttgtgtaccccggccggtcctggacggggattttaatgcacattctgcttggaattctattcgggaatttctaggagtgataagttggtatcagagccgaccttgaccgtaggacaagccaaatggaaaaacctaagagccctctgaatccttttcattgcatatgttctttgcaattggatttgttccgggaaaattgggatctattcttgtggttcaagggaaaaatctttgtcgctcgtttaagcgagatttgtcaaaacaagtcagtctagggttttagtaaaattatttgaggtttattcgtcagtcagttgggatttgatgggtgaaatgcattgggtcctagctcaggaatatgggttgcaaggtatttatgcttttattgttattattagtatgtatctaatttccccattattttatcgctatgtacgtctgtcttatttattcgctctcatgcaaaatgatctatgcataaaatttcgttcttactcgcttctcttatttgagtcctttattgccttatttaaatttggatttgagcatgcattgatcctactcctttgtcttctctagatggccgaccacccacccaaccaccgcggagaaggcatggatgactttgtggcataattggcacgcatgacgctggtggtgggctaccccaacgcgccagagtacacgactgttccaccgctcagtggcgagcttcctcaccgtgtccacctggaagtccatggctacgtgggtacctgcctagctaatatggtggtagaggcatccggaggcacagcagatcacgcctgtcaggaggcagcatacctgatgatggccagactacgggagcgccacaactacatcttccacaacacggcgtaccgatttcaccctcgtcgagccagcggtgatgatgtcagtactttccgtccgacagtcggcgagaacaacaccacctttggtcacatgtgcgccgtgatgagggggatggacaggatgcactcggatctgcacaaggcgtccaaggccttgaacgatgggaagctagtgaggatcatagctctgaaggatgagatagcacgcctgaagaaggagaatgctcagttgaagggtctcccagcaccaggaggagtccggatccgcaccacgccccgcaagtcgacgactgcacccgtgcgcattcagcttgcgcccaagaacccacctccgcccgcagttcccgcagctccagctccagccccagctccagttccagtgtcagctcctgcatccgctctctccttcgcgccagcatcagccgtcaggggccccgccagtggcaacgggggttggttgcctgctactcccagtggtagccgcgaccatagaagcagcagttccagtggcacagagccgggcagtggcgagacgtatctgccagactccaggagccgctcagagggacctggtgacaagcaggaggacgccttcgacttcaccgaccgcaggagctgttccgagcattaggctcgctttctattagtttatcgactgtttagcttttgcctgttagtttgtgtgtttaggtctgctcgcttgtgggtcagttgacggtcgatatcatgtgcctatgatatggctgtcttaataaggatttttgcttgatgtttaagtgttttaattcagatcagaacaactgcagtttaaattcctatataataaagcttagttcttgagcatctgtttttcttcttttcccccgtctgcttctcctccagatggtctacaccaggaatggcacccgcaccacgggcgagggcagcaacggcgaagagcgcactgatggtgtgcatcccaatagtgattccggcaatggtccgccaccactccccgagaatccgacccttgcccaagtaatggctcatcagacgcagatgatgacagccatgatgcagcaaatgcaacagcagcaccaacagatgtaccagaggatgcagcagcaagccgagcagcaccagcagcagtttggcccccctccccctcagtccaaactgccagagtttctacgcgtcaggccacccaccttttctagcaccaccaaccctatgaaggcaaatgattggctccatgccatagagaagaagctcaatctcctgcagtgcaatgatcaggagaaggtcgccttcgccacacaccagctccaaggtcccgcgtcagcttggtgggacaatcacatgactacccgcccgccaggcactgaagtcacttgggcagagttctgccgcaacttcaggaaggcgcaggtgctagatggggtcgtggcacaaaagaagagggaattccgagcactccaccagggcaacaggacagtgacggagtatctccatgagttcgatcgcctcgcgcgatatgcaccggaggatgtccgtactgacgccaagaagcaggagaaattcctagcaggtctggatgatgagctaaccaaccagttgatatccggagattacgccgactttgagaggctggttgacaaggcaatccgtcaggaggatcagcacaacaaaatggataggaagaggaaggcggcgcagttccggtccaaccaagcaagccaccagcgaccgcgcttcattcccagacagcagggtgaacctaccaccatgatcgtccgccagcaccgccctttcaactcaagcaacttccaccagggcgctagtggcagccagaaccaccgtggaggtcagcccaaccgcagtgcaactccgcgcccaccaatggcaccagcacagtcagctccgtctgtgcaagccaagaaggagaccggagcaaagccagggtcctgcttcaactgtggtgagcttggccacttcgctgacaaatgcccgaagcctaggcgtgctgggccaaggtttgtccaggcccgtgtcaaccacgcgtctacagaggaggcacaagcagcaccagaggtcgtactgggtacgtttcctgttaattcaatccctgcaacagtactttttgattctggtgcaatgcattcgttcatttacaagaagtttgtcgggatgcatgggttaataagagaggaacttagcacaccaatgcgggttcataccccagggaatagctccacttcggtacaattcagcccttctgtaacaatagaaatccaaagatcaccatttctagccaacctcattcttctggaatccaaagacctagatgtcattcttgggatggattggctgaccaagttcaagggagtcattgattgtgcgaattgcacagtcaccttgatcaatgagaagggagaaacagtagtgtacaaatcactagtctcaccaaaacaaggggtctctttgaatcagattgaggtggagatcccagtggtcaccgaggagaagaattcgaggaaattggaagagattcccatagtctgcgagtacccagaagtgtttcccgaagacctcactaccatgccacccaagagagagattgaattccggattgatttggcaccgggaaccgctccaatttacaagagaccgtacaggatggcagccaacgaactagcagaggtcaagaagcaggttgatgagcagctgcagaaagggtacattcgaccaagtacttcaccttggggtgcaccggtcatttttgtggagaaaaaggataagacgaagaggatgtgcgtcgactatcgcgcactcaatgaggtcacaatcaagaacaaatatcctttaccgcggatcgatgatttgtttgatcaactgaagggagctaaagtgttttctaagatagacctacgatcaggctaccaccagttgagaattcgggaagaggatattccaaagacggccttcaccactcagtatgggttgtatgagtgcacggttatgtctttcggacttaccaatgcacccgcattcttcatgaacttgatgaacaaagtgttcatggaatttctggataagtttgtggtggtattcattgacgacatactcatctattccaaattggaagaagaacatgagcaacatctccgtctggtactcgagaaattgaaggagcaccagttgtatgccaagttcagcaagtgtgacttctggttgtcggaagtcaaatttctgggtcacattattacagctcaaggcgtggcagttgattcatcgaacgtggagtcagttaccaaatggaccccacctaagaccgtgtcgcagattcggagttttcttggacttgcagggtattaccgtcggttcattgaaaatttctccaggatcgcccgacccatgactcagttgcttaagaaagatgagaaatttaaatggacagccgagtgtgacaagagttttgaggagctcaagaagaaattagtatccgccccagttctgattctgcccgaccagatgaaagacttccaagtctattgcgacgcatcccgccacgggcttggatgtgttctaatgcaagagggtagagtggtcgcatacgcctcgcggcagttgcgtccacatgaagggaattatccaactcatgacctggaattggcagtagtggttcatgctttgaagatctggaggcactatctgattggcaaccgctgcgaagtatatacggaccacaagagtctgaaatacatcttcacccaaccggacctaaatctccgacaacgaagatggttggaactaatcaaagattatgacatgagcattcactaccacccgggtaaagccaatgtggtggcagatgcattaagcaggaaaagctactgcaatgccctatgcaccgaggacatgtgtgaagaattgcagcaggagcttgagcgtctcaacgtgggaattgttgaacataggttcgtagccgctctggaagcacggcctacgcttgtggatcaattcagagcagctcaagtaaatgaccccgaaatagttgaactgaaaaagaatatgagagtgggaaaagcccgggacttccttgaggatgaacatcgcacaatctggatgggagaaagattgtgtgtacctgacgacaaggaactgaaggatctgatactcaccgaggctcatcagactcagtactccattcatccaggcagcaccaaaatgtatcaagacctcaaagaaaagttttggtgggtcagcatgagaagggaaatagctgaattcgtcgcactctgcgacgtttgccaacgagtgaaggcagagcaccaaaggccagtaggtttattccaacctcttcaaatcccgaaatggaagtgggaggagattggaatggactttataacaggactgccccggacatcatcgggtcacgattcaatctgggtagtcgtggatcgactcactaaggttgctcacttcataccagtacataccacctatacggggaagaaattggcagagctgtgcctggcaaggattgagtttgatctattgagataattcttcttttcatacttaatgttgtatcaattgagtttgatctagtgagtcgtgcttagaatattgatctctagcctgccacctagttgtcgattagaatagcatcggagtttcagccgatcgtatctgatttaactataattatctctatttgcttcagtgatatgttaaatctaccctttatgccaagatattgttgtatttgaatatattaggtttttgcttgatattctatatttgttttaatatcctgatatagagtagtatcggagtatttgccgatacatgctagatctatatgatcggctatgctgtaaacttatatagtcttgttattaatatatatttcggtcttagtgatttatactgtctcggcatggcgaccgatctatcccaatcacttgatttaagtatatatcgatataaggagtatataccgttaacatctacagccgatcaagtaggtttagttttcttccttatttattcacgattaccgatcgatgcacagatgacatcggctaagatataaatgatatgtcatcggcctctggccgatcggctatcatttatagatttaactatggctcctttgtctttatttcttgttgattataggatcaaatcaactggcacgctcatacatccgaaggcgagttttggacctgcactggagttaagcagatatctcaggcctcatgttttctgtcaacacgcttttggcacgcccggtgggacctgattagaagttaggcgttagttcttcctcatggccgagaaacgagcaccactaccatcaagcccaggctccgttaaaggcaaattaccgaagccgggattgactgacatcattgatgacaatgtcctgccgatcgatcccgagaaattcacgcctgaccagaagcaaaaatttgaagcaatgatgcagcaagcacgggatcagtatctaagctcgttcatgcaaacccgcaagggaatgctggttcagaagtacaagttaaaactggttgctgacaaccctggaaccggttcttctaaagatggagaagtgaaacaagctccagatggctcggctcagccgagcaacaagggtgctaccagtggttctataggaaatcaaggcgataaccctcaagaagtgcacggagctccaggtgatgctgctcaagggccgcaaggaggaaatcttaatcagaatattgagctagcacaagattttttcaacaacttttaagatcgggttgattacgcggtgcatcatgctttgatcaatcaatccggggtcttagtcaatacactgtcgaacatgatgaaaacgatagccgatggctcgatagctgagcatcaggctacaggcccggcatacttgcaagaaggcatttttccgaattatcgaactttgatcactgatgctcagccagttgtgcaggcgactccatctgtcgaacccacgactcaaccaacagcgccagcatcaacgcccttacctgctacatcggccacggcgtcagcttagccgatcaaccctcgattgctaatgagggaacatccacagcttgctggaaaagcctcgaatcagccgactcaagatcaggttgctgctatgttttttccaccaccaccagttgttgattcagtgcagcagcagccgatccagcagacgtcatcaattcagccggttgtacagccgatccaacaacaggtcgcgcagccagctcagcaaacaccaccaattcagccggtggtacggccgatccaacaacaggtcttgcagccagttcagcaagcaccatcaacgcagcagcatctccaaccaatccagcaaacaccgccaaggcaacgccttcagccgatccaacggactccggtacgacagcaggtcgttcagccgattcagcacctggggccagccaatgcatcggctggatttgcagcacatggggggcaacctgcgcagcagtttgtgaatcaagttatcccggagcatttggttcatcatgcacaaccggatggcaccttagtaactcatatggttcctgagcacttggtgcacaacattcagccgaatctgcataactaccaagggggtaacttgaactatcagtatcagctttcatctccgcaagcccaatatcaaccagggggatcggcacagcaacagttcgctcctcagtttggtcagtacgagcccatgcaacagcaaccacaaggagcagctctgtcacaccccgaagttctttcccaagcctaaattgaagttataaatggtctcaagaaaataccagtgtaaagcaagagtaaaccttaataaattaatgcaagtaataatcggaattggcatgtggaatttttcttgagttctacatgtcgaaattcgctaacaagatttttagtggaattttcagagctctcgaaataattttaatcaattaaaattgagcacaggcaatatttaaatccctgggaattcctttcttcctttttcttttttctttttccttagtgggccgccggcccattccccctcctctctccccgcgccttgctgggccggccggaggccacggcccaactcagcccgcgccccctcctctctctcggggtcaccgacaggtggggcccacctgtcgggtcctcccccaacctccagccgctcgccgccgcacccgcaaccgccgtcgcgcctcgcgcccgcgcctcccgggccacgtcgtccacgtcgccttcgcgcccgcgcctcccgcgcccacttccccctctctcccgctcgcccgcgctcccgagacggccgggattcgattttcgaatcccgcctctctctcctctcccactcccccacgtcggccggcgattcccgcctctcccagccacgtccggccccctctctccctatttaagctccgccgccaccccctctctctttttttccccatttcgcctaactctctcgtgctccccatcgctcccgcgccgtgcacccatccgccgccgccgctcccgctactccggtcgtctctagccgccgctaggctcgccgccgcaccgtgccgtcgccgccgttgggttcgcgtggtcgaggtccacccagtccgcccctcctccatcgaggtccgtcgccggagcccgcatcccctcgcactccggtgagcaccacctccatcgccgccttcggccatggtttccgatcgccgtggttcatctccctccctctaatttctctcttttcctctcttagggcatctcggagcttgtccgtccgtcgccgccatcctcccatggctcacagtcgccgtttgccgtcgtcctcctccgggccgg

SEQ ID NO: 67334 - DNA, 42922 bp, Oryza sativa
gggcccatctcccccagttctcctctccgatttctcgccgcccttcacgtggctcacccccctccctctcacggcccaactgtcagcctcacatgccaaccacgcggcggggtggccaaccagcatcctccaggtatacaaaaagaaggggtcaatcgggtggggccatctgggcccgcgcggttgggcgaaaagcgggggagcccgcagctgcagctgcaactggcaaaaagaaaaaaaagataagctgggatgggtgtgagtgggaaggggaagaagcttccagaactctcgccccgggccttcccgaacgttcgccgccacgtcaccgcactaggcagcacaccatcccggggggaaggaatgaaggctccgcttccagaactgtctggaaacttccgcccccacatcccaacccacccgacccgacgggtatatatataggccggggtgggggcgcgaatgctggtcctggtttcgacgagctccatcatccaagtacgaaggggataaagggactcatcactccacccagctggagagaaaaaaaatctcagctgtacttgctcgtgttctttcctctcccttttcttctccgccatcattttctctgtactttggggtgtacttcatccttctgtattttcggttctttttgctctgatttgtcatcttttttttgcgagcgagctcgttcgctcgccaacgaacactcctgctgtagctgttcttggcgttaatgaaagccctgcattctcgcatttgcaatcgccatttattcagctgtgatctttgtagagtgttgtgttgattaagaatcgcatgatttgggttccattggtttgtttttgcaagagtttttgtgtttttctctgatcccctttcagctgattgaatgatcatcttctcccctaattctccatctgtctttggtggtgattgatcacttaaactctacacaatttgatattttttgcaaacttttcagaggcaagatcgttccagattgaattcgttcggtggagggcgatatattttttttcggcaaggatcgccattctcaccggtcgttcaaattcttctcctgcgttaagtggctgtgtgtgctctgttcgtcatcttcctctgctactcaattgcattggttggttggttagacatgaatccattgcgcgtcatcgtgaaagaggaggagctcgacttcgccgccgcggcggcggcggcggcggcgggtgagggctcgccgtcgtcgtgggcggtcggcgtgatggacctgcctcgtccaatggagggcctcggcgaggccgggccgccgccgttcttgtgcaagacgtacgaggtcgtggacgaccccggcacggacaccgtcatctcgtgggggttcgccggcaacagcttcgtcgtctgggacgccaatgcgttcgccgccgtgctcctcccgcgctacttcaagcacagcaacttctccagcttcgtccgccagctcaacacctacgtaagtccatcaatggcggaatgcgatgcgcggttcgtgttttggcgtgatcaatggcggggttcttgattttcttttcaggggttcaggaaggtcgatccggatagatgggagttcgcgaacgaggggttcttgcgggggaagaaggagctcctgaagacgatcaagcgacgccggccgccgccgtcgagccccccgtcgtcttcgtcgtcgtcgtcgtcgtcgcagcaccagcagcagccggcggcggcgtgcctggaggtggggcagttcgggcgcgacggcgtggtgaaccggctgcagcgcgacaagagcgtcctgatcgcggaggtggtgaagctgcggcaggagcagcagacgacgcgcgcgcagatgcaggcgatggaggagcgcatctcggcggcggagcagaagcagcagcagatgacggtgttcctggcgcgcgccatgaagaacccgggcttcctccagatgctcgtcgaccggcaggccggccagcacggcgcccggaacagggtgctcgaggacgccctctccaagaagcgccgccgcccatcgagtaccttctcacccgcaacggcgagacctgcgccgccggcgagtcggcagctatgctggcggcggacggcgtggcggaacccgacggcgacaccaccccgcgccgcgacggcggcggcggcggcggcggcgacaccgagagcttctggatgcagctgctcagcctcggcctggaggagaagcagcgagaggacggcgtcgccggcggcgtccaggagagtaacagcggcggcgctgacgtggacaacgacgaggaggatgacgacgatgacgtggacgtgctcgtgcagagcatatatcacctcagccccaagtgaaaggtcgagaaggttccacggcgaaaacgaagggtacgtttcgtttcgtagggtgacgtaatcgcaacagtagcgagtagtaggaatgtaggggtagcactgcacttgtctttctttccatttttttatagtttcggacatcttgtcgccgccctgcaagttgccaaaaaaagcagccaagccccactgccacaggcgacggaaggttcaagaagtcgagaagcttctcccgcgggggaagcttctagaggtgtccagtaagacagcacagtagctgcgggtgttcaagaagctgggaagcttctagatgtcctctaggacggtggcttcgaatgttcttcttctggaatttgcacctagtatcagctaattatgtgcgctgtattttgcccatgctactgccatatgcaactggtgcctcttatcccccaacagctactgctgcccttttaaaatttgaaagttacggagtaatttcagctgatttttaagtttcttcattagtagtttactttctgtattggttgtcaaatcttaaataaagttctacttataaatatcttggctatactagttcattttccccttgtcttttgtcatggaaggctgcctgttttgtcgtgtggtgacagttctgaacttttcatctatactggagtgctacgtggagtatatacatacaaagtgctccattttgtttgagccgtgccgtgagcgcgtgtccttgaccagggaaaaaaaatgttttgctttcaggttgcagaggacaagaggatgtcggtgccaaagatattttcaaacatactaaccgaaaagggcaccaaaatatcatcatctgaagatcttaacagtatcaagaaagtggttcccagctcatcaaatctaggagtactacgtggtaggagtatcaggctccacctgtacctggtgtcttaattaaggaaaaaagaacagagaaacgctcggagagatgattcagaagcttgacagcgagtatttcaggagtacgggtgtcgcttgctgcgagatttcacaacaggagactgtctgtcacggcgttgctgtaccacctctttaaaatggatcgtgggacaggacagttgacacgtagagtaacactcgtactacccgtttccgctaaatgtcaaaatcttgtacggagtactatctggattaaaattaaagtttatctatgaaaagaaaagatcatctcaaagcatagaaccactacaggtgtacagtacaaaagaaattttactgggcctctcacacataaaaaggagaaggaacaagtccaattaccgtcccttatctttacttcacgtttaattgacatccctaaattacaattggcttgttcggcagaactagccgttgcagcgctgcagcgcaactacagcagccaatcagcaactactcctataggtttgcaacaggacaagcatattaccgcattgctacaatggccatccgctgcaatgcttcagccgttcgactatgactatgctgtacagacgtaaaagcgcaggttggcttgccgaacaggcaaatcttcacccttcatcttagcaaagccgtctaagttaggtccatagcagtatgaagggctggttttgacttatgtggtattctagtcaggaaaagttaataaaaaacgtgtggccccacatgtcagcatccacatgtcgttcgtggggtggtggcgagcgagctcgtccgggcaccgtgtgaggaaggtagaggcgagagagggaggcggaggcggctgacgagcttgtccgaggagaggagagaggcaagtgggcggctagaagaggaggggggtgaccgggtaaggggtcatcgagctcgcattcctcacggcggtgtgcaagctcaacctcggtgacattgggagcctatgcgagagaccgtcttggatggtgcggaggtggaagcggcctcggcctccgcgagaaggtggagacaaaggcgactgtgggtgggcctgccgcgccaccagccaccgccaccacagatagccgcgatgccgaagaagatggtcgtcaactcccatgccaaggcaacccgcgagcgtcactatattgtggaggccgagagatgtcgggactgcctggagagcgccaaggaggagtattgggcgcgaggccgagagctccaagtcccgcgttccgcgccacaaggaggaggatgccgaggagcacatcaaggctgccgcctgcaatgccggcaagcccctccaagatcaagcttgcccagcctccatgcgagggaggcggagatgggaaatatgggggagggcggggacggctccaagcactggggtagggacgattataccatgcgaactcgtcgcgcgtcctccatgtcaacgtagtcgtggttgcctggccttgagcttgaggaaaccgagagcaggccatgcttaggcattgccgctgtcgttgttgactcgtctattgcgtttccccctcccatagctcccaccatcagtcgcgagcatggccgccggcagctcctcgaggcagatggccgtggatctcctgcaaccgctctcctcaatgtcgtctcccctaagctatggcagtcgcgcttgttgtctcccaaagctacgacggttgttctcctcgacaccggctcactctctgtctcccttgccctgtgctcgccgccacctttacggcggctctagaacatgagaaaggaacgagaggggagaagagaaagaggcacttgcacgtgtgtcccacatggtatttttattttcttttgctgactatgacgccacgtcagcgaaaccatctatccatattactagaggacctgagttaaacggttttgtcaagatggaggttgaagatttcgggtattacggttcaattttgctacatatttatcgacaaattttctcccaaaaatttgacagatgtaattacagtacaatcgtactgtaattacactgtaacttgtatataattatactgtaactataatgtaacttatctgtaactttcaaaaatctctccgtaacatgttatttcggtaaaatggaggtcgtgggaatcctttcacatatgtgtagggatgaaaatggttcggatagtttccgtccgtcctgaccaattttcggattcggaaaaattcggtcggaactatccggaatttctcggattcagaaacgaatttggattttttttctcggatacgaaaatgaatacagtaagggtgatatccgacgaaatcggaaaacggtcggaaactacccgggatttttcatccgatatccagtagtttacatgcgagcaaaagggaaatttttcagcaaaaaaaaacccgaaaccctagccggccgcgccagctttgcgccacccaccgccagccgccgaatggccggcgctagatccatgccactgcagccgcccgccgctggccgttgtggggccgaccgccgaacacctccctagggcggcggatccggcccctcacgagggcgccgccgccggatccgccgccctcgccgcctgccgctgccgcccaccgacgccatcgccggctcgccgcccaccgaagccgtcgtggcaatcgagcccgctgccgccgcccgccgcgcgagcccgcccgtcgccgctcgtcgcgtgtcgcgccgctctcggccggccgccgcccgctcggccccgcgtagtgagatagaaagagtaaaaagtgtgtgtctgtgagagagagacgagagaaagagtcaagagaagataaggttgggaaaaaatggtagattttttttcaatgtaaaaatcgattttttttacatgtggctctttaaaacgaattttaaggaactaaatcaactcatataaaaaagttgtcaaaaacaaagttgtataacttattgagatttaccatttttcttttggtcatttccccatccgagttttattgaactatataaattttgaattttaaaatataaaaatttaaataattttttgggtagtaaatgatttcaaatgaaaaaattgtcaaaaacaaagttgtataacacatcaatatctacaacttttgttttggtcatttttctatatgactttgtttgaaccgtttgaatttaaatttcaaaatatgacaacttcaaacaacattttgaaatactaaatgatttcaactgaaaaagttatcaacaacaaagtttcataactcatcaagatctataaattttatttgggtcattttttcatccgacaaagtgatagtaactttgttcacaaaatttacatctatctcatctggttctatagactataagagagatatgtaaactttgtgaacaatgttactatcactttctcggatgaagaaatgaccaaaataaaagttctatgtcttgatgagatctacaattcaaaatataaatgtagttttatgttcatgacttttttagctgaaattaattacagcttcaaaatataatttgaagtttttgaaattcaaatttttaattgataaaacaaagtcacacgaaaaaaaagtccaaaataatagcggtaagaatacaataacatgatagagcatgattttggaaacatttaggaaaaagaatcatccaatttggagttcatatgagtgagataaactagttttaaagtttatttttgcatacggcttcttaagacacccttatggaaaaattgatttttccatgcgggtccttaagtggtccacatacaaacaaatgaaaaaaattcaattattaaaaataaccactcaaatttttaaaaactttcatgttcaacccaaaatttaaaatattcaaccaattttcaaaaatttcaatgtgcatgcgaaaatttcagtgatgcacattaatttatttgttttatgataacataaatttgtatggaaagtaaacacaacattttctatctcccccttgcccttataaatagagataaaatttgaaaatggtgatgttttgtttttgaaaactaatggctacagctcttccttgatttaagaagcttattttgaggggtcttaatattttgataattattcgttagcgtattcgtttcaattcgtattcgctccatacctgtattcgataatattcgattccgttttcgtatccaggttttcgattccgagaaaaaaatatgaaaacaaatatgatagagcttgtttccgaccgtattcgattcgttttcattcctacatatgtgtgtactgcgattttttttcttcctcaccagaacaaatcttgtaatagatctaatgattcaaaattgcgtgaaacttacatacaagttacactgtagtacatgcaagttacagtgtaattacatgcaagttatagtgtaattacactatgattgtattataattatatctgtcaaatttttaggagaaaatttgtctgacaaatgtataggtggtcccttgcggttttaggggtgtgaattaaactcaacgtaaagacgagagacgtcaagtggacttatttccaaaggagaaatttcatacgggacgtgtttctcggcccagcccaaatatctagagtacgtcttctactcatgattacgtaaataatgagagacgctatttactccgctagatcagccaccttctcctcgccacgtacgacacaagcagccactcgcgcgcacatggccacgtcacgcaaaacccgcagaattacgcgattcgctgagcccttttctgcaaaaacacgcagcctccctcttctccccaatctagcccgtgacctcctcgccggggctacttctccatcgccatcgacctcgacctcgccgcctcctcctcctcctcctccccgtgcgaactccgggctcgtgccgagggggtggacgcgccggtggtgagagcggacgcggtgcggtgggccatggcggtggggtggcggccggcgatgctggtggtggtggtggcggtggcggcgtggcgcggggaggcgctgtcggtgacggtgaccgacacggagtgcatccacgagttcgtgccctacgagggggacaccgtgtcggggaacttcgtcgtcgtcgaccacgacatcttctggagctccgaccaccccggcatcgacctcacggtgcccgcccccgatcctcctcgtcttcgttgtgcttttgattttcgatgcaaggatctataactagatgggtttatgggtttgttttttcgtgatctggggcacgctggattggggatcaggtggaatcgtggtcctctttttgcgatctgcgatttcgcggtgcaaaagtttggggaaatttggtgatatgaagatatttcatgaataggtttcgatttgattttagtttatgaactaaattaacttggcgcggtggctgttcttagtcaattcgttggagcgtggtgcaaacttacgaacttttcgatgatgtttcgatggattggcatgctggtctgtagattttgctgcgtgacagggtcataggttcaactacgtgatagtgtgtttggtggctttccactgatctgcttataaaagtcactacttttagtttgggtggttagttttggccagtggcaaggtgttccagatgattttaccttgtcctgtagaaaatttaagcaaggttcttctctattttcttgatcgggtgtagagtcctgtctcttatgttttggtgatcttgttttaaagttcacactttaggcgttttggggaggctgaacatttttcacctccattgatgccagaatcgaattgttcgctgtgaatgcccctttagtttcttattaataccctgatatagaaaggtagatgaacttgatatttcttcccaataactgtagtttaattgaattatggctatctataaatcctcatcagaattcatttataagcaaactttggagaatacttgtgatgcagtgtttcttggagccacttcatttgaaagaaaagataatgtgccaatttttgcaaatgtgttcaaagcgcattctgcactggagtgtgttctgatcatcacacataactaagtatcattgtgttgcactatagcgttattccactaataaccttgtctcacttcctttcgtgatattttgtgctctcgtggaatgtaggtaacttcaccaggtggcaacactgtgtatacattgaaggggaagtctggtgacaaatttgaatttaaagctccaaggggtggaatgtacaagttctgcttccataatccatatggagcacctgaaaccgtttctttctacattcatgttgggcacatacccaacgagcacaatctggcaaaagatggttagtgttctggtcttttaccttgaccttttcgcttgtcacagtctcatatctgcttatcacgtcaatttatttgttttgagcattgaatcacaatcagtttaatatgcgatcataggtttatatttggtatgttcattttatatttgcgtacataagctatatttggttgcttttgcagagcacttggaccctatcaatgtgaaaatagcggagctgaaggaagcattagaatctgtcactgctgagcagaaataccttaaagcccgtgaagctcgtcaccgacacagtaagcttaacaatccttttgcaaatggtcactgaagctttggcagtttcctataatcctgcgtgtgatatgagaatgcataaatttgtatgaattttctgttggtccactcaccaccctttccacatgaagcaagaaaaaactgatccgttattacattttaaacactacaacattatcaccatcagaaagaagagcaaatagggatagaatggctaatatatgtgactggaaattggatattatttaatttggtttgtgtttaacgactttagcctgtccctttcttagagcacaataaagccacagtttgagtgagacaaatttctgtctggtctcccacttttgggctgttcttccattctgtctttgttcatctctgagctacctaactttcctcctttgttcttccatactactttctcaaattctgatcatcaattcttagctatacattttttagggcaaatcttgatattggtaagtgttaagttagaacctagtcaggtgggtcgatgtgttctcagtcaggaaaaggaacttgtcacctgttgctccaaaaagggagaatatcctctttaactaatatatgttcacatttatggtaattgatgtttcacttagcttctttgtaggggaatatatctaaagttgttttctctttggcttaacatatattcccctttatggtaattgatgtgctatatatagctttttcttgctcttgtagcatgacgtttttatgtattctatttttcttatcattatgtgatcgtggagagcttattttgtgttaataaatccagcaaatgagagcacaagaaggcgtgtcatgttctacacaatagcggagtacctagctttcatgggtgcaagcgctttgcaagttgtttacatccgtcgcctattcagcaaaaacgtggcatacaacagggtgtagaacagagtctacttcaaggcagcagaaaatggttggagcaggaaaaaaatatttccaacatattgtgttagcttttgcagccattttttttgggtttagtctaaaacgtggcacttttaaatttattgccttgtactttagaacttcagtgagatatgaagcacatttgttgctgaacaagtgaacacagatccgtaactaatcttcaaagggttgatgtctcaaagcaccacttgtgttattgtgttaatatgacttatgagggtcttcgttctgatataaattgatcaaattttatcctggtctatgcaattcattcaaagcacaacgtttcctcgttatggaatgaaaaggaagtgttctatgtcaccgttccagacaactataacaggttggtccttgtattctgtacatgtaaaactgcattagcagtatgtaaagttgtctggaatcatgttaaacattaccgacctaccatgctcttaactaagttactatactggaaaactgatttaagcttattttctagatgaactcataaagtttgaatccgaagtaaacagcaagaaggtggttaaacacacagagtagcaactagcaaacactaaaacatgaacaattaccatatcaatcacttgttgcacggcagcagaagagggaaacataagcaacagaaaaggcatataaaaagtaaattgtacatgtattgatcaatatctcagtatataaggagatctgtttgtagtatacatttgcacatctggacattttacttcaaattggaaggaaaaaaaatgattcgttcctgatgccattttttcctctttgccagacatgagcatgtagtaaaactgcacacgtgctttcagtttcagttcatcacactcttggccattgaggactaactacctgcagagttgaagttaaaaaccggtcagcaattagaatttttcattctgcttagtgtttgtcgattgagaatgcaatagggtacgaacctctaatgtactgaaaactaattgcatgcgactagctactactgatggctcctctgaactgcccgtgacagccatttgttccagctgcaaagttttcactggtaacctgcaacaacagttttgaccccatgcatatgatcataatcataaaacttgtaaataaaaagagaaacattgctaatttcaaattgtctcaccatgccattcctttggtatagtaagcgttcgctattaaggcacaaaatcctttccactgatgcaaaacgtcagctgacactggtggggtagtagaccatctgatgatcgttggttgtggtgtgcacaggattgtaatgaatactatactgagccacaggatgcattcacggacctaccaaaaaaaggggaaattctcgctaagacgaagaaatgaaagcacaggtcttatcaagtgtgtttgcatggtaaatgtgttctccagcagactacatgataccttacataaagcttcatatcttgccaatgcgacttagtggacttcatctatcgataatcattaacaaattaaaagaaaaagtaaagacatgatgatggaaaatgcacaccaaaactcttccacttgtgtataaagactaaagagcatattgtcaatgaaattagagtataaagcaaaggtaactgtaaactgagcactttatgttgtgctaacctcaaaggagtgaactttgaaggtcaagctggttcctcctccattggaccgcagagcttcaatctcaaggccagaatcttcaatatccataagttccttcctgagcccctcttcagtacagcctagagcatatgcattcaccccagcactaacaaactcctggcaggattgaaagcaccatattgaagaaaagttatgtccagaagagaggagaagaatttcagcgagaaacagtaccttcaggttatctccacctcctcggtcaatgacatttttatatcgcttgaataggctgattgctatattgcgtgatgagcggaagtcctcatccgacgaagcgttaacatgaaaccgatgctacacacagcacaatgattcagagaaaaaccaagagcagccgaattcatcaaaaggaaggactttgggacaaaatctgtaccagccaatgccttgtagttctttcacttaaacttctatagagataatggctcgccctggtaaagttaactttgcagctaggaacgatgtgcggcttctgcacatgatgcccttccactggattataaaacgcactgcaacctaataggttgttatgaggaactatggcatgctttggtgatgacttgacctcttggtaagcactcggcctaatgaacagagcggttccatgtagcgtcagcatgtctggatgctcatcagcctgcaagccgtccacacatttctccaataactggagagtccttcagaacttgccaacagttcaatctgcaacaaataaagctttcatgagtcattcgcaactattagttactccacagatcacacaacctcatattcagcccccgaagcatgtgtatatgtgtatacaagtgtgcaaaatgatcaataacagtgtttctttagggggtcaaaacggcaatgtttcccacacatggtatcaagatgtaaatagacacccaaaaaaaaaagaaaaagggtatgcaaagtgtatgttgcctcagtctgtatggtaccgaacaggccaaaattatgggaattttttttaggaaaaatagtgtagtacttgctatctacagttggtaacataagcaagatatgctaccaacaaatgcatcgcatggtatcagttgatcaaaattatgctctcgaaaccaaaaaaaaaaaaaaaagtgcacagaacaacccacaaggccaccatctcaggaagccaaaaccacacccatcttcctgtactgcctgaaggattgctacctgtatcattccactaattaattaatcgcagcttgttcatctcccataaactatgcggcatcatacatcatgaaatcagtactacctaattctgaaactatcgcttttcccccttccaagattatcggaaccggagaatctacctacaagatcgcgaccaaaacacgcaagaactcacatagcaccacgcggaatcaagaaaccgatcagaaacagcttgcagatgaggagcgggaggggaatacgagcggatctttacccgggaggggagaacagcagcagcagcagcggccggaatccggaggaggaagaaggggatgaagcggttgaagtggaaaatataaatacgtggaggggttccgtgcttaaaaaatataaccccactgtgtgagtgacggagggagaaatgtaattcgccggaaattcaggggccacaataaaaaacgactggatgagtggcgacgggggaacgcgaggagaggaaacgccggcccatcgctctcgctgaatctttgtgttaaatgggccggatgttggggctcgttagaatatgctgtttgggcttctttcttagttgggcctggcccatacacaaaatattatcatttttttggtttgtttatattaacaaaatggcggtgagtggatctagcattgaagccaattctcgacttcatttcggtgaaaagaacatgatttcgggttaaaatctcagccatgacagaaaattgtaagctcaagggtctttagaagaagggggacacttagaacacatgaattctacaagatttttattgatctttagttcagaattcagatcctttaaaattcctctgtatcaaaggtggcctaagcatagaatcggaacttttccctatggaacgaagtttttgaatgaatcaatgcatctaacgaaaccaaaaaaaaaaaaaggaaacctaaccctccttttatgcctgcattttgacccccatcttgaccaaatccctgcaggcgtgtgcaatgctaactcatccgcaaataattaatacaaatgtatcatccttgtacattcctatgatttagtcaaacgtgttaaggagcagaattggtctactggccaagctagattcagatatgaattaagctcaaaaacaaacactccatgacaattccataatcccactgctcctcttgattcccctggtgatatccataccttacaattcctccactactcccttcacacctcaccaatgctgcaatgcatgaaaatgccatgattgagctgtaccattgaatcattgttcttgttcattaggattgtgtttttttctagagaaattagaatgatggtggagtatttatcacctaggtctaatggcatgcatgtcatgtcatgtcatgtcatgtcatctttattttaactcaaaatatcatactccctttaagaaaaatattcacggaatgatgctattaaatgaattagtgaatgagctgattattgagaaatgcatctagtagttgtagatgagaaaagatgtcctgatgggattaattaggaggcttttatgacgccatcacaacaataacaacactgcaacgcccaaaatgcaaaaacatgggagaattgctagcaaacgtgtcaaccaggagattcatctctctcgcgtcgtactcatcaatcatcattcaccaaccagataatccacacagcacacgcacaatgtagaagctaccaacaacttccacctgtgtgatgttgcttgcattggagatgcatgtgcctgatcactgtgatcttacatccctgatgattaccctatctatatgaaggctccgtttggtcttaatttgttttcacctgatgttgtcttgatcattgaaagataaacttagtccaaagctatcttcaaagcaaccgattaagttactctagtttcataccaccatttcatgattaaccatcataatctgcaaaaaagaattcctcaaaaatcttatatttttaaacggataaagtagtgttctctcatcctttggttattagcggtagctgaaatttaaaattttaaaattaatttagaggatctatcgtcataatttatattttagcattaactttaaaccactaactaatggagtaccattttacctataaattgtttcatgatcatacaccctttatctccaaataagtttatttccaatctatctcacacatatcaatacaaaacaaataagccataatactctcgttttctcaaattccaatacaacttttttagaaacacaatacaaatcgtaatttaattttattttattttcaatgtatttttaaaaattttataagctataatctaataattaaaatgttgagaaaaaagaccagggtgtagcctcatagcgcttctgtcagggtaatcccaacccataaactattaattagttttcataatttctatgtcatatagacactatatatataaattatatacccaatggaaggtatctttaattaaattcttatctaatcaccgcttttctctctttttatctacatatcctttgttttaattcctgattcctgtatagagatagtttcttgtataagaaatagtttcatttatctttttacctctctttttattaattctcttataacatcaaatttttatttatgtggcagtggatttaatgctattcatactagctaagacggagggttgagattggccagagggacaccgtctcacaggcggtgctggttttggattgctaaatatgatgttgacttaatcctttgccatttagctgtctcgctttacgctccgcgactcccgctcttgtcctaagactttcccaccttctcccactgaagctgcatttctacatggttgatcgatgctagctagtgtaaaggagttcatcatcctagatggcttagctaatgatttattccacttgcattagttgtgggaccctgcaagcacaaagggatggtggattcaaccaccgttaacgtgtcttaactaaaaatagggactggtttatatgtactaacttatatattccctaaagaaaaactatatatttatgtatttatatatagcaggacatgcaggaaagctagatgctcatctacttgtttagagttgggactttggattctgatgggaacagttacaatattagattcaggtggttaatttaagatcatgtgtatggaggattgggattcggtgacattgccccgtgacattctcggtgacattgagtcactgacatgtgggtccagtcacatgtgggtcccatatgtcaatgactcaatgtcatcgagaatgtcacagggaatgtcactgaatctgtgttcgtgtatggataattttgtgttgattagtacaagagatggatgtcatccatggttttcatctgagattttttttcggttttaattgccgtgttaagccaacgaaagatgattcccgtcttgttttaaaaaaaaaaaaatctcgtttcttcttttgtctctgtcatatgaggtgtgcatagtaatgggaagcgggtacaaacaaaacttgcactgcgtagattggtgaaagaaaaatcatcatcgttgaaaattgttagttttcgtgaacacgaatgaatacaagtaattaagctgtttatttcaaaagttcgctatttcgagaggtttggggttaactcccagtcaaaatagtagtaggcactcaataatatagtaagacttggcctggtttgatttaagattgttgagcgggttattgtcatgtattatccacttaattactacctctgtttcagattatcggactttttagcattgtccacatctattatattatcttctattatattattaaaggaatagaaaaaggagcctccacattcgctctcatgccctagaaattctcacattaatcgaagaaaaagaaaaagcatagtccatatagatatacaatttagaaatagctgaaattcggaattaaaaaaaaggaatattagaagagaagactagagtccatatagaaatacaattaggaaataactgaaattcggaattaaaaataaggaatattagaagtagagtatagagtccatatagaaatacaattaggaaataactgaaattcggaattaaaaataaggaatattagaagtaaagtatagagttcatatagaaatacaattaggaaataatagaaatttggaattaaaaataaggaatattagaagtagagtatagagcccatatagaaatacaattaagaaaaaaaataaattcggaattaaaaaataaggaatattagaagtagagtatagagtccatataggaatttaaaactaactaaaatttggaaataaaattaaaagtagagtttagagtccatataaaaatataatttacgaataactaaaatttgaaattaagaaaaacatgggaagaagagtttaaagtcaatataggaatacaatttagaagtaactgaaattcaaaattaaaaattaaagaatattaaaagatgagtttagagtccacatagaaatgcaattagaaataataaaaattcagaaataaaaataaataatattggaagaagaacatagagtctatatagaaatacaatttatagaaaattcggaattaaacaaagaaatattaaaagatgagtctagagtccatataggaatatatataatttacaaataactaaaatttgatattaaaaataattaataactaacacgtatataaaatacaatatgaatattacacattagtagttttgcaaagttatttaaaaatttaaaattatgttatcattttaatatatttgaataatataatgagaaaacatatatgctattatatgagagaaaatataatgatgctacccgctcaatctgcgcgggctactatgctatttcatataaatgttaataaatctaggcacacatatatatctatatttattaagatatatatatgaatgtgggcaatgctagaaagtcttataatataaaatggaggaagtataaaaaatagattgataaataacatttttatgacggttgataaataaacttaataaatagcttcaaacaatgctctttttttttacaatgcaataaaaaatttttataaaaaatgtattgtcttaagtgtgaattgtgtaaagtaatgttaataatactgtctagtgaaaaaattaaaaataacatgagtcgatcatggaagggtaatttttgctcggcctcctctacatacaaccggatatatacaatatttttaattagaaacttagcgctttaaacagagaacttagctctcaaataacctagtctgaaactcactcctacagagatttgaaatcaggatattagggtgcttctcgggctagaaaaaatcattgggagcctaatgctgcgttattttcagctattgcaatttagctactactcgactttcgttagcacacttttcaaatggttaaacaatgtattttatgtaaaaactttatatatataaactgttttaaaaattctaataaatttattcatcaattttttatatattagtacttaatcaatcacatactaatctcgtttctcattttgcgtgtggctaattagctgtttcaaaccttcgaaaagaacgcagccttatatctcatattctcattgtacaatatatattgtggcttttccagcgttttggtcgtggctccgttataggaatactacttagggcttgtttggtacagctccaactcctaaatttagcttcagaaattaggtctagagtggagttatagagctgcctaaacccagctccacaactctagttcattttgtgagagagctccacccagctccactcccagttttggtagagctgaaactgtttagctgggtagagctaaagttggagctgtgctaaacagacctttaattatctggttcatgtgcgtttttatggtggctatgtcatgacattagcaccgttcaaattattgtgaggatacaagtccttgtgtgttgcgacctctgtaaagggaatgacatatcagttcataacctcgtgacagcttaactacaagctgcaggaattggtctatctatcctgcattccgctctctctgcccacatgggttgtgtgcatactcttcctcttttctctctgttttttttttttgacaggttctctccaaacgtgccaattactacaaggaattaatcgcggttggttcgatcgtatcgattctctcttcctttccctttcccctgattggatcaacccattgaccgatcgatcgacctcaaaaaaaaaaaaaaaaaaaacggtcgcacccacgcacgcgcccgcgcaagaaaatctcccggcgtccggcgacggtgacgaccgccacgagtatgatgggtctatttagaagtttaacattcggagtgtttatttgaggagcaattttacaatacctggtatcataagaataagtataaagataaagatcggtatggtctctacgttaattagaggctatcacgttacaatagttaagacaatattgtctttaaactaaaatactttcttactagtcatcttttctttattagactcaatgcaacgaaaaatttcctaataaatactaagagtcgactctatgccgttgtcatgcgtagcaactatctttctatttccttcttcctttctcttccacgtcaccaaatatacttgcatgataataaagagagaccactaataaagaccattatacatgccctaaggtaacactttttctattataaatttagtatctcttggtacctaagtactatgaagaactaaattttacactaattttttattatcttatggtatctcttcaaggaccgtagaattgctcttatttgagagtttaagattaaagcagctgttgatattccaaacaaactggtaaacccaggttctggctttttattcgttttatggattctacgattacataatctcaaaatcagggtagaaactacagccgctataatataggagaaactacagccgctataatctcttaaaaagggttttgagaaacagctgattagtagttaacttctaataacctgaagatattgagtttttagtctctggtttctaattcgttttctagattttacaattatagctttttaaaatctggatgaaataattgtgagagaaactgcagccgtgggaaactccacaaacaaacccgatgtcgagcggtgccgtgaggcgaacctcccaatcgcgcatgcgagatctcaccatctcgtcgccgtatcagcccgacgaaccggtccgtgcggcgcggtgtctctcgcgtgcttccgtggacgtcgtggtctcgcaagactatcgatttatttctacgtacacggtgctaccaatccatcgatgctgactgctcatcagcgtacatcgaaaattcgaacatatatactcccactactgacgacacagcatgttcttcgccgctgtgagcgcattttcatataggtcggtctgaaattgggattaagctaatcaagcgagcaatcgagacggatatcagcacatagtacagctttcagacagattaattatcaaatattagtataactggttttttattagtccatgatgacaattaatcagactagttcgtgtatatatatatggccatgcatgatcgatcagttgcttgattttctaggccggtttaatttggtcgagatggaacatggcatgcatgcattcgcgcctgacggagctagacacgctccgtgcatgcacgtactgcacgaaagctgcctttgctaaatccccttctgattaactaagattccatctcccattttttttcttgaagaaaatattcccaaacctaccaatcaaactaaggcacttaataagttcatccacattcgtcgacatttttatatatccttttggttccatcaccaatatattatatatgcgattcttgatttcgaccaacaaggtagaaatcttattggtccttcattgctcaatccctgtttaagagctactcccccctatcaaaatataagtatttttagaatagtgccaagtcaaattttttaaattttgcctattaatagtaaaaaagttaaaaatattaatcatgtaaatttgatcttactatatttatcattaaacgaaatatcataatatgcaactatttttatttaaaacattctacttttaaaaatatttttagtaaaagtagtatctcgaagaccatgtcaagataaaaaaatacttacattttgggacggagaatgtaccttattattattttctattttctgggtcaagtcatgacctgatcctgcaacctgcatgcatacataagcgtagaccatgtcaagagaactcgataaacgtagaccatgtacatgtaacttgatgagttgtttaatcatcgtgtgattaattatctttatatacactgtcacaatcgtcgacgataatgtcaatactccacctgcagccgcctgcatcaccgttcgctaagctgcgtgcactgcacaacgtgatttcacacggccattttcactttttggtccaagcttagttaggccccgtatagttcacaattttttttcctaaaaacatcacatcgaatctttggacacatacataaagtattaaatataaataaaaacaaaaactaattacgcaattagggagaaaatcgcgaaacgaatcttttaagcctaattagtccatgattagccataaatgctacaataacccacatatgctaatgacggattaattaggctcaaaaaattcgtctcacagttttcaggtgagttatgaaattagttttctcattcttgtccaaaaaccacttccgacattcggtcaaacgtccgatgtgacacccaaaaattttcttttcccaaactaaacagacccttagcttacggcttgaaattaattaactagctctcgtgatataggttttcaaatattttgtttagtactttcactagtccacgatcaattggccacacctaaaaaggttaaactgcgtggtaacttctccggcactgctaattatagccaccatgtgctcggtttaacattcgctaacttactctattaattctaacggacatcgagagtgggtatgtgtcaactgtgaaaagtacacacctcgaaaattagttagaaaataagctgtcaagtactgtaagctctcacgtcatgcctatgccgaaatggaaaaaaaaataaatcgtaaatcccataagcacaaaatactttagagttacatgctaatcacacatctgcttgagatttttgtttagacaagcaaatttgaatttacaagttggtgttatcgactggaatatattccaacgggacgtcaaacatctccatctccatttccctatctaatcccatagcctaaccggtttcggtttagtttaagtttaatttgaaaatttagcagcgcctttgtccctacgcctgctacgtcatcggggcggggatccgcatccgcatccgctgcgcggcgcagagcagcgaacgctcgcgcaccgaccgtcggatagccgcccgcgtgtgcatcgagattcgggctgaggcgctggttcgcggtggatcaggatttggtggggcccggccggccgaggcgcgggggcgtggggcccacctgtccgtgtccggaggcgcgaggcccgcacgtctgcccgggagctgccacgtaggagagagaaagtctgacgtggctcgggcctcatttgcggggaagccctcgtcagtcgtcaaaattgctcgttgtttgtaagcagacacgaaggttagtactaggagccaaagattaataaagaatacatttattagcattcgaagatgacagcaagatttttaataatttggttaattcaaagaatctgctggagttgtccaaatccggataataaatttgaccctatgtattgtacatctccttagttaatcttcatctaattcaggctcgaatgggaccattgttgctttaaaacttgttcggtatctcttaggcagtggtttttgttttacctaaactacacaattttatcctttgcttcctcttacgataaatatgattctttgctagtatatattcagtatgatagcatttcgataactttctttatgaatgaaattccaacgtatatacattttataaaagcctttcgatccctcttatagggacaaagatctaaccatttgattacaaatctaacgcctaatgatgctctcccgtcgtatttactctaaaaacgtcataccccatctatgtttattcggttatagcatcgtcttatcatttcttcaacctcaacatatccccatctcctcctaccttgtaatgctactcagatctacgtgtttagatctgctcattgattttatccacatctccttctcttctcttggtatttgtatcagccgccaccactagtataatcttgcttcactcatattctcatgtgccaaaaacaactttagggtttcgcctcgaagcaaatagagtcatcaaaagcttacttcatcaatatccatcggtgacgaatatagatgagtaggagttgattatgtcatcggattctctaacactcttgttttatccctacatccatcgagggcgcttctcttgattggccaaatggtatgtgtttggtgtttttgccaaataaaatattatacattttctctattaagttatattcctcactctaaatttattattattcctttaactgaatattcaccgaacatatatataaagtatcatactatttatattctctctctgtaacatgttaatttcctgataagtcttacattaaaaagtactccctctgtcttataaaaaaccaacctagtaataaatataacacatcctattacagaatctggatatacatctgtccaaattcattatactagaatatgtcatatccaatcctagatttttttttggacggatggaataggcaccatgctctctagaattttattttttaaaatctatttcaaatacacacatcaagcttgccactttcacaaaggaaaacaaaagataggtgagtcggaacaggcaaaacatttttctcccaattacggtagtgcgaagacgtcaagcaaaagtcacaaaagattttaaagtaaaacgcacacaaagtcagacgaggttagtaaagcctagttaacgatgttacccacaaggccattttcttttcacaataaaagaaaaaaacacaaaaatggacaaggaagctaagcaaccaaatcacccaccaaatcgcacagtacacacacaaattacaaaccaaacagagagagaaagacagaggggaaggaagagcgcgtcgtcgaggaagacgagatagcgaggaggcgcgtgggagaaaaggaggaaacaaaagggagagaaaaaggaaaaaaaataattattacaagcgagggagagaaaaaacacaagcaaaaataggggcaggaggaggaggagggaggcgaccagaggaggagggaggcaaaaggcccgcgcacccggggaggggaaggaggaggaggcgattttttgttgttgttggtgataggaactaggtgggtgggaggagaggaggagggggggggggggatcgcgtcggaattccggcgaatcggcgggatccggccgggatctgcgcggcggatgaggggtcggcaccatgaaatggtcgacattgctcagtaaggtcgtcttcgccggccagcaggagcaggagcagccgcctccgccgccgccgccgccgccggggtcgtcgtcgtccccgctcaaccgccagaagcagggcgaccccggccaagccaccccgcggctcagcgccgccgacgagggtgggtcggtcggaggtggcggcgtcgcggcggcgtccgggagctcgccctccgccgtctccgcgtcccctgccaggtaggccacgccacgccacgccacgccacgccacgccgtggagtcaaatactgtccctcgcctgaatccgtcgtggtgtaggcagctccgatgcgatcctgtcgcgtgcgttttttcggattgagcaatggcaatcggatttggatttcgagagcgttcgatcgtagatgctttaccttttttttttcctcgttctctgcgtgctttttttccccgtgtttggagatttgataggtagatgcgggattaggcgtttgatatacgctttgacctttgctggttgatacacctgatattgtttttagctcaagcttcccagtaagttccaaatttttttggttttactcatacggttccggggagaaatgatgttggaataagacggtggttggagatgcgttagctgtgtggtcagctcatggatttcaattcgtctgtacgctgcctattgcctgtttcttttggttttgttatgcgtttgcattagaagcgaaatttgtatgagctcttctagagatggtgggagttttacttgtcacggttgatgccaaattggtggagaacttgatgaatctgttgattcagcattcatgtttgcattggctgtgctttagtaataagattggtgcatgccattttaagacactgtttaactttgatagtgttcctgtattgttgcctctgagaagttgcttgctaaatttgtatatccacttagtgaaatttgattgtattactaggattatattcatgtccctattggaaacaagtaagtagtagtaattttatgtgttggaaattttgacatatttaaattcaatggcattattgtttatgttatacatctgagcacaatgtctataataaatgctaattgagcacgcatgttattgttctttatattgataccatgacgtgcctagagtgattaccagtgttagcattctctgtgtcctcttctgttccatggtaataatattgactgtacaaccgttgtaattaaggttcctattgtaatcgatgccatatatgaagaatacgttctatattttactgtagaatggagatttatgagctgttttcatttgtatatgcttgatacctggttctttattcagatgttctcttgtcatttcttcagcattcaataaatatcattaacctaccaagaaagaatagtgacttttgcaattgcattactaatgagatatcgtgagtctcatcctttattcctttgtggctttgtctggactctggactaccactagatattatgttgttaaagttggtaacttcgttgtgtgcgttgtttcaaggtgttctgtaacttaaacttgtattgtatggtaactggcactgggaaagggataatattagagcctgtataatgttatagttctctctcgtacttgttagttggctagttgcccttccaatccttgcatggcagttcatgtatttgtaggtgtcatgtcaggcattcacattatatatgcatcacatggttctgatgcatggattgtactaagaatgacaaaacgaggcatttgatccctttgcttcaattattctccagaattttatctgctgtttcaagtgaatttcctgcaaaaatttctcagtttgtactcccattgttaaataaatgttcttaaccttgtatttgcaggggaaaaaatgagttggagttggacttcaggaggttctgggaagaattccgttcttccagctctgaaaaggtaccatcgcacttggttcaccttgtcaccatggaacatagcacttgcatgtccgttcttatcctaacactgtgccttttattttccctgcacaggagaaagaaagggccttaaatttggcagtagatgtcttctgtaggctagtgaaggagcactctagtgtagctgaattagttacaaagtatgccttgttaactttcatacattcgctacattgttttagtttattctaaaatcatatctgtttatcatgacataaatctttatccaggtcgagttttgttaacattcttgtgattactacaggttagtagaagcacatgtttttgcttttgttattggaagagctttcgttacagatgtggaaaaactaagaattcacagtaagggaagatctttgcgtgttgctgatgttattggtttcttttcggagatcacagaggtcagcctttataataatgcctataatgcagtttccaaatttcatgtgaccatacattctctgctaacttctattccattatccagcttggcatatgtccaggttcaaatttgttatatgcagttgaagttcttgtgacacaggttcgtgcagtttctcttgttaatatcaaatcattctgttttctgttatatttaatctcccttattatcttatcaggtgttaaatatatataatcgtaaagtcaacaaaactgtggtattcaagttttttgtgattgtgtttgtgtaaatttttactaattataatatgatgaggagggcacatcattgtgataaaagctatacataggccatatatatactccaggtgttatttgaaattccttttgccttcaaagctattatgaacattggactagtgtgttatatttacctctgtaatactgttttcatctttatatttatatccaccttgtcctctctgtaagtatacagtatgagccatctggaggacaaaaatgattctaaacatctgaacaagagcagtatttctactacaaaccttgtcaaaacaatgttagttcttagtgtactatatataatcttgcatatttgtgaatagatgatgattgtcaatgaatgttgcaaagagaatctgtatatcgaagcaattagccattaagtgtttggtgttaattttgggctggttttgcaaccgctaagtcaagttatggtatgaaaaccaattttagttccctgttctttcctttgcaacctttttgcattgacaatgacacatgtaataagacaaaaaaagagaggcatctgctttctgataaaaaaacaaagcttagatatagtaaggaatgtgcaactgacatatggtgtttcaaatcggctaaaacaacatttgccaaatgctcagagtaacatgcttttcatgtttaatttcttggttacagactatcgataagcagcctctgttggattctggtattttgtgctgccttatatatatcctcaattccctattgagtcctgatgaatcctcccaaaaatcctctcctgttggtcaagaagtttcaaccagtgagaagagtaaagattggggtcctatgctatcacggcgccttgaggtaataccagtctcgtggttcttatataaagaggatttcctttgcattattttttaaagaactcgacgcaaggggagagaatcccgaaggcattgcatttaaggtcgagaaaaggccctgaaagctggcacttacctgtatgggaacattgttgtcacaggctgtcttaacacttacttttggggaatacacagagaggtaccttttttttgggtgagaaccaggttttgagccctggttggtagcctcacaactggaggacttaccaccgtccactgtgcataagcacgttctcacctttgcaatatcatatactacctccttttttaataaatagcgccgttgatttttggcatatcgtttgaccattcgtctcatttaaaaattgagtataaatatgcagaaatacaagtcatgcttaagttttctttaatgataaaacaggtcataacaaaataaatgacattgaataagatgaaaggttgaatgtcatgccaaaagtcaatggcatcatctactgaaaaacagagggaggagttgttaacttattctgatgcaaaatcacaacttgttaatactttatccgctgaacttcacatagtgccatgctggagtatccatctgaactaatacaaggcattcgttttatgccaaacctgcattatgtgatatgttaaaccttcttaatttctttgcctggttaatttgagttttgatttttttccccttgttttttgctctatggagatcgaggcaagtgtagtacatacaatgaaggcactagcgagccatccatctgctgcaccaagcctaattgaagatgatgctctacaagttctattccacatggttgcaaatggttccctgaccgtgttctctcaatttagggagggtcttgttccaattcacacaattcagcttcatcgccacgcaatgcaggtaagttgatatgatgcaacattttttgtggatacctgacttcctgccacaccgtaagttcctaatatatttattccttaactgagcaggttcttggtctccttcttgcgaatgacaatgggacttcagcaaactatataaggaagcatcagttggtacattctttatctcttcttcattgtgggttgaaatattttgatcttgttcttctgtttttagcaattgtatcttagtagttattagggctccttgacaccatactcaatgtaaaaatgtgtctgtactgagctttcttggcaaataatagaactcctgtagagcaattaatacctttttattgaattatctagagtatttcattttggtatagttatctctctctctctctctctctctctctctctctctctctctcttttgtgtgtttggaacatctactcttttgcactattgctaataagtcctatgccttttagattaaagttctccttatggccgtgaaagatttcaatccgcagaatggtgatgctgcttacaccatgggcattgtggatctcttacttgaatgtgttgagctatcttacaggcctggtaaacatggacagacttttgccattcagatacatttcatcttgatattttttcaatgtgtacataattcatggtcagctactcagctatagcgtttgctaatatttcaatatatggttaatattgcagaagctggatccgttaggctcagggaagatatacataatgctcatggctatcagttccttgttcagtttgctcttacactatgtagcttacataagaaccaggttctccaatcttcgcccaagttagcatctgaggatggagtgaatcctcctcacagatcagaacaagatacattcacatccgatctttcaccacagctatcaagattgcttgatgttcttgtaaatttgtcgcaaactggactgtctgaaaattatgttggtaaaagtatgaaatcttctcatgggaagggaacaggccacaacagaagccggactccatctgttgacaagttcgcagatgagattttggagattaacagtcccaaagtaaaagatcttgaggccattcagatgctacaggatatatttctgaaggcagacaacttggaagtgcaagctgaagttttaaatagaatgttcaagattttctcaagtcatcttgagaattacaagctatgtcaacaactgcgaactgtgcctctttttatcctaaacatgggtggcttccctccagcacttcaagaggtcatcttaaaaattttagaatatgcggtcactgttgtaaactgcatcccagagcaggagttgttatcactctgttgcttactgcagcaaccaatttctaccagtcttaagcatacaatactctctttctttgtgaagctcctttcctttgatcagcagtacaaaaaggttctcagggaagtaggtgtacttggagcgttgttagatgacctgaaacagaacaagcttttttttggagaggagccacaaaacaggacccctaagtctgcacagaggatgtccagtgcaagtagttttcgaaaaaccatggataacaaagatgcgattctttctccgaagctaatggcttctggttccaccaaatttcccatgtttgaagatgaagggacaataactgttgcttgggattgtcttttttatctgctgaagagagctgagcctaatcaacaaactttcagatcttctaatggcgttaatacgattcttcctttcttggtatctgaaagccacagatctggggtattacggctattgtcttgcctgataatcgaagattctcttcaggtttgtgttagaacctgactcccatgaaatacatagtcatttttaatcacgaatcatcttagtttagggcataaaatgccaagttcatgggagtgaatgacttgtaaaaaccttaagggtctatttcccctatgatttgttaattttaatgatgcttaaaaattgaatttcacgagcaccatgtgagctatgactcctttgacattgttttcaggctcatccagaggaaatagggtccctgatagaaatcttgaagagtgggatggtatcaacttcgtcaggttctcaacagaaacttgacaatgatgcgaagtgtgacacttttggcgctttgtggcgtattcttggggcaaacagttcagctcaaagaatttttggagaagccactgggttttccctgctactaacaacgcttcacagtttccagaatgacagtgaaaacgaggagactgaatcatctttgcttactcatatgaagatctttggttttctaatgcgagctatgacagctgcagtatacagcaatcctgttaataggataagactgcatacaatcctgtcttccaacactttctatgatcttctgtctgaatctgggttgctctgtgtggattgtgagaagcatgttatcttgcttttgcttgagcttgcacttgaggttgttcttcctcccactagtaacctgcaggtagagagcatttcatctgaaaacccagaggatgaatcaggtttcttgtctgcaacctcatttggactatcaaggcttgacaaggagcgtatatataatgctagtgctgtagttgttttgatccgctctttgctagtatttacacctaaagttcaactcgagctgctgagattcattgagaagctagcaaatgctggtcccttcaaccaggagaatttaacttctgtaggtatggacagcaattgttttgtcacctctgtttcctttactttagctggcgagtttgccttatgttattcttgccctttttgttatacaggatgtgttggtcttctacttgagacaatcaacccatttttggagggctcatctcctatccttaatcacgctttgagaattgttgaagttctgggtgcttataggttagttatatttgatggttaattttatatagaagcttgccttgttagttgtggtacatgttatgttttttctttgtcaggctgtcttcttctgaactaagacttctggtgaggtatatacttcagctgaaagtgaagtgttctggtcatctttttgttaatatgatggacaagttaatccaaattgaagatgtcagacaaggaagtatttctctagcccctttcattgagttggacatgagcaaagctggtcattcatctattcaagtttcattaggagagaggacatggccacctgtttctggatactctttcgtttgctggttccaatttcagaacttctttagaagccatcctaaagaagcagaaaaaacatcaaaagggtcttatagtaaaaggaatggacaagttatgcgcatcttttctgtaggtgcagttgatgatgccaacactctgtatgcagaactttatctccatgacaatggtgtttttaccattgcaacaagcaattcaagttcattatcatttccaggcattgagatggaagaagggaaatggcatcatcttgcagttgtacatagcaaaccaaatgcattagctggcctctttcaatcaagtgtggccagtctatatcttgatggaaagttgaggcacaccggcaaacttggatactctccatccccatttggtaaatccttgcaagtaacacttggtacacctgctatccgagccaaagtttcagacctatcatggcggcttcggtgttgttatctttttgaggaagtcttaacacctggcagcatttgcttcatgtatattcttggacaaggttacaggggattgttccaggacactgatcttctgagatttgtccctaactgggcctgtggtggggaggtgatggcaattcttgattcattggaattggaagtaattgcaccttcaggcagccagcgtgttgatagcgcaatgaaacaagggaactctagacttgagagcagtggaatcgtttgggatatggaaaggttaagaaatctttccttacaactgtccgggaagaagctaatatttgcatttgatgggacttcatcagatgcttttcgagcatctgggactttgtccttgctgaaccttgttgatccaacttctgctgctgcatccccaataggaggtgattgaacttctagctatttttatttaaacttttttctcttggaagatgtcaatattcactatgttctttgaaatgacaggtataccgcggtatgggcgcctaagtggggatgtttatgtgtgtaaccagtgcacaattggtgacactgttcaaacagttggtgggattcctgttgttcttgctcttgtggaagccgctgaaactagggatatgctgcacatggcactagaactgcttgcactatctcttcaacagagccatcaaaatgtgaaggacatgcagtccttgaggggttatcatcttcttgcactttttctgcataggagaatgtcattatttgacatgcagtctcttgatatctttttccgtattgctgcttgtggagcttcatttcctgagccacaaaagtcaaatatgaaccgaacagcaagctatgcatctggaatctccccagagtccagtcttgatgatcttacattacccaagtttggtgatgatatgtcttctattggatcacatggagatctagatgatttttcagcacaaaaggattcttttagccatctgtctgagcttgagaatgccgacttagctggggagacttctgagtttatagtcttgtcaaatgctgatatggtcgaacatgttctattggattggaccatttgggttactgctcctatatcagtacaaataactctccttggatttcttgagaggatggtatcaatgcattggtttagaaatcataacctcacaatactgcggcgaattaatcttgtacaacatcttcttgtcactttacaacgtggtgatgttgaaattcctgtcctggaaaagctagttgttctgcttggtgtcatcttggaggatggttttctagcttctgagttggagcttgttgtaagattcgtaatcatgacatttgatcctccagaacttacaccaaaccgccagattgttcgggaggccatgggaaagcatgtcattgtgaggaacatgttactagaaatgcttattgatctacaagtaaccataaatgctgaagatatgctggagcaatggcacaaagttgtttcgtccagattagtcacatatttccttgatgaagctgtgcacccaacaagtatgagatggatcatgactctcttaggagtttgccttacatcctctgccacttttgctctaaagttccgtacaagtggaggtttccaagggttgaatcatgtgcttccaagcttctatgattcccctgaaatatattatatactcttctgtctgatttttggaaagcctgtttttcctcgagtaccagaggtccgcatgcttgatttccattctcttatgcctagtgatgaaaactgcggagaattgaagtttgtagatctattggatactatcattgcaatggcaaaagctacatttgattcattgattatgaagtctatgcttgcacatcagaataataatctttcacaccttaatggcaccttagttgcggatcttgtggaatcgacaccagacatgggaggtgatcttcagggagaagccttgatgcataagacatatgcagctaggttaatgggtggtgaagctgcagcacctgctgttgctacttcaatactgcggttcatggttgatttgacaaaaatgtgcccaccattctctgctgtttgcaggcggcatgatttcctagagagctgtgttgacctatatttctcttgtgtaaggttcgtatggtgtgcatatgttaagttatgtgatgctctagatgtttaggctaaaacctttttattctgcaggtctgattgtgccgtgaagatggcgaaggacctaacatctgcggcaacagatgagaagtgtatgcatgatgatgacaacgaaagtctaaaagatactttttcgaatttgccacaggatcaggaacaatctgccaaaacttttagtattgcaagttttccccaggagcagaaaagttcgagctcaggaagtagtggcatgcataactctttcgaaactgctgaagtaaaagcagacgactcttccaatcaggcatcgagcaccacgtttttgaatggacaagcaaaccaagtggttcagagtgctcatgatcaaggacagatgtcagccccaagttcaaatggcattgctgattcccaccaaccagctgattcacccacttcagcttctatgaacaatattgggtctcctgttttatctgagagatcagctcacaaagcagcaagtacccctactgcatctccgatggctccatttgcatcttggcctggcagtgcaggatcatacagcgatggtaggcagctaacagcctctccatccatgtcttcaactatatctgggattgacctcgattcatcccctgatctgaagacaaacattcaggggtcacctgcagtgaacacacttttcccaattaattcgaagcttttgcttgacatagatgatttaggttatgggggtggtccttgctctgcaggagctactgctgttcttgatttcattgctcaaatccttgctgatattatctcagaacagctcaaagcaacactctttattgagagcatcctggagtgtgtgcctctgtttgtagatatcgattctgctttggtttttcaaggtttgtgtctaagcagactgatgaacttccttgaaagaaaactcttacttgatgatgaagaagatgggaagaaacttgacaagagccgctggtctgcaaatttggacccactttgctggatgattgttgatcgtgtatacatgggctgctttccaaccccagtcggtgtgctacgtacgctagaatttttaatgtccatgttgcagctttctaataaagatggccgtattgaagatgcagtaccttcaggtaaaggtattctatccattgctcgaggaggcaggcaacttgatccttacatccacgccatattgaagaacactaaccggatggtaatgtattgtttcttgccaacattccttaagaatatgggggaggatgacttgcttgcaaatctggctttcctaacagaaactggaagaagtttaggtatttttaaaccttcccaggaagattatactgttgatatctgtactgttcttcagcttctgattgccaacaagaggctggtgctgtgtccaagcaatgttgataatgatctaatgtgttgtttctgcataaatttaatggcacttcttcgtgacaagaggttaactgcacaaaatttagcagtggatttacttaaatacttggtagtgcatcggcgtccgtctcttgaggacctcctagttagtaagcctaaccaagggcaacagatggatatcttgcatggagggctcgacaaactactgactggaagtacaacagcgttttttgaatggctccagagttctcagcaaacaataagtaaagtgttagaccagtgcgctttaataatgtgggttcaatatattactggctcagcaaaatttcctggggtgagaataaaaggcatggaggtcaggcgcaagaaagatatgggacgaaaattacgtgaaattgcaaaactagattcaaggcactgggagcagataaatgaacggaggtacaatcttgatttggttcgtgatgtaatgtctacagagctaagagcgattcgtcaagacaaatatggatggatactgcatggagaaagtgagtggcaaagccagctccaacagcttgtacatgaaagaggcattttccctgtgcggcaattatcgacagagcctgcatggcagctgtgcgctgttgaaggaccgtatagaatgcggaagaaacttgaaccgtccaaatttaagatagatactattcataatgttctagccagcaaccttgggttagatgatgttaagattaccaagaaagaggatgggcacatggtgatgacatctggatcagatacaatgtcaggcttgaatcttttgacctatgacacagaacggaaggatcttgatgctgctgattttgcatcgttcaaagatgaagatgacatattcaaaggaggaagcacagtgtcacctccaattggctggactgatgataaaagcagcattaacgaacaaagtcttcactctgcaacagaacatggagcgaaatcaagttccttttcttatcacatgacagagagtgtccacggtaaatctgaatttaattcacctagacgggcaccttcagttaagggcaccgatacaagaacctcagaggataaatcggaaaaggagttgcttgacaatggagagtatcttatcagaccttatctggaaccttccgaaaaaataaggcataagtacaattgtgaacgggttgctggtcttgacaagcatgatggaatatttttaattggagaacttagcttatacatcattgagaacttctacattgatgattccaattgcatttacgaaaaaggcaatgaagatgagctctctgtcatcgatcaagctttaggtgtaaaaaaggatgtattgggaagctgcgattctcaccaaaaatcaccatctacgtggggtgcaacagcaaaagttttgcttggtggcagagcatgggcatacaatggaggtgcttggggtaaggagaagctttgcagtagcagcaatttgcctcatccatggcatatgtggaagcttgatagcgtccatgagctcctaaagcgtgattatcagcttcgccctgttgcaattgagattttcagtatggacgggtgtaacgagcttttagttttccacaaaaaggagagggaggatgttttcaaaaatctgaccgccatgaacctcccacgaaatagcatgtttgtattcttaactctttgcaaatacatacactcagtaattaccatgcatgttcagtcatttctttagtataagatctgaatgtcaggtcctactatcaaggctatgtagttttcagagttgaaaccatctagatatgatcccttggcataggttcacaacaggtttatgtgtttctttgtctatcctgataggtttatcacaaccgctgaacaagattagactggaaactgtctgcttacgtccatcgagtaccgctcaatgtcatttttttaaagaaaaatcttagcaacaaaatagagtagtttttttttggactaacaccacaagaaacgggcataattctgttaaaactagcgaaactgccagaaatatatgtaaatttgcaatatctttgtttttttttattagtcaattctcacccttccctacttaatctggtaattagcaagttctaagtgatttatcatctatggtgggaacatattgtgagtgcaagtatgaattgatagacagacacatgaaattaagtcctaaggcctttattgtatgctggaggtttctaattgctctcatgttcttcctgcacatgcacagtcaaattttaagttgcacaactaggcattattttttaatgatttttacaatacactttttttgacattgaagtatacttttacctatcattaacaggttggacacaacaatatcagcatcctcaaaacaggatagcggtgaggggagccgtcttttcaaaataatggcaaaatcattttctaaaagatggcagagtggagaaattaccaacttccaatatctcatgcatctaaatacacttgctggtcgaggatacagtgaccttacgcaatacccagtatttccatgggttcttgcagattatgagagtgatactttagatctgagaaacccacagacgttccgtaagcttgacaaaccaatgggatgtcaaactgaagggggagaagaggaattccgtaagaggttcgttcatctaacatcaatggatatacttattttgtttatttcttaatataaaagactatgcctttaggctgtagtattgctgtacataagataagaatttgtgcatctaacattatctgaaataccttcttctgtttacttcagatatgatagctgggatgaccctgaagtaccaaagttccattatggttctcattattcaagtgctgggattgtccttttctatcttttaagactgcctccctttagtatggaaaatcagaaattacagggtggacaatttgaccatgcagaccgtttattcaatagtgttaaagatacatgggtaagtgctgctggcaagagcaacacatcagatgtcaaagaattgattccggagttctattatttgcctgaatttttggagaaccaatttaatctggacttgggggagaaacagtccggagagaaggtatgctacttacacaaaagtgcactgaacttttaactggatgtaaatatgtaatggcaatactcttaaccaaacctattcaagctgcatgtaatctgtaaaataatgatttcaggttggtgatgttgttttgccgccttgggctaaaggtagctccagagagttcatcaggaagcatcgagaagccttggagtcagactatgtatccgagaatctgcatcactggatagatcttatttttggatataagcagagaggaaaggtataggccatctcatgtttgtgcattctttattgttcctaatggtggtgatattgccgtcatcatgacaacataaatatgtttgtcttaaaaacaagggtgttatcttctgttatagattcgtattccttcatttctgtggtcctagtggtggtgacgttgccatcgtcatgagtccatgacaattcagacatgtttgtagttttttacaaaggaaaatgaattgtgtttttttatagattgataaattttgtcctttatagcatcttacccattcaaaacctctcaatagttttttctaggtcttgttcagcatgctaaatttgtatcattttttactttctcatggtctttcaactctgagcattgatttctacactgttagccagaagtattttacatttgtgaatgtaaaccagagtgacttgtaaaattgtgacacgaaacaggggaagttttctgctaatcatatttattaacttgttctaattgttatttcttttgtatatggcaggcagctgaagatgctgtaaatgtcttctatcactacacgtatgaaggcaatgttgacatagattccgtatcagatcctaccatgaaagcttcgatactggcacaaatcaatcattttggtcagacccccaaacaattattccaaaaaccacatcctcagagacggactgacaggaaggtccttcctcatcctctacggtacagcgcgtatcttacacatcaagagattcggaagacaacatcatcagtttcccagattgtgacctacaatgataagatcctaattgctgcagcgaacagctttctcaagccagtaaattatagtgaatatatttcctggggatttcctgaccgcagtttgagaatattgacctatgatcaggataaacttgtatcaacacatgaaaaccttcatggtggtagtcagattcagtgcactggagttagccatgacggcaacattctcacaacaggtggtgatgatggtgtagttgcagtatggagatttttcaaagatggcactcgtcgtctcctgagaatggagaaagctctgtgcgctcacactgccaagataacatgtatctatgtgagccagccttactcattaattgtctctggctccgatgactgttcagtgatcttgtgggacctgacaagcctggcctttgtgaagcagctgccaaggttcccagcatcagtgtctgcgttacatgtgaacaatctcactggtgagatcctgactggtgccggtgttctttttgctgtttggagcgtcaacggagactgtcttgctgtggttaatacctctcagcttccttcggatctcatcttgtctgtggcaagcactacaaactcggactggcaggacacaaactggtacgtgacaggtcatcaaagcggtgctgtgaaggtatggaagatggtgcactacacgtctgatgaggcagcaaacagcaagagcaaatctccaccgtccacccttggagggatgagcttgaatggccagactcaggagtacaggctacttcttcagaaggtgctcaaggctcacaagcacccggtcactgccctttgtcttccacccgacctgaagcagcttctgagcggggatgccagtggccacttgttctcatggtcactaaaagatgatagctttaaggtttcatagcaacagctcaacagaggatagtcaggattcacctgcacatatagagagccttagttaagttatatacctctggttcctttctcacccagaatctgacaagcacctgcttgtgctgccaaagaaagaactcagagttggcctcggcatgcagaaacattctacaatatggttggcccaggccccagcccattcagcaaaatctggggtgaagacacagtacaacagaaacacactggaagggataaaatggagatggcgttgtgctgacattacaatcttattatactgtgaattatctaccggttctacctcatcttcttgttttttcatgagaggattcgtgcggggtagcaaccagcgtgtgtaaagtttgtataggatgcttttggttagtagtggtgaggggacgatggtgatgatgttgtacggtgaagatgttatttttcgtcttggggatgtaaggaaaggggtg

SEQ ID NO: 67335 - DNA, 14667 bp, Oryza sativa
aaatttacctgggcaaatgccatgccaaacccaacatatgaaaaattagatcgagttttggtaagcacagagtgggaagtgaaaaacccattggtgactgttcatgcccttagtagagatctctccgatcatacccccatgttgctagacacgtgtaaagggtctcacaaggatagtcaaccattgttcaaatttgagctcggttggctccttagggaggactttcaaaaactgttagcaaatatttggaccaaagatgttagaggggcaacaaatattgcgagatggcaaaataaaatttgaagacttcgtcagtttcttagaggatgggcgaagaatacaagtggggcttataagaaagagaaagtgaaattaatggcaaaggcagatgagctagacaaactagctgaaactagacttttgactagtcaagagctcgagttaaaaaattcagtaaaacatgccttggctaagatgttgagagaagaagagatcaaatggtatcaaagagcaaaaacaaggcaaattgtaggagatagaaatactaaatattaccaaatgattgcaaatggaaagcataggaaaactaagattttccagctagaccaagaagagggaataattaaaggtaatgagcaactcaagaagtacatctctaactattataagaatctttttggagctcctgaaaagaataatttctctatgtgtgagaaccaaaaagatgatatacctcaaatatccgtagcggaaaatgagttgcttacgagtgagttttcagaagaagaggtgaaaaatgctatctttcaaatggagcataataaagccccagggcctgatggttttccggcggagttttatcaagtgttctgggaggtaattaaggatgacctaatggcagtctttagagactttcataggggcaatctttctctcaataatttgaattttggtattattactcttctacccaagaataaggaggcaaggcagattcaacaatacagaccgatatgcttacttaatgtaagtttcaaggtctttactaaggttatgacaaataggattgctctagtagcacaaaaagtcataagaccttcacagactgcctttctaaaaggaagaaatatcatggaaggggccattatcctttatgaaacgttacatgagatgcataggaagaagttagatggggtcattctcaagctagatttcgaaaaagcatatgataaggtagactggaaatttcttcagcagaccatgaggatgaaaggcttttcggaacgttggtgcaaatggatagagcagatagtgacagggggaagtgtagctgtaaaagtcaacgatgaaatcggaaatttttttcaaacaaaaaaagggttatgacaaggggatcccttatcaccaattttatttaatttggtggcagatatgttggcaattctaatcaataggtcgactgaaagaggaatgacacgaggtgtaataccgaatttggtagataacgggttgtcaattttacaatatgcagatgataccattatctttatggaaaatgatgtagaagaagccaaaaatcttaaaatggtactaagtgcctatgagaagctttcaggcttaaaaatcaattttcataagagtgagatgttctgttacggaaaagccaaggaagtagaaaaagcattttcttttctatttggctgcaagatagggtcctacccttttagatatctaggccttccaatgcactataaaaggctggcaaacaaagactggaaggagttagaggatagattcgaaaaaaagatcagtagctggaaaggaaagtttctgtcaacaggagggaggttaatcctcatcaattcagtgctaagcagtctagcaatgtatatgctttcattctttgagatacctaaaggtatcttaaagaaactggactattatagatccagatttttttggcaatgtgatgaacataaaaagaagtataggctggccaaatggagtgtactttacaaaccttaggagtgtggaggtttatggattcagaacctagagattcaaaataagtgcatgcttagtaaatggatctctaagttaatcaatgaagagggaatttggcaaaatttgcttagaaaaaaatatttggcaaaaaaaccattctacaggttcaaatgcagcaaggagattctcatttctgggctagtctcatgacagcaaaagaatcattccaattacttggacactttaaggtgagaaatgggaaacaagttagattctgggaggattgttggatgggaaacaaatctcttgagaaagaatttcctaacttgtacaacctggttcagaataagaatacagtacttgctaaggttttggaaacgataccgttgaatgtgtcctttagaagagcgatagttgggaaaaacttggcagattggtatgtcattgtctcgaaagtggctaatgttaacctgacaagtcatcttgaccaattcatatggaaaactaataaagaagggttgttcatcgtaaactctatgtataagttacttatgtttgatggagtaatacctaggaaatctttaatttggaagctaagaattctattaaagattaagattttcctatggtatttgaataaaggggtgattctaacaaaggataatctagctaagagaagatggaaggatagcttattgtgtagcttttgtaactctaaagagtcgatacaacaccttttctttgattgtataatggctagatacatatggagtgtggtttattttactttggggattagacaacccagaagttgcgctcatatgtttggtaattggttgaatggttttgaacctaaactcaaaagacaaacttgggagggcatagcggcaatttgttgggccttgtggcttagtaggaatgacatcgtctttaatggctataatcatatttctttcttacaggtaatattcaaggcaactcattgggcaaggctttggtctttgcttcttaaaaaagttgaaggagaaaaagctcaagtcaagtgcagaattttggagaagcgagttatggagttcttctctacctttggatggaattttcgaagaagaattgaagtttagcctccatttctctttaatcgtttgttaaacttttatttgtgtgtccctatgtaatgggaggagtcttatgtactcgtgactatggttttggctgtgtacaccctcgcaaggtgtagagaccgggtttaatataatccattatctaaaaaaataatacttagtttaacccaaagttcaaatatttctaaattatatatatgcgatgaccatttcacttaatattatttatttttaatccaaattaaaaatatttctaaattgtactctgcaagaactcttttatctataacatttatttttataccacattttatatatttgtaaattgtatttctacgtgtactctcccaatattatttattcaaagtttagttgtttctaaattgtatttctacatagactattatatcaatgttaattatgttttaggttctagtccaaattttataatatctgattgtatttctagatggattcttatatcatttttttgttatttgtaattttttgtttttattctgaatttcatatattttcgaatgtattctttacgtagactctaattctttattttctaagttttactcccacatgatctcttttcccaataagatttttgtctaattgttgggagtacagctatcagagaccgatgcaagcgtgggatgcatggatgacaaaccggacgagctcgcgatcaatgaggactctctcgttcgctcgtgatcaatatggactcgttcgcgatctagcggtgggcctggacatggaacgcggacgtgcggtgatgagtcgggcggtgggctttgaatacttattggtattttttttaataattaagaatgattttgaaggtatgttttttcattctcatatctttgttaccacatattttatgggatgtgtttgaagggtaattcagaacatcccttggcattatttgttcttttactgatttttttctgttttgaattaacggttctctttattcaaatcatgcatccaacggttcatatttatttaatgacgtgactcattctggtggaatcttgggatccccttttcactaatgtagataatatcaaactatttacggaaccagactatatcattatatggagtatatgatagtacaaagtaatgtttgtccgttcgtgaaaaatattactgacgaaattatttagcagtgtattatacggtgtagattttgatcaattgtcgactttacttgatatttttcacactcgacactcggtcagttagggggtatcaattgatgaaacttcgtcaaccttgcctcttctatcttcttatccaatgacacacaaatctcccgcgacttctttaaaaaaaatcacaatgacatatcctctcgcatttctactaacttgcagtgatattttaatttcatccagtggttcatgcatgcattagcacggcaccggataatccattggttcacttggtcaagcactggactgatggctatatgtgtgtacaaatcggtagttcaactgtagctttagcgaatccgagtatgcaataaaactaactataagttgacttcgagactttagcccctctctcaaaaatataagtccctcccctagggacttatacttttgtaagagggattaaactttagtccctagtttccaaacaccccttagacgatatatctcagcatctctatctccaacataaaatgtactagtagtagcaaggatggaatgggtaccctactacaacattaatttctgagataaacgccgctctcaccgaaatttttgacccgttatagtgtgcaacctgtccatttttcgttcgatcaggtctctttattttacttcccaatgcgctgtttgaaattaatacgccaaaattttcatgctcctgcaagaatttttgagatactttataataattgactgtagctttgatgagcaaaggcaggaatgtttcattccattatcttaaaaaaaagaaattttgagatttttttcctaaatagaaccaacttatacctctatatagacacaagcacacagcgctgcctaaacactagtattcatgcatgcatccatgcatggttgtccattattactctcctggatagttggattgtcactgctcaacagtcaccattgcatgccatatctgatactgcaccagcgaaaagtttaaaccaatcagatagctaatagcttttagataactaagagcagtaaccacaagtttaatttgtcaaatgaagtggattgactaggacatttatgaagtattgcactcgagctcccgatcaatcgcgtgcagtagtgtctataaaatcggccccaaattaaaatttatatatgtaaccgaacacagaaaaacgttataggatattcaaacttgaagacaacaacgaaacatgatatttgttaaccggttcaaccaatatacatatccccataagctgactatagatgctccttttgtatcaggatttccatgaccatcgataggttaggtcactggtcggtcgtctctcgcctatgctatattattggcatgcggttaaaataacgcaaaaactatttcgagaggcctctcgatctggcgctatcgcgcgacgccaggaaaaccgtcccagccattccaccacgcatccacacgtcattgtcctcgtccattagcgtgcgagaaaaagaaagagagaaagaatgagagagacagacgtggcatgtttccttagacgtggcggaggtttcaaataaaattttctcttaaactactcatccgatctacgatccgattataccgttgtgttcgtaacaattaaatctttataacaagatctcacatgattatattttgatgaaaaaaaatataaattacttttataatatatctaaattacttttagatttcactgaattacttcttagacatataaaagtaaatttagtaactttaaaagtaatttacatatatattataaaagtaacttaatataaaaccgaagtaactttgtcacggcattagaagtaaattcgttgtagggataaaaatatgactctatatagaaattaaatttaatcagcatagattagcacatgtaagtttaacaatttttaaaagtaacttcaatgttaattggaagtaactttttcattgttcagaagtaactctctataaatcaatttaatcacctattgtttttttccttttatttttgtttttcatgtagaatgagaaaagaagataaaacctttgatggattataaataacattggtggaataactaatgagaattaattatgtataagatgtaatagttccttcatgataacatggaagttactttctaacatgtaataaattacttttaaattaataaaatgtttgaatatatgcaatatggatctcgttttgtcacatattttgagtggagtacaatgatgcaaatagatcttaaaaacaatatgtgatttaaaagatataagttattaaagagattaagaaaagatatatactattgcatttttcaagtaaaaggagacactgaatggagtgcctaccactaactgtgtagtcacgtcctatgaaaaaagatatgcattaaagttactttctttttgttataagttacttctataatatatgtaaattacttttaagctttattaaatttacttttatatgtctaagaagtaacttagtgaaatctaaaagtaatttagatatattataaaagtaatttataatttttcatcaaaatataatcatgtgagatctcgttagaaagatttaattattacgaacacaacggtgtaatcggatcgtagatcggatgagtagtttaagagaaaattttatttgaaatataggtggatagaatctctcataaatagagtggtatcaaactagctatcactagttgtgtagtcacgtccttaaaataagtgtattcctctatttaaaagagaacttacatcttcaagttgtaaactgtaattgacacaaatactggcattccaaatggaaccttgaagacttcgtaaccaacttgactgaattgtccaacatatatttggctagcctttcaaagtatcaaacgacgccaggcctcattgatttctcaaattataagaagaaactgatcaagaccaaatttgaaccatacagcaacgacgagaaacttaacaaagcggcatgcgcgcaggtgaggactttcttttagctaccagccagttcaatacgagtatcatctcatccaaaagttaaaaaaaaaattagtatatactccacccagtcaaatatatttgatgattgggatgaaataattttttttacacataaaaatacgcatctatggatgatgtaccatgcatcgtcccacatgtacaaattaaagaagaacatgtacatatacacacaagcatttaacttagctcatcaaatgaagagatgaatcatacgcaagcgaccggtttgtcgcaagccgaagacccgcatcatcgcgttgacgccgtgtgggaaaaagagagacttttgcgttgcgcgcggtggcgtggatgagtcgccactggcccatcggctacgacgtgtacgtactgctctgagctagctccagctagcgtcgccgtcgcagtcgtcgtcgcgcgcgcgacaccaacgacgaaaccccggcccaccgatcgatcgatcgtggtcgtcgtcatcctccgggccggccgccgcgccaccgctccaccggcggcggggcccgctgctcgcagctggctctctcgtgatcgacatgggcaatttgcgcgcgggtgacaccgtagtgcagctgcttgcgcgagcatacacgatcgagagagaccgcttagtcaacgggcgccgtgtcgtctcctgccgactttatctctctcgtcgccgtcgccgctcgccgcctagctggttggtccacgggctttccatcttgctacgctaagctttctactactttatacagcgacgacctaattaacagatcggtccatactctgatgtcgtcatgcatgagatgtatggagcatgtatatgttcggattcagtatttctgtattcttgcccgttcgcccaaattaaaggctactccggattaaccgtccactgttggtcacccaacactctcaagaagtgttcacgtttcatcactcacagtccaaaatgatcactctatcgactgtcttcagttgtgtatcgatatcaactccaaactacaatttactcgttttgtattaacacgttttctaaactgctaattgctaaacagtgtgttttgttaaaacttttctatattgaagttattttttatataaaaaaatcaaataaatccatccttcaaatttataatcgttaatactttattaatcattcactaataaaccatccagcattgcgtgttgttaatatggagatatttaactatttgccactcttacaagtggcaattaaggatttatcattggacccacatgtcatagatacaggagagtctatacgtcataaactgtgagtggcaaattcttaattgtcacatcttaaaagtggcaaaaagttaaatgccccgttaatatacgctactccctttgtcccaaaataagttcattaattatgtaatcaaaatttggctcggtaatttatatatgtttaataaaagaaacaagttacaagctgtatatatagctcgaagtgtattattcgttggtcttattgccaacagatgagaccaactggcaactttgtgctagacaagtagacagggatgacgactaaaatgtgactatctatttgccttgtcggcagcatcctcgagtttggttgacgttctggtgcaaaggaaaaaaatgaaccaatacacatctcaggttgaccagtagagagttgctggagctgacagttctggcatatggccggttacttgccttcacatgtcatttttctattggtggaaaggttgaagataccaacgcattttttaactttgaagaaaaaagtgataaatatagtttgaagaaattccccaccaaaaattttaaatggcataagcccataacctagctaacaaaggttaaggacttgaggtatccacatgtggaaccactttatctttttcactaaaaaaagcatttttgcaggcggccaaaagtagttttctcaagcggggggaaggaccgtctgtaggggtacaactgtgaaaatcctctagaaaatccccgcgcgtcgtcgtcgccaccccgcgctgtggcccgccccgcgcctcgcctcgccgccgccgctgccgccctcccctggcctccctccggccggatctaggatgggagccgccgccgccgccccctgtgtcgtcgtcgctgccccgcgccgtgtggccagccccgcacctcgcctcgccaccgccgttgctccccctccggtggggagggagggagggaggggagggggacgacgggtccggtggggagagatgtgttgagggagagagagagagagttgagagggaaatgagtggtggggagggggttggaggagaagataaggagctctagattttttttttggtagatacgatttttgcatgcggaccacataagtttcacctgcgaaaatagatttttgcaggcgccgcttaagtggtctgtctgcaaaaatcattttcgcatgcgccgcttaagtggtccgcctgcgaaaatatattttcgcaggcggacaacgaacttcaccccgatttatatttatgtaggcggtcatttggcttcaagggtcatgtccgcctgcgaaaaaaagacccccacattaggaaaaatgatttttctagtagtgtttattaattaggttgattttacaatccttacttcttatacttaatttattaatagacatctctacattaagcaggtaattagagtatacaaagttttcactaactggttgaatgcacgtacgtaattatggaattaaaaaagagagaaaatcacattatgtgatagagagggcgcctgagagaaaaaaaatcgttgatatgatgtataatcaattctcatatccggtaaatgaattatattgtgtctattgcgcatatcattacaatggattatcgttttgattatacataaattaaatattttaagaaataagcttattaaatagtttaaattaagagtaatgctccggtgcaatctacttgcagtattctactccaagtagaattaatcttgaccgtttattttgaagggcaggtaagtaatctcctaatatcgtttaggggtaattttggcatgggatgttttctttggttcgcatcgcattaggtccggactccatcacacgcagtcacctcgctattcctcccccggcctcgccgccttgtccgcccccaccgtcgccgtccgtatctcccaccgtcgccgccttgtccgcctcctcagtcgcattgtccatatgggagcggacgagtgtggcggcgtccgagcgaggatcttgagcaggagttctggcggtagtaaaaattccgacgtgggcttcggcggcggcggcgtcacgcacgcacgcaacgtcatttgcgtggcggcatcgtctcggctcattcgtcttcttgccgttccgatcactgcgttgtttcatggattatatggatcaattaagatcttgcacgaccaactccgacgaggatgacatggtgttcgatctatggattgtaaaatgataatacccctacgcgaattatttttcctagacgaaaacacccctccacatttctacttccactaattctggtgggagtagaactagatcttaaccctataattaaatatgattgagggtccagattactttctactccgagtagaaagcaccggagtgggactgttaaattaaatagtttaaaataaatgatctgagcaaatcagtataagaaaattccttcagaaatcatattttccaaactgtagagtaaataattcatttcaataatttgataaatagtctgcccatatgtcttatataggttaactaacttttgaaaattatgtgattcgcacaacattttctccctagtaaacgttgcacctatcaaatttgtgggagatggggatggggtggtggcaggccaccctgccaccatcttttggaaaggtaaaaataaaatagagatatgacaccatatttaaaaaaactaatatatttacactaaaaattatctacatttacactggttgcacaaaaacgtgactttatataaaagtctatcaaactttctacaaatacttctaaaccatcacgtggtatcctacatatgctcctaagccatcacatgacattttaataaatttaaaaaatcataaaaattatgataaaaagcaaaaacatctcatccttaattttcacttaaattgatgacatgttattttagggccaaactggatttatctcatcgaaagagaacaatcggggcctccaccgttacatacttacattagattgatctaattaattagagccttaagcggtcaagcccatctcacctcccccgtgcatgcgatgcacggtggaaaaaaaattctatggcacctccaacaattgcaggagatcgctgtcatggtggaaaaaaaaagtttctttgacgagctacattttatattgtatacaacacaacttcgactttatgaagatggatatgtcttgatttatactgtgctgtgctaaattattcgttgcctaaaacaaaccaacaattgatatatacttgagcatactcatagaacaggccatagatatatatatagtaccatacataaacaacaaacaacttggagcgaatttgttttccggcgagttcaagcaaactgattttacgtgtgcaccaccgggacatagggccgtgcgatgcatataaacggaggtttaattagaaggaaaaatatatagtatgaaccacatatattgcaaacctaaaaactatcacatggtataaaaataaaactttgagatttactcacgtcatcacgagtaaaacttttacttccagtgtacctatgccatcttatagcaatggacataataaactaccatgattatttaaatgcctaattctaccaaacaaagaagataaaatagggtagatgttgcaggcttctcattgaagattatgcacaacctgcatgagcacaccgtgcaaaccagctggcacacacatagatatatatcactaaaaattaattacatattgagagaaaaaaaaaacaaaattctaagacatttatactccgaagactattagaatttaaggtaatactctacacgtaagtgtaatactaaacgcctaatgcacgttagctaaaagaatgttacaaagagtgattgtttggagtatataaattcctaatgtttaatgaaaaactttaaagtaaaaatatttaaatcatgatggcaatcatgaaaagcccacactgcaataataattatgattgcagagttatttttatctataaaattatattcgtaggctatgtgaagtctcacgcactctgcacgaaacttccacaatccaaaatcgatttggactcaactagacttttttatttggaatatatatagtgtcactactcacatgcaccaaggcatccattaatcaacattaagaaaatgcagcatataggaaaaaaaatcagcaggtgcatctcagctgcacgatacaataataagttataaaagatctagccaattatgctacataacagaaagaactatcaatttctatcaattgttggcaaacaataatatgggcacaagtaccattactttcacgtagggatttctaaattattaattgtataaataattattttcatcatactactacacaaatggtttttgcgagtattcttttcacatgtggctcaaatgtgcagcctcgtatgtggcgagcctcttgcctcaaactcaagggacatatttgaaaataacttttgccatccttttacagataactattttagtggagtgcttaacccgcaatgtagcattgaagcttttacacataaaactattttattggagcacttaacccgtaagatagtattgaatcaatctactcttttcgttatagaaaaacatagctcattttatatcataataatattttattctttcaaaatttttgtatttctcttcataaaagtcatattaaacaatccaagagacaaaggtcaataacaaatcaatgaattcagtaaattgttatccttcaaagtagctccatgggttttaccacaacctgcatgtatgagcctctaaggtggcaattcaaaatcagtagtctttcttataataatatgattaaaagctatattttttcctaataaattgttattttaagattcatattgactaggtcttttctttaaaatatattagagtctcacatattacagagaagtgttatataagatatgtatatttgatcaattaaaaagattgctaagtaagtgttaacaaccaaatttggtagcatgtgtatcaggaaaggggatttgatcaaagaagagttggaggcggagatcgagttctggaacagagcaggaatcggctggagtcctgattggctatggctaggatcggctgagattgagttgaactagataagctgatatagccgatttcgacaatacgacccgtgtgcaacattgggttcgagttgatgtgcttcaagatgattgccacgcatagatagagtcctgagaaggcaattgtatctattaattaggatattttatgtaacttccttagagatatgtttgggcaaaagtctaccgcaaagacttgtgatattttagagtttgttagagataagagtcgtgtccaatatggacatatcttgtatttctcgggaataaatggaccccgagccctatgtaaaaaagattcaatacacacattcaatacaattccggcgcatcgccaccttttgctttagttttatttcgacgagttcttgctttcgggttgagctgcatcggttccgatcttcaacaagaggtaaaacttgtcgtgacgaattatgttcttagggattagtgcttccatcttcatgacactctaatctcgtttatataattcgccgagttatcatatatcttatataatctctagcaacatcgccatctaacccacaatcggctaacatctattaacagacggcaaccgattgggttagatgtcgacattgatctagattatataagatatctaccattctatgaatcttctagcggcttgattgtctagatataattcttcttttcatacttaatgctgtatcaattgagtttgatctattgagtcgtgcttagaatattgatctctagcctgccacccagttgtcgattagaatagcatcggagtttcagccgatcgtatctgatttaactataattatctctatttgcttcactgatatgttaaatctaccctttatgccaagatattgttgtatttgaatatattaggtttttgcttgatattctatat

SEQ ID NO: 67336 - DNA, 19881 bp, Oryza sativa
aggaacctagttttagccaagtctttaagacctctgctattccaaaaaattcctttcattgtaacccttttttctacccaacttgaaacctactctcccacgtatccttttaccacctttcctgcttttctttgggtatgatttgattaggatatcatcaatttcacaacttaggtgaaaatcctcatcatccatcacctcatccattgtatcaccacataaatggttaagcagatcactgtctacatattcctcctcctcatcattacaagaatcatttagtttttcaatagaaggagaaactttgtcacctaattcttccgatctaagaaattccgtctcttttaaaattaaaactgaatctgaaactaagttgctagaatctcctaggttcagtccaaagcatttaaattctcaacaatatgtgcttgcgaaaatgaaagaaatgaattcttagattcattacctgaaagaagatcgagattcatccaaaccttccttgatttcttcttttcaagggagtgcctcccgctgctgcccatcaacctctcactccctcttttcggggcaccaacacctcttctatgttagctagttgttcaaccttttcctgctgcatgactgctccatctatcttctcttcttccctctccaccctctcatactcctcccctagcactctctcaacagccacatccaacacattttcagccatctccaaaataacatcttctctcccttgatccccaccttcctgcacctcattttccttcctttccgagttttctttattgtcatcaatagccatatcatcattctttgttcttttagactccctctccttcccttcattattttctttgtattcctctccctctgaattaccatcctcctcatctccatcccaatcttccaaattaaactccacctcctccccattctcatcaacccctttcttttccacctcaaacttcaattcaaaataatggtcaccaatcaccacgtcaatcatttttgggatcaactttggattgagaaccgctacaaaaaacctcccaaactcatttttcctagtggttttcgtatcaactagctgcgttgcccccaaaagagagcccattgcccacagcgtcaagtactcccttaatttctttctcagcccaaaaacctttacccaaaccttaggcaaaagaaaaccttcctctttttcgaaccactcctcgaattctactcttaccccagtagccactcctccttcctttacatcagctctaccaaagttgatagcacgctgatttggaagtatattaaatgcggactaaaaataaaataatgagagaagtgtccgaacttttgcttatattaattaattggatgctcttctaggaacccatattaatcctacgaggtgaaaatagctacaagttaattgaaaattctttgaatccgtacgttgatcgaagaaaaataatataggttgaacatctaatctacactaaaaaaatacaactaacaaataagattggatccttagacctatactaatgcgacaatggagttcatagcatccaaaccataagcaacaacagcataataaaatataagaaaaccaatgataaagaattgttcatgacgatggacaatttttatttgaaacagattgaaactatctcgaatatacaataaaataagccaactttagtaggtgaaagaatgtcacaatagagataataagaaatgtcactaatagtctaaagataaagacggaggaagaaaacaaacaaatataccataatgtttttatatatgcacatataaagagttctctatggacataggaattaatatacttatctaaatattggtttgttccattattgtcgaaatataaattgtgtttccatttcaatatattttataatagaatgccaaagaacatatgctattatctgagaaaaaaatataatgatgctacccatgtaatagtatctatatgaaaattggtggttatcaaaggattttttaaaccatataaaaccgctatcacacccagttcaaaacataaaaattctcaacaatacggaggaaaacctgaccagtttcacagcgcttgagagaaaccggactcgaaggaaagtctcgatatatacagttcccaagtcagtatgcaactcaaccagtcaatgcctgttggtttctgccttgaaaatgtgcatgcctctcgttatatatctctatctcgtcttttgattcttttttataccatgttgtgaaaattgaaggtgctagggaaccttgctttcgataggtgaacgaattagatggacaaaaagccattagacgacaagacggaataatagccatgtcggtttaggtgtacggagctttcaggtaaacctcacagctttcttcttatgcaatacgcaaagagaataagagatggatatatacatctcgtgactttggctcaggattgtgcgtcaccgtcgaacttgcagcctctaatgttgaacttggttgacaatttgacattatccagcaagaaatgacctaattccgtttagcaagaagtgaccagatcaccatcgcaacactttgaatttattttaacggacggactaaaaaacccacgcttatataagaccctgaaaacttagccacactagtaaaaatcaatttttactagcagagcattaagaaaaccgtatgaaaaatacatctatttttacaagtagtgctcttaaaatatgtcgtatgtaagagaatcaatttttagcggcggggtcctaagggccccgcaaacaaaacttgtgggagagaataaaatagcatgtacatccccaccaaccaagccacggaaatcattttccccttgctcttttctttttttcctcggctatcaccaccaaccccggacctaacccctccctcaatcacttctctctctccctctctctctctctcgattcttcggcaagcggcggcggaaggaggtggcggtgccggtggtacgaggaggcagtggtgctcagttgtggcggcgcgggggaggggttggcccgcagcagcagccttggtgacgatggatcgtgcaaatctggcggcaaaggtggcacggtgaggcagtggtgcttggtggtggcggctgcgcgggggagtgggcggcttggcggcggccggcggcatgcttggcgatgacggatggtgcagatatggccctggcgagcctcgggagtggcgtttctaccgccgccggcctcgtctttcctcgtcaagtctgcggcgatggtgaggccattgacctagcaacgatgagctcgttcgtggcaggtagcggtaggggtgaaaacggtacggaaacggacagaaaccacctttatcgtttctgttttcatatttttttttcggaatcaaaatcggaatcggaaactccggatacgaaaacggaatcgaagattatcgaaaccgaaaacggagcgaaaaagaaccggtgcaaatatggtaataaaaatttatcggaataaaaaacccctcaaactgataaatccaattctcaagtcttaacggtcaataattcaccataaaatataatcatataagtccaatttttaagtctcaacagtacatcacaaaacacaatctatggaataaattatcttatgtttaaaagagtaatgctgttgataaatcccaatgcaggaaaaaatattcttatgtaacttcatatttgcataacaaatatttttaaagaaataacaaccaaacaccatggtattcactattcagtgcttaaaaaatcaagggtatttcagtctcaaaattttcggaaattccgagaaaattttcagaaagtttccgaccgattccgagttctgacagaaactgcccttatcattatcatttccgattccgtttccgagaaaatatttccgaatttgtttccgtttccaaaaaaaattccgaccgacagattccgttttcgaaaataggtccggaatccggaaagttttcgtaccgttttcacccctaggtagcgggcagatccaaggtcgagctctacggcagtggcgaggcctttgacccagtgacggcgacaacggcagatgtgctggtagaggaggctaattgggaaaaccatttattgtggaatttgtgctcattgatatatggatttgtattgtgatatgtttttgttcttagatttgctttgcaatgtggattgggaatacagggctactgcatctgaatattttcaattttttttcaaaacttctttgctggtggttagagagcaaatgcaatgcatattttcaattttttgaaccaaaataagcctcgcaggtggccggcttaatacatacgctagtgaaaattgattgtcactggcagcccacgtaacacgcacccgcaaaaatcgattattgtctgcggccacgtaacatagctaccatcgataatcaattgtcgctgatggttgaagagttgcttgtgaagaccttttattttctctggccttttgtcgcaggtggttagcctagtcgctagcaaaaattgattttagccgtcagaaaaaaaaccattttttaccgtgcacaaaaccttatttggaggagcccatggataaaattattttttactactgtacctcattttccacgcactactactaatactacgatttttttcagtcttgcagctcatgcaagggagcagaagcccaagaggccgaacaaaaccagcagcaaagacagcaacgcatcaaaccatttggcccaagtgtgacccgcatttcagcctctgacgcgtgatggtcagaaacgattgagataagttcactttaagtctctcgtcttaacaccgagtttgaattacatcatcgagccgtaataccaaatataaggtgtctctcaatttgtaaaacgatgtacctgaaatctcagacaatatagtgtccggttttagctaaagtgacgagtaggacccacgtggaccccacatgtcaaggctattcccaaaaaaatagaaaaaaaacaagtgaggcccacatgtaagcgagagaaaatggtgtgggccccacatctcttctttcttttctttttctcttctcttctctcagcgggcgtgcagtagcaggtgggggagaggcggccggcggtggagtggcaggcctgttcagctagcgtgagcatggacgtggccttgtcaggcacggtgagtagttgccacccggggacggtgagtagcgggcggtggcgcgggtggtgggctgccgcggtgaagttgatccaccgacgaggaggcacaacaccgagagcggcgatgtttggtcctcgtcggagtcaatggccggcaggcgcaacccgcgaggtttgtttcggtggcgacgaggcccgggaggcgaccgagagaggggattttcccattttggctcaatcatctcctctctcccgccgctgccgtccctagatttctagccccatacaggtgaatgggatggaatctaggcaccgttgctgatgttgttgctcctctactcgtggtgctcggtgacggcgtcaaggtacaacgggaaagggtgggactgggaggaggaggagtggcatccgaagaggggggaaagggcggttgtggcaaccatgtctgcaagccaagacccgcggagagagggttgttcgtgctggacgaggggcataaggtggtggagttgaagggtgtctagtagggtcgtgcctgtggtacgcggccgtgcccggcggtcgctgtcgtgccgacccgcggcaacgcgactggtagtggtcggcaacctttgggtgctgctgggagggactcgtgccccgtctcccgctgcctgtcgccagcaacctttgggtgctgctgcccgtcgcccgctgttcatcggccgtcgactcctctctccccctttcctcgtcgtcgtccctgcatgccgatcgggctgagggagtactccaggggaagcccttccaagttgcggcgacgacaatgtccgcgcggcgccggcggcactccaccaccggcacaccaagctatggtgggggcgggctcgaatgtggcggcggtgcgcgtggtcaaaacagctgtcgccggaagctagagtagtgggaggtagggcactactcccttcttttcttctcgcttacatgtgggcccgataaattttttaattttttttgactgactaggattcctcgttagcgaaactgcccatatatactgaatgagacctatttttcacaattttatataatttaggggtagagatttctgatattagatattagggaccttagacagactcgacgtaaagttgagttacgttaggcgaacttattcctttcctcatctctcgagtcctgggccacaatctgtgggaaggtctcagcgattaaggctcgtttggagcactggaaagatttgtgaatcctgacagaatcgaactgtctctaactattatcaaacttatgcaaaatcccaaaccaggcagtttttggtacacaaataatctgctcactatcatggcagctagcaaagtttgcttcctgtacttatacaatctttggtagctcgatcgccagaaaacaatcgccttaaacatcgatctgagaactggattgcgcaaaaacaacacttgagtgaaaaaaaaaagtcttcaactaactaaactaaggacctactatgtatatactgtatgaacacatgtatacagtacatgatattctgtacgtatacacgtgctaatcaaccgatcatgcagtagtgttcttggcttgctccagcagcttgacaacttcagccatggttggcctgttgcagggctcagactcgaggcacttgtctgccactttgaacaccagcttcacctcctccgccgggaacgacgactccagcgcgctgtcgaccgcgtgctcctccctcttctcctccatcgtctccttcacctgcacgtacacaccgattacccatgttggtatgttacaaacttaattaatcacgttattatcttgttttaatgattcgttgattaggcccaatagtagtacgtttgacagataattagtatacgcgtatttaattattcattgatcgtgcatgactttgtggtttgtagtacctggtgatgattggtcactgctaatgaatgatcagtctcagcaacaaaacactgtagatgatgtgtgtacgacatgaaatgaaatggatggaaagcttttaagttctgtttgacacggctctggatctaaaatcttttaaactgggtatttttaacttcacaaatatatgaattcgagtatgtgattacgttgataatatttagataaaatcattttgtttcattttaaatgaaatataagattttaaactttataacttaacaaacaaactttaaatctaacgcggatatagaatctggagctgtgtgatcttacccaggtcactagcctcgtgccgttctcaagaaacgactcgtccgtcggcctcatcccggtgaggagctccagcagcaccacgccgtagctgtacacgtcgcccttcgtcgtcgccctcccggtctcgaagtactctgggacgcacacaacatgttcgatcaaatgactgacagtggttcagagaagctggtgatgaggcgaggtgaggtgtggtggtcggacggagacggacctggggcgaggtagccgaaggtgccggcgacgacggtggtgacgtggctatggttgggcttcatgagcgtggcgaggccgaagtcggagaccctggcctccatgttgtggtcgaggaggatgttgctggacttgatgtcgcggtggatcacgtgcgggatgcagtcgtggtgcaggtacgcgagccccctcgccacccccgccgcgatcttgtgcctcgcctcccaccccagcgccctcctcgtctcctccttccctgcaaccacatcaagaactcaggatttccatggacaaaatcgccatagctgcttcgagttctgatgtgtatatgtaccgtggaggatggtgtcgaggctgccgttgggcatgagctcgtagatgaggaggttgaagtgcggggcggcgtagtagccgcagagcgggacgatgttgcggtgcttgatgtcgcccatggtgtccagctcgcgctcgaacccccggtccatctcggcgctgccgcggctcagcttcttcaccgcgaacgccgccttctcgccgacgcttagcctgtacaccgtgccgtacccgccggagccgatgatgtccttgttcgagagccccatgatcatggtcaggaacgacttggggctcagcgactgcatcgccgccgacctgaacatcaccatcttgccacctacagtacgtgatgatcaattgatcattcgcatcaacagagaagaattcagcaagaaaaacaagtcagaattaatctctgtttttttttaacctgtcaggctgttctcgatgatccgtttcttgcgagcccacttcttgtagagcaggaaggagatgagcatcttggacacgatgaacaggatagagcagattgtaatgtagagtgcaaccatggtagtatgcatcttgcaatcctgaagaaccaagcagcagctgcaactttgagcccttgatgactatatctatatgcaaaaaaaaactatattccccttgaagaattcagtgaaccctgaagtctgaacccaagaaatgaacaaaaaatcaagctctccaaaaagggcaacagagaacaacaacaaaagtcactgcatgaggctgtatgaacgagctgttctcagctcggaagcaacagagatgaatgaggaggccttcttcactgctgcatgggctcagctgctttggaatcagcaagttgtggcgatgtgatgtgaacatcatggagattggacacacatgtgagtgctgtagaagaagcacaggtgtctcgatgagcaagcagttgggcaggattgcatggaaaaagaaagtacattggccccaatcaatggggactggttggatcatgtgaatggcaggcagagtcatcgctcatgaacaccaccctttttattaatgggcgtgccaatcctaatttaattctgctactgtttatccaattccttttgttaatttcactgttgtttctttcatttttgtgtagtattttccatgaggttttacttttcagagaaggtagaattctactagtagtttcagaggtaacatcagaaaacaaccgcatagttactaacttactactgaatatccagattagagataatattagaaatttaggcatgaaactattttattccttggatctttttctgtctattgttagtcaaaacgttatcgaagcttgcgtgtactaattttggcggctgactctgaaactcgaacgttcacaatcacaaagccagcagttagatggaaaagcaatttctagtttggcagtgtcggtgaggtagggctcgattaatttgtcagtttgaagaaatttgtcctaagctgattcaattcgtcagtttgtgcaatggtgtacgagctaaaattgttgaaaaggctggccttgactagcttccaagaaaataggggtgttagctgccttttcccctgtgctgtgtggttgtaatcctggagctgcacaaggaccctgccgcctgtagtagtagcaacatctatcaaacttttgtttcaaatcacgtgatcaaactggggaagagctggcgaattctggacaataaggcaacgcgttgtatgcataattgcatgtatgtgtagtttttttttttttgaaaaaaatggttttctcacctaaaggggatagttatgataaattttaaaataaatttacgataaatgtactatatacctatattttttaataattatctatattgtattttagatgaaaatgtaggcgaagggacatcccctcgaggaagtaaaaacagtctccattttttgttctccactattgccatgcctatgcgttccaataagatctggatgaatatgcataggaatggttttatatataggttgggttttttttatctggtttatttggtggattgattttcacacgagaatattggttattgtaaagtgagttttttttacatgggaaagtgaaatggttagggtggggagaatggatgactccacttttaccataataaagataaagctaaggtgataattgtaaagtagattatttagtttaattctacatttctaagcactgattctgggtgtttcttaccaaactagcctaagtaaaatacatcaggaggatatcaatgaccatcgaccaactttgattatatcatgtttatttccagtggttgtgttatacaccaattaaatataataaaataaacttaatataatttttttgtgtggctttcataaaagtagtttattattacctccatctaaaaatataatgggtacatgtattttaatatttaactcttctaatatatgaccaacaattagtttaatataaactatacaccactgtctagctagccagaatttaagtttttctttggacaaaaggagtatttgaaaataatatcattgaattgagtttcgaatgtactttcctatgattatgttctacaaaggtgattttacagtgttcttaaagaggtatcaagggtatcacattctttctagtgtaaaatttagtatctcttgatatctccggtatttggaggtaaaaaattactaatattggagaactgatctttgttcggatggcaaaaatcacattagtcccggttcgaataggaatcgggactaaagaatatgttcagttctggtttataagcccaacgacactttatgatctttagtcccggttggtaaacacaccaactaaatatcatttttagtcctggtttaattgttgtcgagccgtgtcaagccaccaatgatctttgactaaagataaacactttagtccaggttgtttataccaaccggaagtaaagataaaaaaaatggaacgagatagccgagccgcatgggcttatctcctcgtcgtccttatcttcttcgcacggctgagacaaagaacccccgcttcgccctcctcctccccctcccctcgatctcttcatatggttgagactacggcgacggcgggcggcgggcgcgcgctcctcctccgcatccctctcgctcctaccttacccctcgccgccactccccctcctcctcctcctctccctggcggcgccacccgtttctctaatgccgtcttctcctcctccccccttccctccgtcctcgatgacgacggatgacggcgaccaccgtggccaagagtagcgaggaggtgcccccggcgagagggcttcctctgtatcttcacccgccgtttccacatggcccagagcgcaaaggagagggggccgggctagggtgcggaggcagggcggcgcacgacgataggtacattgtcttctctcctatactacgtctcatcttgtcagtcgtcacgttcttgttctcgatccgagtttttggttcgcaggattttgcatttttcttttcagttcggctcccgatgtggtgttcggtcggggtgcttcatcgatggaccgccacccgccgcttgccatctccccgtggaggctccgtccacgctcgctgctcgccgtttaggaatttggttgagatgagcggatccatgtttcttttcttccctagcggttgttcttgatgtgctagttttttcttgtataaatcctaaggaattacctaaggaatggttgattatattggttgttgtgcgatgcatcgatgcatatctttttaggtatttagggatggattgtttggtccgatacaagcagcaaaaaaaaaacaatgaaaaaaagaaataaaaagacctttagtttcggattgaatgttccggtttacaacccaggactaaagatgagtttctcagtagtgttaattacttgataaattaaaagtcaaaaactagttttatatatcacgctaattgtaaccatctcttatattttggaaaagaggaagtactatatttctcataggaatcttggaatatcccaagaattcactttacagacagggcgtttgcaccgcaaaatttcactagtataaagctttgatatatacgtgcatgtacatacagctgtcatatatagtatatatagctttagtacgcagttacacccactacttatatatactgatcaactgatatatatatatatatatatatatatatatatatatatatatatatatatatatagtgctcttgccactttgtggaaggctagctaggccccatggggttttaagccatatatctttgacctaactaagtgaccaatccaacaggagatcggcgacctaaaattgatggttataattaatcttggcaaaccatgcataggcacttataagccccggaattgttatacaggtcaggatatatatgttgtgctctagaagacccctgtgcccttcattgccgcaaaaaggttccagcgaaaaatttgaatggccatgatccaaaacgagggtctgaataatttgccatgcaatgcaaatgcaaggccgtcttttgtcacctgaaaacaagctagctaattccctccgtttcaccatgtaagactttctagcattgtccactgtatgtctatacgtatgtggacaatgctagaaagtcttatattataaaacagaggaagtagcttattagctgtacccaactctagccactacatcttgcaccgaacagacttctcaaaagaagatgatcatgatgattaaggagagcattaagctattaattatcacttacagtcgatcgatcgagccgtccatctcgcaactgtatggcgagcaggacgtacgagccggtacttttggtacgacctcctcgatcacatgtactaatcagtaatcattatccatctatcctcctgctcgccactacagtactatacgtacctaattagggggtttagcccctctctcctaaacaccccctaagctacctagcaaaacagcaatagcatatatatacaccttccggcgcaaaaaggatcagcttttatatacacgaatgtctagctagattcgtatataaagattaagtttattttaaacagatgaacgtatatatactctcagtatgtacgtaatctcaatctaatccgtacgtgtcttgtttgttgccgtggcaattggcaacacacaatcgatgctcagctcagctcgcagcagctgcaagcacacgttgcgatcagcaaatcacctgagaatgaccggtagagatcaacggccgtccagatcaggtgatcactagctgaattgcttgctcaggcatgcaggggctacctgggcctctcgtacgctaagcccctgcgtgcgtgtcagcttgtcattgtcatagttgggtaatgggtatatatgttttttcactttgcaggagaaattaaaccgagagtatattcgggcaaaaataatttctggtacgctcgagatcaaccgaaaccgccctgggggagccggacgaactcccagtcggcatcattccaattccagcatatgtgcaactgacgcccaaaatgaatcgttacatcgaccctatcacacccggtcggccgccaccatcttcccaagcaaatttacacccatatctctctctttggtaaatctatagctactgtactatatatacatgcacacacaagtgtatgttacaatgtagccatgtaggtgactaggtgtagagcctctgttcgtccgtgacaacttttacggtggtccctactggtcgtagtagaactggtgcggacaaccccatagcttttctatggttttgaactttgaggagctaggttgaagtagtagtactgaggctaccagctagcgggcgagaggggggcaggagaaggggtcgtcgtgggggagtaggtcgttggtgcggagcacggtgaataccatgagagcgagcgtgacggctacggagaggatggcgagcgcgagcatgagcacgctcgccgccacctccctcacctcctgcgcgtactccgccgccgccagcgccagaaccgttagcgggaatgagtacgcccaccacgccacactgaaccgccgcatcgccctcttaaacagtgtcggccgcgacacctgcatcatatccaagctattagttcatttattttgtttttaagttaaaataaaaataattaaccatgcttcatgacatgcattattgctttctaaagattcgtcttttttttcagctaaagagaattgtttatggcttaattgctaactaagcatgattagttggccgtgagtctggaggcactggcacgatacacacacatgcataaatatatattttagagaaagaggatgatcagcatacgtggcaccctagtggtatcctacagtcctacacgatcctagttggatcagttctttcccagccactaaaattaatgaaaacgaaaagcaaaaaggagatagatagatgcagagctaaaaagctgagggaaaaaagaacctctcagcgaaatggatggagcagaatttgatcatttcgagaaaatgcgcatcccccacttctcttcccccatcctttagttttctctcgcaatatctataaactctacctatatcatgcatctatataggacttctattttcattgtcaaatgcatcctaatttctaggggttaaaggaggaatctttgttgaaagttttggatcaatggagagcacatggtgctgtggttcttttagaaatgagaatttttatgatctttaagaatactagaaacaaatgcccgtgctttgcaacgggtaaatgttattttaatcttattattattattatacgatttagatatggtgaaattcactgtaagaatttacttatatttttttttagaaaatcataagctgtaattaggagtctgacttttgtctcaaattagattgcaagtttttttaaagaaatttcttatccgactccttttgtatttttaaaagcaaacaaaattaaaaaccgactcaaacaaagatgacgtaccaaaacaccgataaaaatattttcaattttttataatagtagagatagagatatgatactaaaattttacattatttaaaataagatacctctcgatattttttaaaatggtagagttaccctttagaaatggaatttatcttgagcgttggataaaaaatgggacggtttggatcggatgccatgctgactcatcacgttcatcctcggcgtttgcgtgcaaatgcaatataatggcgtaaacgcgaggcttttgctgtggagagctagcttaattaccagggaggcgaagaggaagagggagaggaagaagagcatcttgcagcaggtgtcgaaggaggccgagatggcgtcccaggcgagcgacgccatgctgggcgcggcgaagaagaggaagaacaccgggcggagcatcgccggcagcgagtcggagccgaggaaccgctggtacagcgtgacgaacagcacgaggtagtgcgcggcgcccacggcgaacatggcgacggcgccctcgtgccaccccatcctcgccgccgccctcgccgtcaccaggttcccgatcaccgtgatgtggctggccgggttggccaccatggacaggaacttcctcccccgggtgaaccactgcccgtacaccttgacgtcgagcgccaggatgggcagcgagaacgcccaccagagcgcgcggtaggggcgcgcgtcggggcggaggagcagcggcggcgccgcctgcagcagcagcagccaggagatccacggcgcgaagaggtagttcatggcaacgtggtgcctgaactcggcgcgcacggcggggaaccggaggaggcaccgcgcggcgtagagcgcgcacagcgccaccagggtgagcagcgccagcgaccagaggaggacgaacgccgccgacggcagcgaccgcaccacggggcccagcgcccgcgggtccgtcgacgcgtcgctcagcgtccgccacagcagcgcctgccccgacagcgccaggctgatccggaagtaccccgcgtggaaccgcgtcagcatgccaaacctcgccaccaccggcgccgccgccggtttcgtcgacgccacgccgccgtcgatggacgaggcggcgaagggtttaagcgaacgggacgaggtatccatggcgactcgactcgatcgatcgatcgatcaatgtcagtggagaatgtgttgcgtcgtgttaagcttttggaagtgagatgggtatttataggggggtacgtgacactgtgacggctagtgttgtgaagccagggtgcatgtgggtgaggcggtaaccgagggtggttgtttcctgcaggttttaattgattctggggttttttttctacttttttatttttttggggtagcaaataggttgatcagctagctgaaagatgaattatgctgtgatgtgaaagaagaatgcctatgcaatgtgggcaggttacttctgtggtagagactgggcttgtactttgggaaactattcttggcttatgtttcctctgatttgggagctagttagcccagttgctctgatttggctagtgttgtctacaatgtttgaacattaattcttcactatagaggttagtacctcgaggtatctgaattttacactaaattttttggtaccttcgtttcaaatcttacactagaaaatatgatacatctcaatactttttcaatgatgataaaatcaaccttctaaaatatattgcatatccattccctgccccccgtctctctcactctcaaaagtttttgtttcttgaaaattcactatataaaatttattactaacaattgaagtaaaaatatgtgtttagtttgatggatgtaatacctttatattcgtatttaaaaataatttatacgatattaattttgcaattgttaataatatattatgaactaaattaatggtcaatatatataatggtggagatcatataaaaagctagtgtaatacactttctatagcttaaacaattcactttcctctctcaaactattttgttggatcacttatcacataaatatttttttctcgttttccctcctgagctattaaaaactattcaattagcagcttaataccatttttcttctttttttctctttatacaattcgtaattcaatatgcaattgtttagccatagatgacaccattgtcaatgttttgaaatatttttaatctttttccgtaactgttcgctaaaattttaaaatctcaatgtttaaataaatatgtctcggtgtgtgcttccaatccatgcaaaattgcaaaccttggtaaaaagaatacttaataagagataataagttgtaatgcacctaacaaccctactaaattttagtgcgaggcatatataggacagagagaaataacgagagtaaactaaaccctttaatagtttaggggaataaatgagcaaaagaaaatagcttaagggttaagtgatccggtaaaatagtttgaatgagtaaaatagaattttttttcctatttttagaaaggagttagcactatactacatactaagcgttatttccaccagttagcaaatggatgaaattaacaccactggtaccgctacgtgctcgttaagaaactgtagccaattaaacaagaaaacatcacatcgtcgtacagctactactctcttctatagatataaaggattttggacggatgagatatcccttatgttctgggaaactgtagccaattaaacaagaaaagatcacatcgtcgtacagctactactcccttctatagatataaaggattttggacggatgagatatcccttatgttctgggacagagggaatagtagttaattaatctatccacacttctccatcggacagattaaaattgctactaggtacaactcactctcaagcctcccccaaaaaggtgatctctgtgctgatcgatcagaaaatccaccgattagtacataacctaattattaacaaggtcgaatcacgccgtgtatatatataccggaaattttatccatgatcagcgcttgcagcaacagcacggcgcacctcgactccagagtcgtcgtcggagtcatcgtcgccggccggtcgccggcgactttcttttaatttgcctgatatcgcggagacacaaccgatggaaaactaaagcacgcagcaaaatatgcaggtgcaggcaagctagctagcatgtccactttggcgtcgcattgtggcctctgcaattctgcatgtacacggagtgtgacagacagagatgaggttttgatcacttgcagatatgagatatactatcctatctctccaaatccaatggcaactacttcaccggcagtggaattggaccaaaaaaacggttagcacgtcctatgattgtgtgctagtaatgatcgagtctctgattcatcacttgtcaaatttgggcattcagtgaggattgaccgtgctgataagcattcaggcaagtggtgactggtgtgttgaaaagcttgcatataatgcacaggatgtatatgcagcagattcaggaagtcatgagaaatataagaaaaaaatggtaataattgcttggtgtcaaaatagagattttcttacattaatgaactatttgaaaatgtgcatttgtttttatttctagagagggcctgaatggtgaatctgcatagcaatatatatatatatatatatatatatatatatatatatatatatatatatatatatatatatatatataatgtggattaggagattctaagaagatttctggtgatgagttagtgcacacgtcatatatacggctcgatcacgacctgagtagagtgaccaaacaaacagcacttgatgggataattaggtagtaaaaacttaaacgcgcagttggcgatatatattatcaaaccgtcctatccgtgccgaatatatgtatattcagcaaacaggcttatcagaaaacgatgtttggctagcttcagtcagactgaagagctagctagccagcaggataacctatctgcagttctgcactttgcaatttgcatgcgcatatatatatataattaatctgcagagatgaggaagctaatggtggggatgtgagtggatccagctggttgtaaaatctgtacacaacaaagttactcgccgccatctgaaattctgaattgcttctttggttcaacgcatttggaggaagaaaagggtagtttccttgcacgataaaattgccatgaaacaagcaaaaagcgatcggaatacctgaatcatggtggcgattttgacctgaaaggagacggggacgtacgcagttacacattgcttcaagttgcgaaaaatgtgtagagtcgccctgccgtttttttgacaaattgacccttttcaaaaacttaattcgaaactaacccctgtcaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggat

SEQ ID NO: 67337 - DNA, 699 bp, Oryza sativa
cttaccgatgcagccaactagctccttaactatcctttcatctttccccattgttcgtgacaccagactccaatgaagaatttacagatgagggttaggattttaggataggggaaagagggcagattccttacgctttgagggatttccagggaggcggcagactagcactgcgtgacggacaaggacaggcggcgaggccagatgaagctagagggggatggttgatggggttagcggcagggcattatatctagagtggttaggaggcaagggcatctcgatggcgcaagccaccggagatggagaagacaggcaggatgaaagctagctctcgctgcccaactgagaaagaggaggaggaggagaggggagaaggaggtggaggagactagtggtaggtctcaccagcagtagtgtggctgggagggtaacacgctagctcaggcataggagacatatgttcgagtggtgcgcatgtgaaagataggaagaggaagagagataagataatgtgggtagggtaccacagttgcacaaatcttaatgtggtctggatcgtctaaaagctactaaatttatgggtattatcatgtgactaaaagctatacaatccctcataaataacgtacgtcaagcaaatacctactacatccctcataaataacgtacgtcaagcaaatacctactacatccatt

SEQ ID NO: 67338 - DNA, 687 bp, Oryza sativa
ataccatgcatgaaccctacaaacatatgcaagatagtgaagcctagcaccaaacaataaccactatacgtgaccgttcgtcgctaagcggagactcccaaaagaaaggcttggttcagtctgtcgaatatatggattacaataagcataacttgaaatgttgatgatatgctagctgcagcgcatacccatggtggcaatggtgcaagaagtactaataatgaactagccctttttttcacacgaagaataattcaccaatctttatttattcgcatgcagagttaatttacagcacgaaccgtgctaccaaagaccaacaaggcttactgcacacagtcaccgtcatttattccactaccataatatatacacatgacatgtcactcttttaacagagctcgatcagacactgcagcctgcaaccacctccaatgagatggacagtgaaagcactcctcatgcgtctgagcctgcaacggagggtgggaagacccctctcccgggctggcgatcagcaaccgatccgtgccgagttagcaactacatgcagcgaaacatcacatccattatattagcatttttttagaaaaaatattattttaataaaaacttgtaaaaccacaaatttagcaccatgtcgaacacatgacacatggtgtaaggtagggttgttgtgcagtaaaa

SEQ ID NO: 67339 - DNA, 29325 bp, Oryza sativa
agcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaaggacgagcatgtagattgctaagctgacgcgtggtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaaagagagaaatggtgcatgtggtatccccttaagatataaaaggaggaccttgcccactgagaaggggactggacttttcgagattagaaacccagaacaagggagaggctggctcatactttgtagctccttcatacacagatctcccacaaaacacaggagtagggtattacgcttctcagcggcccgaacctgtatacatcgcccgtgtcatgtgtgtttcctgtctcgcgagccttccacatacagagagcttagaatctctccctgagtccccggccgaaccggcaaaggggggcctgcgcggtctcccggtgaggagccccacgctccgtcagatatcttgacatagagtagtatcggagtattagccgatacatgctagatctatcttatcggctatgctataaacacatataatcctgttattaatatatatttcgatctaagtgatttatactgtctcggcatggcgaccgatctatcccaatcacttgatttaattatatatcgatataagaactatatatcgttaatatgtacagccgatcgaatagatttagttccttattgtttatttataaccgccgatcgattcttatatgacatcggctcaaagataaatgatatgtcatcggcacctagccgatcggttatgatttatagatttaaccacgatctctttgtctctatttcttgttgattgcaggatcaaatcaactggcacgctaacacactcgaaggcgagctttggacctgcactggagttaagcagatataggcctcgtgttttacgtcaacactggtattgcggtttaaggatatgaatcaaattcggtcactggttaagggacttaaagtggacttattccagcgtacgtgcgtgccgaccggaacgcgagtgtcgctacgtttgggccccgttttgctacttgtgctgttgttcatgggccggaacgcgattgttcggctattgggcttggcgtttgaggcggggcgcacgcgcgatcgcgacgtgccggccggggacgtttaccgcatcggctgaacgagtgaacgtgtgcgtgtggtgccgctgcttttcccagcaacctatacaagtcacccaggtttccgtttctgacttccggttcgtagcttgcaataccacaaaaggattacgttgggtagatctggtgactcagctttatgtgatgcaatcgtgatttgatatgtcccagtataataagtttatccttggctcattatccgcctttttacacgaaagtgactacaagaaaacgcaacggtaggtgctcacctgctgaaaattagtgccaaaaaacgtcagcatcccacgagaccgttggttatctagatcgtgtgcgtcctgaatttggacggtacccactccatgcatatcccttcaggggttaggccgttctctactagtactacagtcttgtagctttggagaattggagcacaacccttggtacatatgtacagctagcgtacatgtactgtgacatgttattactactggagtatacatatatctgccgcctcactgtacagtacggaagcgaggcggcagtggacccgggcggcacacatgcagacgtcctacctcacggaagatatccggcgaagaaaggcatcatataggagtaccagccatcataccatcgatggtccatggttatataggacgccggcgagatcacgttgttttgccgggatatgtatagtatagggtccggatctgtccgagccgggtcgctgtcttccgtgttccctctccagcgttagagcatccacaatgtacatgaaaaccagtacatagaaaataaaaaattccattcagctaccttaacacattgtacaactagtctatagcaaagaaataatgaaagttgtccatagcattatgggtagtccatagacaataaaaaattatagttatgccaggtgcatgcgtgctgcagcctgcaacttctgttccggctaatttttttttgcctttagtgtgacccaccttaattacacacattgtggtgatttctaaaactatggactcctaggtgtgggtcccacatctatgaactagtttgccaaatacattgatgttgctcttcgtgcatgaacgcagatgacgcggcacgagatggatgattccatgggcctcgctcggtggctagctaagttcacgtgacacggcgcaacgagaaacggccgtgttttcctttttttttttggaccatctaaagtaacttgcgcaagaaaatcggtacctaaatcttacgaattctcaattgttggactaacgaacgaattaaagaccggccaatgtagactcacagctcatccaatcgggcagtgctgatggtcggctgacctcgtgcagttgccaaccccttaaatccttccgtgtgtgtatacataagatcttttttttcctaatttcttgtccaatgttagttagtaaattttcttttactgcctaacaatcagttgatagactacctcccccttgcaatttttggaccatttgttcactttgagattcataaaagtatcatcattattcccttctctccatttccatcgctcacttgctctagcctactctctccgtcccataaaaaactaacataactatacgtgacacattttaatactacgaatctagacatacatctgtccagattcattgtcctagaatatatcacatctagtcatagattcgtttttttcggacggagggagtatgccattgctaactccaagttcttgcccgcccccgtatgccacacttcccccctcctagcctcgcagatgccaaaagacactaaggttgtgttcgttttaggaggatgggaactaatccatcctgcacagaaaacggaatagtcaattagcacgtgattaattaagtattagccattttttttaaaaaagtatcaatataattttttaagcaactttcttatagaaactttttttgcaaaaaaacacaccgtttagcagtttgaaaatcgtgcgcgcggaaaacaagaggggggagttgggaacccctggaaatgaacgcagtctaagggcccctttgaatgaaaggatttatgtaggaatttcatagtattcaaatcctataggaaattttcctatttggccctttgattcaaaggattgaagctttccaaatcctatgaaattcctatggaatggcacattgcatgtggattttggaggaaatttagcaagagctccaacctcttggaaaatttcctttgagtctatctctctcatccgattcctgcgttttttctgcgctccaatcaaatgaccattcctgtgtttttcatgtggtttgcaatcctttgttttacacttcaattcctgtcagaatcctatatttttcctattcctctgttttttctaccctatgatttaaaggggccctaaaggtgctagtgagactcattagaccaaactgatcctccccttaccatactcccttcggtccttctccttcccaagctgggtagtgataaggtgttccattccaccatctagcttgtctttggcgggacaccaacactaacacagactcctaacgggttagaatcccacaccctgtttgctacaccggcccatcattcgcatccgatctcatagcctcgacaaagtagtagccgttccgtcatctcccaagggcatttaagcatagtgaacatcctcccactccctgccctcagcctatcttcatgccgatgtctaaacccaaactcgttagatcaccgccagtggcggagacagcgtgggggcagggggtctcaagcccccactaccccctaacgaaccattagagcccacataataccccctacaattttaatcccaaagggggtctaaaataaactttgttctgagattttagaaggcccaacaggctgggaaggcccaaaatatcccacaaccctacccaaccggccaaccctaatcttttttccccagccgaagagaggcggagactagtggcggcggcggcacacgagtgcactcggcgcgcgatggcttccagctccaagcgccggtgaggcggacgggggccggcgatgggacccgacgcgcggagggggcgcgccggcactgcagcagccagggcacgcggctcaccggccactggccgctggggcatgggggcgccgggcggcagcaaggcagccaggcagggcgcggcgcgcgggcggtctggcggggggacccggcggcgcgccgacacagcagcagccaaagaggcaacaaggcaagcaggcagcagcgccgggcagcaacaaggcaagcgggcaagccggacagcaccaaccaggcaaccaccaaggcagcaaggcaagcaacagcgccaagaggcaaggcaacaactcaacaattgaggatttgagcaagtgaggtatataaaatttctgatttgtcatttaaaatcaatttcaattgtcatgtctagttgttattgatagttcaagtcttcaaaaaatcatagattgtgattcctagtttgctactttgttatattgctagattgtgaagatggctaaatgactcgatgatatgctatactgagatagtgagaagcaaatttttaaaagtattagtaatgaaaaaattatccaaaggtttgaagatatgaaagcaagtcggatgttactactccatgcctccattccctactttaaattatttgaagctattgtttgttaattgtcattattcattaatttgacatttcttttgtatagattacccctgatgaagaataattggcgatagggtgtgctagtgtcgcacatcgtgtcatcatctattggatatttcaagattgttttggtatggataatacttatttctcgttaattctatatatttacactttgtattagatatatagtcaatttacataagacatgtctcgatttttgtcggccaattttagttcagcccccactataatgtaattctggctccaccactgatcaccgttgactgcctaagatcgttggatcttgctgtagctagaggaggaggacgggtatgaattgccgagcagatcctaagatcaaaatttgtaagattttgctcataatttcccgtccaatgcgatttagcaatttttcctttttttttattttaactgcgtgccatgtgatacgagaggcgagctagcgtacacgtcggggcagccgttgattgaacgatgttttccacgcgtgaacctgccgggtctcgcagcaacggtgtgtatagcaatcacgtccgcgacggggtttgcacgtatggagcgtcgcgtcgcgtgcacgcgaagcgatggagagcgtacgcacatacacaccgtgggctgtggagtcatctcagtccgtggttggcggccgtttcatctggtcttgtatctgtttagacagccgccgtcgttgtcgccaaagcttaatcatggtgtggtactgcgagtgtgagtgtgcgtgcgatgcatcgcatcatgtgaggagaagcatgctcccggttaaattattgtcatcacttctctgcagcatcatttgttccccactagtactgcacacagtacattagccagtggagtactccatttatttggttgcgttcatttcagcgcaaaatttagattttggttaaaattgaagatgatgtgactgaaaagttatgtgtatatgacaagttgatgtgataaaaaataactgaagtttgaatccaaactttagatcctttcttattataagtcgtttgatatttttttagttaagtttaactaagtttataaagaaatatattactagttttaacataaaacaaatatattattattttgatattcaatgttagattttataaaattagtttgttattttagatgttgataaatttttttataaatttgattaaacttgattaagaaaaaaagttaccatcgtagctagcaccatctaaagttaccatcgtagctaatactccgtactatcgtcgttgtattaatagctatagcaccaacaactttcattaagtaccgtgcggtagctgatatgccacctctctgcttgattgctctgatacgcaccttagatagtcatgtcccaccgaagctaatgcatgcagtgttcttttcatataattgatgggccaaactgatgttcttaatgttaaggatgaataaatatccatctatcctgatattactacaaatctgaacaaatctgaccagttacattctgtgatataagagtattgtatattataataaactgaataaatagcttataatatattttaaaaaattgtttgtcggtgacatgggaccgggggtatcgtgactagaggcttgggcagccgcggtcacccacgtggccggaccccctcgggggggtcgggcccgagggtgacgtggccacccctccctctgtctccccgaggggtcgggccgctcccgtttcggcctcgagggctggggcgccccgacccctgtggtattggcgccacgtgtgtgggttaggtgagcacagtggcgctcacctaaccgcatttattgcgggttggacgagcgcgccacgccgcatttaatacggcgcagcgtgcgctcgtccggtccgtgaccggtcgcagtgtgtgaccggtcatagaccggtcagatcgcgggttaggtggcaacaggcggcctgtcacacgcctcgccccgtcccgtcggaatgatgagagcctccaggcactcgtccctagccggagccgacgtgctaactcctggaattagcacgtcagtcccggccagattcataccaggcttcatcgcaaccatggcaaggaagtcattgtatgaagaagggcagacgtgcagcatgctaaactgacacgtggtggacaagaatgaccggtttgtgactggtctgacgccggtcatgtcatcggcagacaaccgtgctcccacgttgcatctgcttccggcggagtggaggtaggtatgacccatcccatcggagggtcattcggatagcggccattgcaaatctcaacccattaatgaaggaatgacagggatatcccctgtgccaggcgaaggcgcgagccaagttttggtcaagatagggtgggtccccacccaaaagaagagtaggtagacgtggtgcatgtggtatccccttgagatataaaaggtggatcttgcccaccaaagaaagggaaaaaaagaaaaaaaagggggggacgactctgggaatacctgagctcgtagaggaaagaaagaggaagaagggttctagagcctgaactctcttgctctccagctctctgtaactccttcacacacagatccaccagaacacaggagtagagtattacgcttctcagcggcccgaacctgtctacatcgcccgtgtcttgtgcatttgctctctcgcgaacattccacagatcgagggtgaagaacctcacttagcgcccccggccgaaccggcaaagggggggcctgcgcggtctcccggggaggagccccacgctccgtcattgttgaagagagaaaataatccgatagacaatctaaaaagaaaagagcttaacttataggtttttttgagaacttagggcaacatcaatgcttaaggtcttgatagaaataaggtagatcccactatactctatgtctatggccacaatgttgaaggcaagaataggtgttaagatggatcccacatctatgtaaacaaattctactttaaagtaggtctcaccatacaataatctattctcatcctctttagcatgcatctgtgctttatctttttattttattttttaaggttgagccataagcttatggctatttttagcatttaatgtcttatggctagtgcatataatgtatatgactagtcataagctcttatggctcattcttatggcacattgtagatgctcttatactagttttccattgtgtacctcaaggtggcaaaggcttgggtatttgatgacgagaatatcgacagatcctggagtacacattgggcaaccacaatgtggttctgttcagtacagcatgtgcaagtttgaatggcaagagttgagctgagctgagcatgtacttgctctgggccctcggattgaccggcgacacaagacgatcttcggatcgtcaaaaaaacgtacggattgggaagttcatgcaaatctcttgctaaaatacggaagcaaaaatgtttcgaagttcggtaaagcatgaagcctgaagttaaattactaagagcaagtttaatagtatagcccactactaacttcaattcatctataaccaatctaatagccaattcatacaatagttgcttactatactattaatatacggtcccacctgtcatacacacattgcgtcttagagtccgtgctgcaactagctatagatttgtagcccgctgttcttctctcttaacttttatctcattaaaatatatttgtagccggctaataatctgctagtattgtacctgctataaggattacatgtaataggagatatatactgcttccgattttaaaaatatgatgctactaactgccttgtaaacgtgacatgatgtttggtcattttgtcctagtaagaaaaactatattagttttatttattttattctgacttgttttattttaattgtgattttatttcttatatttgcactagacgaatttttaaatgccatatctaaaagtaaatagcattattatatatttagaaacaaagggagatatagcctatatcctagatccgcatcaaacatttggtatatcacgttggatctagaatatagagttgtgctaaacaacacctaaataaagcaatacatctgctgccgctgatgaaacctgctcgtggagcacgagataggagaaacatttggtactacaaaacataaggggatttttaatattccctccgtactcgtaaagaaagtcgtttaggacagctacacggtctacaaaacacaattttgactatttgtttctataaaaatatttattgaaaagtgatatatgtatatttttatgaaagtatttttcaagacaaatctattcatataatttttccatcttaaaactcaacaaattaagaattattcatgatttatattcccaaggtttgacttaaacattgtcctaaacgacttcctttatgagtacggagggagtattttcttttctaagataaacatttcattgtggacaaacgtgagagcacacgcaatagcaacatagcatgtcctgaataaagtgaccactaaattcaataaatatggtatacatcaatgcattatcttggtcctggtatccttcaatcatgttccttcacgagatcctccttttgatctgcttttgtcattgttgcttgcatgcccatagatttttttttcttaagatagtataaggattaactcgttaattagttcccgcatatcaaagagatacgcaaccaaagtcgagtttacagggaaatttcaaagcaaagacaaaccttcaataaaatgcataataaaaggacatggctacatcaatcacccgtcactaacttaatttgttccttgtacgtgatccaaactttgttccattagccaagcgtacattaactccaatacttctactactaataactactactgtcatgtgtgtgtcagatttatgctcttaagaaaagatttcagattattttttcttcaccggaacccttacgtacataagtacattgtatacgtatatgtatggtctgtatcagtatcactgcccacgtcttcttttctactaaaatgatagttgccaagtcttcgaatgatccttttaacagatggatcattttcaacgatataatcatactataagaggagggagaagatgttactccaaggacatcatttcttttttgtttttgttttaggaaatatcaaggacatcatcttgtataaattaagttgaaaaacataagaaaagaacacaattaatcttaatccacgcggtttacagattgttgagagagtctacatcaacaattgctcacgacttactcccttcgtcctaaaaaaaaaagacaaactctggtttctgtgtccaacatttgaccgttcgtcttatttgaaaaaattatgaaaaaaaattaaaaagacaagtcacgcataaaatattaatcatgttttatcatctaacaataatgaaaatacgaattataaaaaattttatataagacggacagttaaagttggacacggaaacccagagtttctctttttttttttgacggagggagtaattatgaactactcacagtttgcacctgcatcctgttgctagtttcctctgggcatgcatttgcgtgaaaagcactcgtttacgttaaaaaggatgcatgccaatttactctctagcttcattgcttttgatttgtagcatctctttgttcttagattttattttttttagataaagcttattttcttagattttagcatctctttgttccaagcttttgaagtgagggtgtgtttagttaatgccaaaattagaagtttgatttaaattagaatgatgtgacgaaaaaattaaaagtttatgtgtgtagaaaagtttcgatgtgataaaaaagttggcaactaaaccaggtctaaatgaagtttgggaatacattgattgcgtcccggtttcgcagcctgaaaacaggttttgtcacggaagagattgaaaactactcttcctactccagaacagaacaaaagtatggaatcaactgcatctcgtgaagcgagcaaaaagaaatccagatgcaatgaccaacaagcatagagatctgcatcaccaggagtaataaacgtctcgatgggattgagttgagctagccgttggctttctcgtgggaaaaagcgtcgttgaaacagaaaagaaaaaggaaaaaaaccaggcaatctcacgttccaagtacctaacccccccaaccccggcgccacctccagagcgttctcggccgtcggatcgactcgaacgttgggatttattgctaatctaatgccagggtggtctgcgcctgcgcgcttttcctgcccggctgccactcatcatccgtgtccgtttcttcgtctcatgatcagttcgtgttcgtgcttctgccgcgctataaaaatcactgcgtcgattgggcggttcacccatctcatcatcaccccatacctagccgtttggcccgtttcatcctcctcttcttcttcctcctgccatttcttggcatattgcgagttcttggctgccattttctgggcagtggatcggaggaggagattggggattgggcaagaattatcctggtattgtggatataagatttgcagaggaacagtgggtgggtttgtgctttcgtggtggtgggtgagtgaggcgtcgctttccggcgaggttcgtacgtgtggagtctcgcggccgcgcccgtcgccgtcagtcctcgccacgcaaccgcgccgtcgcttctaaactccggtaagtaatcgcctcatcggcaaggcaccgtcaccaccgcgctcgacgggtggtttttatactcttctccctctctttctttggtggtagatgtagctaggtctcctctctgccgccattgccggcctcgtgttcgtccgttccctcacgctctgtctctgtctctgcatcgtcctcctcctcccatggagatcaagaagctgcagcagagagtgagtttttttgcgtcatttgtgtgcttgcttgattgacggcatggcacggttttcacagtttcacatttgctctggtcgccgtcgtcgtcttcctcgagtaaactgtagtaaactcttgtagagggagggttcacgtgagttcggtaactcacgcgcagctttttttgctctttctctcgctttctgtctcatgccgttgttttcgccgtggcggaagccaacaattccgccgcactgtcgagaggaggaagaagatgatatttttcggcgggaggattggaccgcattgtggcggccttcatgaggccatgcctctccatagcccttgctgctccaaccactcctcgatccttatctcatttcctggctttattatataaagaagccatcgccgggagacggagtacaagagagcaggaagcacgcctcttcttcttcttctccatcttctcacccaccatagccaccttcttccttcctgcaactcggctttctggtaagaccaagagaccatccttccacccatggaggtttctttctccctaatagtagtaattagtaaataaactacagtagtaacgcacacgcacacgcggtgaacactgcactgcttggcgtttactgcgtgtcagggctcgccgtctatctagccgttgctcatgcatacagtgagctttaggaaggcaaaaatggtggctttgggtttggggtttgggtgtggggcgagagattccagtcggttgcaacaaacgcattgaatttgcttgccttttctctcatgggaattgtgcagtgcaagaacagagaaatgcagctgtgctgaactgctgctgatataagcttggctccttcctcttcttgcaaaggctccacaatttgcagcagtgcaaattcgcaactgcaagaggagcactctgcttctgcttctggtgatttgtttgccttcatggatggcatagcttatttctgttttgcttggttattcataccaaacttcagtttttgtgttagtttgcaaagtaaaattttagttcttgttactgtttgagaatttagacaccttgccaaatgtttttggtactatttttttcaagtacaaaagcacagcaactctacagtagagtggccagttaatctctttgttaggagtaaatcattctgttaaaatgtccattagagaatgctaataaactattgttaacatctgctagagatctgcaatgacagtggaaaaacagtgtctttttctttcacagttgcgaataaattaaaaatagctctgatgattttgacccagtagtttgttaggacgtcatggtttcctcttgccgcgtttcctctctgcattcttggctcctctcgccgttgaccgaccgcccgcaatggccggcaacggcggcggcggcggcggccggagacactgctccggcgttctcgagtcgctggagggttgcttcacggggtttctcatcgtgctcctggaatggcacgcgcaggtccggaggcggctgctcccgctccttcgccggcagaggatggcggtgctcgcggcgccggtggtcgccgccgtgctgctgctcacctgggcggcgtacggcgaggcccaatacgtgctgtacaaggacgccaccaagccggtggaggcgcgcgtcaccgacctcctggcgcggatgacgctcgcggagaagatcggccagatgacgcagatcgagcggcaggtcgcgtcgccgcaggtcctcaaggactacttcatcggtgagcattgttcttcttcagagacacagccgtcggccatggcggcggcggcggcggcgagctgaggtgtttgttttgcgggtggcgtggcagggagcttgcttagcggcggcgggagcgtgccgaggaagcaggcgacggcggcggagtgggtgagcatggtgagcgacttccagaaggggtcgctctcgacgcggctcggcatcccgatgatctacggcatcgacgccgtgcacggacacaacaacgtctacggcgccaccatcttcccccacaacgtcgcgctcggcgccacaaggcaagcagctctcctctccccaagatttgcaaagctgcttccatttttcactaaccgagagatccggttttgtttgatgtttttgagcagggatccgaacctggtgaagaggatcggcgccgcgacggcgctggaggtgagggcgaccggcatccagtacgcgttcgcgccgtgcatcgcggtaggtcaccaccagccacagtgctagctttgcttcaactctcattggcgatggatcgggggatctcatggcgttgacgttgatcaaacaacaacaggtgtgcagggatccgaggtgggggaggtgctacgagagctacagcgaggaccaccgcatcgtgcaagccatgacggagctcatccccggcctgcagggcgacgtcccggccaacttcaccagcggcatgccctacgtcgccggaaagtaagtcctattcaagaacacctcgtgacacacagtgccactcaagtgtctctttgtgtgttcgtccgcctgatgaacgctgggtgttcgacgaaatgccaggaacaacgtggcggcgtgcgccaagcacttcgtgggcgacggcggcacgcagaatggtgtcaacgaggacaacaccatcatcgaccgccgagggctgatgaccatccacatgccggcgtacctcaacgcgctccagaagggcgtctccaccgtcatgatctcctactcgagctggaacggcatcaagatgcacgccaaccacgacctcgtcacccgctacctcaaggacaggctcaatttcaaggtgagacatcaacccaaaccacttgtttcagattctcattgatgtgataatgtagtttttcagatgttcatcatcttgagttttgtttgtgtttgtgttgctttcagggcttcacaatctcggattgggagggaattgacaggatcacaacaccagcaggttcaaactactcctactctgtccaggctggagttcttgccggcattgacatggtgagaacacaaactttcttgtcactcttagtacaagtgtgcttgctgttttagattcaagcgtatttgatttcaagatgattaattaattgtgatgttacttgtagatcatggtgccgaacaactaccagtcgttcatcagcatcctgaccagccatgtcaacaacggcatcattccgatgagcagaatcgacgacgcagtgactaggattctgcgcgtcaagttcaccatgggactcttcgagaaccccatgcccgattcgagcatggctgatcagctggggaagaaggtaactagtgacacaatctgatgcaatcaaatcataatgttgcttcaatttatttcaggagattattgacggtgaattgtgaatttgtgatccaggaacacagagatttggcgagggaggcagtgaggaagtcgctggtgctcctgaagaacggcaagacaagtgacaagccgatgctgccgctgtccaagaaggcgcccaagatcctcgtcgccggcagccacgccgacaacctgggctaccagtgcggcggctggacgatcgagtggcagggcgacaccggccgcatcaccgtcggcatgaccatcctcgacgccgtgaaggcggcggtggacccgtcgacgacggtggtgttcgccgagaaccccgacgccgacttcgtcaagaacggcggcttctcctacgccatcgtggtggtcggcgagcacccgtacacggagaccaagggtgacagcttgaacctgaccatcccggaccccgggccgagcacggtggcgacggtatgcggcgccgcgcagtgcgccacggtgctcatcagcggccggccggtggtggtgcagccgttcttgggcgccatggacgcgctcgtcgccgcgtggctgccggggaccgaggggcagggcgtcaccgacgtgctgttcggcgactacgggttcaccggcaagctgccgcggacgtggttcaagtcggtggaccagctgccgatgaactacggcgacgcgcactacgacccgctgttcccgctcggattcggcctcaccacccagcctaggacctactagctagcttagctgcagtgataaggagatataggaaagatgaaaatttcactaaatgggaattcgtactccctgccattgtttcccttgatactatttttctctgttttggtgtatgctcgatcctcattggcgagcataatgaggatcaatttgattatgagaaattccatttacaccaaaaatggcttcgtctcgatgcaccataaattgcgtttaaaatgtccaaacctttctaaagaataatggagtaaagatattaataagcggaataagtccactttgactcccttaaaagcgacccgaatctaattcatgaccttgcactgcaaaaccagatatcttgacccctaaactgttaaaaccggtgcaatttgactccctcagcagttttggagagcggttttgctgacgtggcgcctacgtggcgatattgaccgaattttcgttccacatggcgttgacgtggcacttatgtgacattaaaattaaaaaatatacgtgggacccattagtcattcacacaaaaagaaatgtgggccactgccatgtggggcccacatgtcagtcctccctgtctcattgcttcttcctccatctctgccttctctctctttctctccccttcttctttcccttcggccggtggtggcggtggtagagaaagcggcggcatcaagccgcgagtagggaaggaggtgggcggcgcggctcaccgcgactagcagggtgggcgacatcagggtggtgccggcagagcgatgtggccgcggcggggggatcccggcgaaccgccacaaccttgcgcatgctgctgggaaccgaccgataagtgcttcgatttttcccctcgccggagttcatttctcgctgccgcggccgcatcccgaagcctccgtcggtttcacggttgcgaaggcgaagccgcggagggtgggaggagagcgagaggaggaagaatagtcggcctggtttgcgtttccgcttccgctgggtgtcaccaatccaatccctaatcccgtgcttcttactctccgccatctccatgctacgttccctatgttccaagtgattgtcgatggggctttctatgatttttggttaatctgtatgttacttgttcggctgtgatatccatctcttttgcaaattataccactatatcatgtaacgcttaatcacattcgtgagctaacttacatctcacggtggtaatatggattgtgcatctcctcatataagttgttcttctactcattgagcttgcttcttccacttcaggtgtgcagagaaggggcaagcaacatctgcacaaactctgctggaggcattgtctatgattgctgattcctcatcctcttcttagccaaaggcattagcggtagctcaggataccattgagttctccgaaccatcaggacgctgcctttccttgtctcctgtctcacgcatttggtcccgactgatgcgtcaatggggatggcggcgggcaggagcaagccgatggcggcatcaagtagcgagcgggggaggaggtggtcggcgcggctcactgcgaggagcaaggtgggcgacatcagggcggcgccggcagagcgatgtggtcgtggcggcggggatcccggtgagccgccacgcccttgcgcatgtccgacttggaaggggagagagagggaagggagagaaggaggaagggagacacggaggactgacatgtggccccacatgttagtgggcccacatttctttgtgtgaatgactaatgggtcccacgcatattttttaattctaatgccacgtaaatgccacgtcaacgccacgtggaacaaagactctgtcaatatcgccacgtaggcgccacatcagcaaaaccaccctccaaaaccgctgagggagtcaaattgcatcggttttaacagtttagagatcaacatatctggttttggagttcagggtcacgaattagattcgggtcacttttgagggagtcaaagtgaacttattctttaataagcagatgcacacatataggggtaccgacctggcccgttgatcttctatgagaggcagcatgggcgtgaaggcggcagcgacggcggagaatcttcagaccgacgcggcagcgcgatagaaagaagcgatgcgcgcggttgcacaaaggagaggggggcgaattcgtgcctggcctttctcgggcatgttgtgggccgtccaagtctctgatcgtctgccatgccgaagcaaacccacagcatcccgaattgatgtattgctcctcaagtccaaattgaatccacacagaaatgacaagagtaccacattgtgcaaccaaaaaagtttttttttttctgagaaaatttcttctgaggtgaattttgagggttcatctatttttcatgaacggtaatttggcagaccttgccgacgaacaacctcgtaaacaacccatttttaacagaacaactgggcaccagccaaagtcgtcacattacgcgtgcgagcatcaagaagtagcaaaagagcatggcccgttcaaaaattaacgcctaatctacctcctctagattaaagaggaggttcacttgccgttctagtcattgctgttatgggcacaagtgatatttacaaatatacagtaacacccttcgggatattcttgagctttgccagattcttaccatttgctggtgcccatccccgtccaaaataaatatgttccggggttcttgcgcgagcggctgccgatccaaaatcttgtcctgcactctttcggagtgactacctctttgcataagacagataaggttcttgagcgatggttagaacgtctggtctttctgcttggttgtatgtcaagcagcgacgaatcagttcctgcgagttttcaggtgatgcagggtcaaacttttgccaaactatgtgcaatgttatttaaactagtgtgttgagggacaaaagtttaaaccaaacggacagcctcaaaggcacaacatggaaaatatagtaaaagggatcaatctaactgatgactctgaaatcagagataacagtaaacatacctttgcctcatttgatacagctggctttgaagggaattccactctgcgtgcgttgatgattgtatcttcccgaagtattctctcctgggtctggtcatggccaaaaggacgccttccgaagagcatttggtaaaacattacacccgctgaccaaacatccacctgcaggaatgcaaacatcaattttaccaccaatcagaacaaagatgaagttgcccataagtggtttaaattgattactcagggggttcacaaatgactctaactgaaataagggttaagaaggaatcgcgtaacattttgagtaaaaattgcatatccacatggccattgcctgcataccactaagcccaaccagtattccccatccccatcaacagcagatcaattcaccacctgtgacctgcaccttcctgctcttgcacctccttctgaaaactaaccatctgcacggccatttcccctggatctgtccaatgggaactactatcagactgatctatttggcacataattgtctcgatattgacacaatttaagctgtgcatgtgagtttcttgatagttttccctgattttcctcattcgccacctctttcctgttctgtattaagtaacactctcatgatgttgatcttcttcctattttccatagtgcaagaattggactggacggtggtaaaactagaaatgatctgaaccagtgaatggtctggtttggcttagaagaatgtcggtccatgtatacgaactacgataaaaccatatccagtcctaccagctcacagcctaaatgcaaaaaaataaaaataaaaaatgttatgtatgctgggaattgaaccctgcaactaggacaggccttgcaaagtactcccacaatgcatctaagtacctaaccaactggataatggtgatttcctcgctttaatgacaaacgagtatattcagcctgttattttacttaccaaactggcaaaactattattttctcaaatcagcatttggaccggtgaagtgcagtccaactggcaaaaagcagaaccaaggagctcactaactcaatcaatggtccaggtttttgtactacgaagtatattctttctgaggttttcaagtatggatagaaagctcatcttctctacttatctccacgtagtgtcatagcgttctcaatgcccgtcaaaatacatcttataatttgtaccagagggagtaatgctaatatcatattaacatactagggattactacttaatgaatgctgaaaatttggcaagtgagcatgatttgcgcatgactgcggtctctgtttatgacaaacaaacgccacaagaatccctaacatccttatagaaggatcttattgatgcatgtttttgtcaaattgctttaacacactaagatatgaaagatttattaacattaaaaggaaaacatgttgccaaatataccttcgatgagataaatggcgttttgctaagatcaaagcattccggtggcaggtacctggaagaaaaagaagaacattaggaaacaaatgattgacatgccaaaagaacaatggttctaaatgggaaacagcaacactaacataaataaaaactaaatttatgacatcatttgttctatcccacctgtttacataagacactagagaaaaaaaatatttcattggtagatagtagcatgaaaatggttgtacttcatgcaataactattaattcccttaggttctagaatgatgcatcaaatgtgtgcaactctactacacagtgcaggcattgttgcaccatgtataccaatttaatgccagcagataaaagattccataagaggtagtcagatagagtattttatcaatttagtacacagaaatcaaccggaaaagtgagcacgctcaccaataggttccagctccctgagaagtcagttccattccctgagacccaacatcatcctccactatcttgctgaggccaaagtctgtaacttttgcaacaccaacctcatcgaagagaacattgcctggtttgagatcatagtgaatgatcttttgagttctcttgttaagataaactaggccttgaaatatttggacaattatgattctcgcttccttttctggaagaatcggtgttgctttaaggactgcatcaagatctttgcctgcataaaaggtagcaattgatgtagcattattacatgccaaggtctcatgaacaattaaagatactacagcatgccacttaaaaacaacctcaaagggcctattcaggtgtatgcctattcgaagatagcaacaaaaaagtaagaaacctctatcattaaccaattagagccaattaagcttcattaatttttatgttcaccgccttaaataatgacctcattatccatcagatatcagtcaaatattcatgccccatcctggctatgtgcgtgcttcttacgtaagtgattgaacatggtgggtttgcttatgtgtcccacatgataatgtgccatgaatgcacaaactgatcctatggtaaatgattctaaaagacaactaaatgagtgtggaagttataaatgtaacaaacagctactgaatctacagaactattataaatgctctttcatgtcaacattcaggcaaaatttatctactctcttcaccaagaacaacctaattaagattcctactaataatgaaatgaaatgcagctctcctgcgttttcgagaaaaaaaaaagattcctactaaaagaacagaacagttccgcaaagagattgaatgtttgacacagaagagtgcctggagaacatcaatatatatctggcataaaaacaacacccatgcagccttatctatacaatgaagccaatgggagatatttataaaagaggccgcacgatctacattgtcatgtcaaagaaatttggaaggtcgttgcgaaaataaatttgttgtaccactgcaatattctaggacagtgcagaatgtgttgtgatcaatctcaaatatgtcccatagcctgacaatgtttggatgcaccaaagtcttatggatgttatattcacgaatggcgtggcgtatgtagctttgctttttctcctcactccactgagcattcaaaccatgaagcttacatgccacatacttgtactccaccaaatcaaatgcctgcagaaagaaactgtctcacgtaaatgctggtgataccaaaattgaatcctctatgaaacagataaagatactatatcaataaacattgaggtaacttcaccaaatgaagctcaaaacactagttaaatgctttaacatgaatatataagtaccaaagctattatcgaaaactttacaaatcttgacagaggaagtgtacgggtcaaggaacatttgatgagaaaactgtaatactacatgtgtgttatcagttgttctactcaatgtttaattccaaacaccaagtttcagatatttgtttcaatatatctaatttcctccactttgtttcatttttttatgacttcttcctacatttctaccttttaggccatttcgggtgggacccactgcagcccaccgataggggcttaccttctttatgttacattaataattgtgtgtatcaaagtcataaacaaataatcataaagttcgatgtttcttctttataagcaaagaagcagttggtatttaaagaggtcatgactgaccttagttgaatagtttttgaaaagtaaagctgaagcaagggcataccttataaacctcactaaaccctccctttccaagaagatttaacagagcgtagcgattgtgaagaatctgaaagttattaaagcgtgatccatcttcgtctctgagacgcttcatttcacgtataagcctacccttttccaattcataccgatctctttctctcaagtactgttcttcctcctaaaatacagttcaggggaattagattaaggaaggaggatgcttaatagccaaaaacaataatcagcaaagtattttacccgctttatacttgttaaccgtgatttacatatctcatcctgcaacaggacatcttcctcagacatgctagtttcagcatcactgccatcacccttatctacaatacaaaagtggctagcaaaaataagtgccagcaagaatcctaacttgcatacttaagctgctatgcgttgctagtttctgcttgtgtaaatgcggggagttttcctttgcactaagaagaatgaaatggagtaacatatgcgcaaaactacatagattgtaatggcatttataatcttccttttcatggaataaaaggtcatgcactggagttttcgcctaaccaatggaagctaattcaagtggtaccttgtaaagcaattaagccgggagatgacaacacttttaaaaaagaagaaactttaccggattgtcttttctttagtgattttctatgtctctcgatagtttctttagtctccagcagagatttctacataaaagtccaccatacatgagggattcagcaaaaggtccaccatacatcaagaataaaggttaaaggcacataaaatatatgaatagcaataacactataacagttcacaagagaaaaaaaactgtgcctgataaacaaatgcacaactataggaaatctaaaatcagttgcattaatagcaagcatttgtcttcatggatacatggcttctaaagttgcaaaacaggaactgtgccttaatggatgaagctttatagaaagtggtactgcatgtccacgactccacgttacatcagtagactcagcctgatccagacatgtaatatttttcatgccagcttggtgcttaactgcttaattgaatagatagatatatcttataatctttttggactttattgacctaaggctgctagtaatgtgtggctgtgctcaaaattgtacaaaaagcttatggaacaaagatgtgtccattattagtatctggtagttttaaaactaatcgccttataggggggaaaagacctagacaggttatccagatcaaagtatatgtgatccaattttacggcggaacacagttaaggcatatacacagatctgcagaacttacaaggtgagaattaagatcctttattgcctggccatcctcccatgtttcagatatgacagttccagctctgagttatgacagagagcagtcaaaaaaaaggtagcaatagatagtcaataaccagaacataaaactgaaagtgactagttctgtcctgcaatcaaaattttagtagtcgatactagaaggtacactgcataatacataaactgaaggctcaagctaccacagctgtttctggaagaaaattgggtatcgtacaggctatcatagatgtatagcactccaatgctatagttaacaagaaccacatagcaaagaaatacagtacaagcaaaaggagctttaaatctatcattatacattttcaaatcaattaatatataaatttttactctttaaattaagtgatggatgtatggaaatgttggagattacctcataacaccaacgttaccaagtcggaaagattcctgctttattcgaatccgtgcttcttgccgctctgcttttgacacagctatcagcagatcagatagaaccttcaattgctgcaatagtggaaatcaccatatgagcataaatattacatagtcagggagtagttattattccatgaatagcatgtaggactaagtcctctgagctgtgctgatgaaagagaacaaatagtacacaatatggtcagcctgacctcactatgcacccatctcagcctccaaaggtacacacacaaagcaaaaccaactatcacattgcacatgctcatatgtacacaatcacataacagttcacaaggatcccatatgcaacaatgtgcataaccttctctaccaatgtaatcaggaaaaaagttcttgcatatatgaaatttgacaggttctggtattcaagatccaatgcaaatagaagaatgcaaatcgtttcccaaattattcaacaatgataagcttgagtggtgaactctaatttttttggtaaatttgtctaatttatacaaaggaaagaacaaaaagtaagtaaacaaatatggttagataaaagataataagaatctgccactatagcatctgagtttcttaggatgaaacctttgatttcttttgttgatcttgttctttgagatccttcaattcctggaagaatgaggcaaaaccaacaagtcagagacctggataagtcgagatcacattagggtgtgcattgaataactccataccttcgctagcctatcactaagttgacggtattccgtggactcttgacgcgatttagaaagctcttcttccaaaatagcaactttaccacgcagcaatgacaactcttcctgttgaaatattgaatggatttgctttagatttacatttgagaaagaaaagactcttaacatatttatctggtatattatacattattagtatctataacaacctatatgatatggcatgctccagtacaatatttcacataaatatgttcatgctttctgtagaagattacttaatggaattaagatgcacagtttaaacaaacaaatgaaagcaaataaaaaaggtcatctcaaagaagaagggtcaagagggatagacataatctatcagagaacatctatgttactataataaagatcagaagagggatattcacagtgcacctcacagaaaatgatgtaaagaaagtgtcacctgtaaggcagccttatcatcattgccaagcacagcactggatcgggattcctgatggaaagatactaacaatttagaagatgaggatggatcatcatgtagtaggttgccatcatacacctgatctgcgtaagatatttcttttgcatataatggaagacgggacggtgcaaacagaagaagtgtgtccccataaggattcaattggtactgtacaataaatatatgtgcaagaggcaaacataatgcaccgtaactacctagaatctgagttgctgcaaatgaattcttcaaaagtatcagagataatttgccctaaaatagaaaagccccagagataaccatatcttgatcacataatgcatgatcctttggggatcatcataataagattgttaaaatcaaatcagtccaaacttatcttcaaactatttcaccattttcatctacaaaggaatttcaccatttaattcttttcccagtcaacaaaactctaaattcaatcatgctattcctgctctacacgcatttgtacgtgctctggatgatcacttcttatatatatatatatatatatatatatatatatatatgtaatttgcaccggtttgaaaactaattcttctagtgctcatatttgctacaagatctaattcaggcattcagcattatccaaatgaccaagatatatccataaacatgtgcactttatcgtaataaaatcctatgtatctaaaaatattgaaaggtagcaaactaagatatatcaatttccgttcgctttcatgtctctcttatatggttgtaaggccttaatacccatctgagaacaaaaggttaagaatatcaactgaggtcttgagaataaaatacacagcataccatgttggttaaaatatcatgtcgaccatttgctacaacagcagatgaagttgaagttgctcttgtttgatctacagtttttgaaccacgccctcggcctgctccaccgcgcccccttccacggccttgcttttttctgtttgagatgtctatggatggccgtgtgtccatgacttctgaatgctttaccgcctcattagctgatccctagcattttcaatgaaagagtgcaccaaacagaagaatgacaagagtgagccataagcaagtacaacaaagactatcccatactatttaattctatcgatttcatattgcatacctcaaaatttccaacagctaggccgtgatcaccatctggcgatctcgggcgcttcagtatgttcttctgtatcaagaactcctcgccattctgatttacggaatgcaagtagcattagcaggtataagcaaaaaaaaaaaacaaacaaactagaggtgaaaatattggcaaatctgtagctagaaacaattaatcaagctaatcatacaggtttaccacagtatacactataaatggctccaagcactaaaaagcacaatcatcgcatcactgtcgaaaagtaatgtgcaagtaaggaaatcgatggagataaatatgacactgtactgtagttgagggggaaaggaaaatagcaggttggagttcgaggtttagggctgacatcatcgtcggaagaggaggactcgggcagctcctcctggtccatgaacgtggtggcgggggcagaaggaaccaccagatggtgcggcggcggcggtgatggcaccggagcggccttgccagccatccgtgcctccagcttggcgagcttggacgaggacgggttggaattagacgagaggtgctgcactatatcctcccccgccgccgacgatcccgacattgccgccgctgattgcacccaaaccggatcggccgcccacgaagcttccagaacaagcaaaccaaccgccgcacgcacgcgccaactctcactacgcccccgctccccccgagcacaccctcctcaacgcggccacgcgaaccaccggatggatctacccgcggctgctcgacgaacaggcgatgggcggcggcgccgcctcgggcggaggaacgagcgaatgagaccgaccaaaacggagccgcggcgggcagtcgctgcctccgcctcctcccctcctcccgcctgttgttgactcctcccccgcgtgcggcgacggctagggtttaccggcggcgaggtggtggccctggggcggcggcgccgccgaccagaggacgcaggattcggaggcgagttggaattcacaggattttacacaggcgcaggcatctctctcctctccttttcctctctccgctcttcctgttcttcccccgtactcctacgccgcgacgccactacgcgcagcggaataacgggaactcagcccgcctcggcccacctaggcccatttattccagcccattgaggcccatgggctcgtcgtgtcgtggtggaaagttccttacaagcgccgcctctatcggagaggaaggcgaagagtggggagtgggagacaacaatggcgagcggtgtggaggagagagtgaggggcgaggtgagaggggaggaggatgaccggccgcagctgagcgcggcggcggcggaggcgctgcgggagtttcttctggaacaggggcgggacggtggggaggaaggggaggaaggcggcggcggggtggagctggtggcggaggactggcggctgagccagttctggtacgacgagcgcacggcgcgggcgctcgccgaggaggtcgcccgcctcgtctccctctccggcccggcctcctccgcagcggtggcctgcgtcgcgtgcccgacgctctacacctacctcaagacgagcagccctgatgtgaccgcgcagctgctggagtacgacgtgcggttcgggcagtacggcggcgacttcaccttctacgactacaaccagccggaggagcttccggcggcgatgaagcacgcctaccggatcgtcgtcgccgaccctccctacctggtatgcagagagagattctccctcttcttcttcttgatttatattcgattggactaaaatgttagaagaaattgcgattggttgttcgtgcagagtaaggagtgcttggagaaggttgccaagacggtatctttcctcgcacatcctgaaggctcattcctgctgttactgacaggtaactg

SEQ ID NO: 67340 - DNA, 21233 bp, Oryza sativa
tagaatataatgagtatcatatgcattcatgctcatgccaaaactgactctgtacagtactctgtgctaaaatggtttggcagaataccctgtgactaagcaacaaatcaaactaccaaaaagctaatttacattgatatgttaatgcacacgacgatagattctggtgcagctactgaccattaaagcagtcatgacgagcaatatgagcagaccagtaaaacagggcaagactgggttggaatctagcgttcaccgaagtactaattttagattatcagtaagattatttccgtacaaaacttactaagatcatttcatatgatcaaaacatttataatgagttgcgcgtgatagagatagagtgctgaatagtgcgatttagtcaacttactgactctaaacgttccaaaaatgaagaataatggacaaagtaatgaattctagccgtgcatgaacatgaagctgtaatttcgagtgcttatttcacagagtgcatgcatgatcaggcctagcaaacaggagacatcttatccaggtgaatccttaagtacttcatttccatgcttaattcagagtaaagacatgcatgctacatcaaattaggcgactaattaattactcaagaagacaccaaacagaaaagcagtagaagagactaatcaagtaatcaacacaaaaaaatcaggaaagaagattatacagttacttaccagaatttgggcaagcccaagcacgaacgaatcgggacgagtggtaacgcatcggcgggttcagcatcgcgaagaactgccactccaggaccttgcgcgtgtacaggttgacgccgaacagccgcgagcgcatgaagaagtaggccacgttgccggggagctccgggtgtatgaacgccaccgtggggatctcccgcggcagcttggtcgccttgtagccctcgtcgttccagatatccttgacgagcggctgacagtcgagacgccaagtcccggcatcctgatcgaccagcgtccacatgctgaccaccggtttgccgtcgtactcgcgctcgtggatccccatgtaccggagatcgtcgcctctaaacccaacgcaccggcgcttatcgaggtcaggcgtgcccggcggcagctcgcaatccggagggagcgggacgaagcgcagattctgacgtctcgcgctgatgtcgcaggagaggagaccgtaggagagatccacccaccagactatcgtcttgtgcacgacgacgccgttgccgccccagggacggtcgcgcggcgggtagtcgaccacatgcgtcgcccagatttcgggaaccgagaagtagatgagcagggcggccttgtctgagccgactatggggtggagatcggcgacgtggaagatggttttcgtgatggcgacgagaccagcgttcccggggtgaaggatggggaagccgtggtcggggaggcgggtggacttgtgtttgagcgtgtcgcagatgaagtacgccttggggaagccgtggtgctcgccgagtggcccacggtagaagccgtcgaggacgggcggctccggttcgggcccctggctggcgtagaggaggaggcggccatggcagtcggcgccggcgacgaaggggtggtcgtcgatggtcttgcggcgcggcgcgatgctccggtgcacgacgaggcgggtggcgcgcggagctaatgcggccttgatcacgttgtccatgccagcctcgaagtagtcgccgcggacgacgtgcggcacgcaagccaggagcacccatttccgcccgtccttcttctgccagcgcttgtccttcaccgccgtatccaccttctccattggcggcgcttcggacatggctggagagagagagagagagagagagagagagagagagaggggagagagaggagggagagagagatttgggttggtgtttggggatttttttttttcgcagcagagtggattcgctatttggtctcggggagaggccggccgtggtctggtcacgttctgtgccgccgttgtgtcgtggtttatatcgccgactcggcgtggagttcccgtggatggcacgagccggtacatttcgtgctcgagaagagaacgcaaatggttcatcagcgctagcgtgcgcgtgcgcggcattgccatgcaacggttagaacgagcgcgaggttcagggtagcgaagacatagcctggggggcgcggtggcaagcgtgagctagcacaggggagaaggggagaagcggacggcgagcatgcacgagtgcgatgtaccgcgtgcgcgcgcgcgcgcgccgatggtgacgcctgacgcgcgggcgcacgggagtaccgagtacgcgacggcgccagccgcatggacatggacaggcgcgcaggcgagggatcgatcgaagcgagagcgccgcgccgaaagctcgtgcgattgccatgggcggggaacacgacgcgagacgacggggcgcacgctgggagagcgaggcggttgtggtctggatcgtacggcgcgcacaccggcacacgggggtctggcctgcgtcgacgcaggcacccagccagtcaggcatcgtgggtacttggttttccagtttttgcttactttgacacgtgatctgcaatgcagcggtcacttggaggacaccgtgtccggtgctcctggccgcgttctccgactgcgccacgcacggcacatcaaccaaaacagtgcaatgttatggtttcagtttcggtctctgtatcaggctatcagcacattaatttttttttgagagaatccctaatatgtcacttcaaattaactggttctcttatatgccatttcaaattagcttattccttctatgccactggttcaagtttgtgtcctcccttttataccattgccgtcgctccaccgccccccttttatgccattgccgtcgcttcaccgccagttgaccgttaactttatagttaacaaacgaatttgtccttgagagttggtatacaaccaataataagtattttagtactaatatagctactggatacaatatatgaaaattgatttttttttcatcacatgcaattttagccatcaccatcaaaaaaaaattcaatataatcatgaaatatgtagttttccaacaatattttttttagtacaaagagcatttttcactggctctaacaaaatttggttcactcaaaaaggatttaagttataattttttgaagtttacatattttttagttgagagggcatattggtcatttatgaaaaactaacatttaaataacagtcaactaacactgtagtgctgagagtggcataaaagggtggaaaaacttaaaccaatggcatataagagagaagccaattttaaatggcatataagggaactggccaatttcgtagcatataagagattctctcttttttcccctttttgagtaggaaaggcatgagctctgccttgagagcaagtttaacggtatagtcaactataggttccaaatcatgtaaagttaatttaatagtcaatatatataatagttatcaataaacatatactctccccgtccaaaaaaaaaccaaatcctgggtatgtctagattcaaatccagggttagtcagagaaaaagaaaaaaaaaagaagagtccaagtagaaatacaatctaaaaatagctgaaattcgaaattaaaaataagcaatattgaaagaagtttccatataataacccaatacaagattaatcaaaattcgaaataaaaataaaataaaatccaaaattagaaaaagaaaggagagtccaaatagaagtacaatataaaaatagctgaaattcggaattaaaaataagcaatattgaaagaagtttctatataagaacccaatacaaaattaatcaaaatttgaaataaaaataaaataaaatccagaattagaaaagggaaggagagtccaagtagaagtataatataaaaatagctgaaattcagaattaaaaataagcaatattgaaagaagtttctatataagaacccaatacgagattaatcaaaatttgaaataaaaataaaataagattcgaaattagaaaaggaaaggagagtccaagtagaaatacaatttaaaaatagctgaaattcggaattaaaaataagcaatatcgaaagaagtttctatataagaactcaatacgagattaatcaaaattcgaaataaaaataaaataagattcaaaattagaaaaggaaaagagagtccaagtagaaatacaatttaaaaatagctaaaattcggaattaaaaataaggaatattaaaagaagagtccatattagaacccaatatgagattaattaaaatttggaataaaaataaataaatccgaaattagcaaaagaaaataaaagaagagttcaagtaggaatataatttaaaattagttgaaattcggaattaaaaataagcaatgttgaaagaagagtccatataagaatccaatacgagattaattaaaatttagaattaaaaataaaataatgtccaaaattaaaaaaattaaaagagagttcaagtaggaatacagttttgaaacaactgaaattgaaaataaaaaaaaagcattaaaagaacataatacggtattgactacttcctccgtttcacaatgtaagattttctagcattgcccatatacatatagatgttaatgaatctacacacatacatatgtctagattcattaacatctaaataaatgtggataatgctagaaagtcttacgttgtgaaacggaggaagtaattttttttaaaaaaaactgaaattagaaaaagaaaaataagatttcagctaggaatataatttataaataactaaaatttgtgataaaaataaagattattgaaagaaaagattgtccaaaacacatgatgagataaattaagtaacaggcctataaaggagtagagtgatggcggttgatacaacatataaaaattgttaataaaacaccaaatagaatcctaatgacgattaaaaggagggacatcaggcaggctgtgaagcaaacgagtaagacggttgccaggatttttagaaagtaaaaaaaatgaaccccattgataatcatattcgatttttaaaatctcaataacaataaaaaggagaaactgcgggcggggtgtataagagtatagttgcagagccaccgatggttgacgggacttctagaaactaaaaaatgaattccaacgatagttatgttcgatttttagaatcacaatgacaataaagagtaggcggcggacgggctgtagaggggcatagtggcatcgtttgatgggacttctaaaaattatagaaaataaaaataaaagtccaatttttaaaggttcggaacttctaaaaagtaaaagaaaaaacaatgttaatcatattcgattttaaaatctcaatggcaataaagaagggaggcagcggacgagctgtagaggagtacaatgacaaagccgctgacagtttggcgggacttttagaaagtaaaaatgaacccaaacgataattatgttcgatttttaaaatctcaatgacaataaagagaagagacagtggacggaccgtagaggagtataatggcaatgtttgatgggacatctagaaattataaaaatgaaacccaacgtgacaataaactctaaaaactataaaatccagtttttaaaggttccaagaagaatgaatagaaatagtggtagatcgagcaagcaaataaagaaggagatgacataagcggtagcaactggtgtggcttttaaaaactatataattagaaacacggggacttctaaatgcccaacaggacaataaactctaaaaatataattttttagattgaatttttaaaggttccgaggagaatgaatagaaaaagtggtagatcgagcaagctaataaagaataatatgacagtagtaaggggtagcagctggtgtgacttttaaaaactataaaattaaaaacacgaggatgataaggtttggtctttcaaaatcttaagacaacaagataactatttaataaattttaaataaaattatattaaaaaatatataactttatatgtgtgctagccgcgtaattgcgtgggccacccagctagtttcatcatatgctaacgaatctgatgattgatgttggtgcagctacgaagtatttaaataggatcatgacaagcttaattatgaacgctagctaaaacagggtaaacaggtggaaataaagagtaatcagtattcaaatacatgtgtcaaaaaatatattcattgcagtcactcacatataacgatccagaaatgaagaaacaacaggtggagtaatcccatgatgcatgaagtagtatacttgtaccacagattacaattagtagtgctgcactactactaatgaacaaggattttggtatgcatgctatcttgtcaggttaaaacatggcaactcattatcagtacaaaatcaacattgctcactgactgccacactgttagcatccacaccaacatcaggcaaggttatgcagttactaaaagtctaaatgcataccaaaatctcactggaacaaagttggcaggttccaggcacggacgaactgggacgaatggtagcgcatcggcgggtggagcatctcgaagaaccgccactcgaggagcctgcgcgcgcgcacgtccacggcgaagatccgggagcgcaggaagaagtagaccacgtcgccggggcccgtggggtggatgagcgccaccgcggggacctgccgcggcagcttggtcgccttgtaggcctcgtcgtcccagatcgccacgaagctcgccgcgcagtcgaagccccactccccggcatcttcatcgagcagcgtccacatcctgacgatcgggtcgccgtcgggctcgtcgtcgatctgcacgtaccgcagacggccggcgctcaccccgacgcagcggcgcttctcgaggtccggcgtgccggcgggcagctcgctgtcctgcgggagcggtacgtagtgcaggtccggggggtcgtcgccgtagacgacgtcgcaggtgaggaggccataggagaggtccacccaccagagcctgtcctggtgtgagaccatgccgttgccgccccacggccggtcgtgcggcgggtagctgagctcctcgtcgacccaggcgtcggaatcggagcggtacaggaggagggtggcggtgccggacgcgggagcgggctggagctcggcgacgtagaagctgatggagtagcagaggaggccgacgttgcctggatagaggatggcgaacgggtggtcggggtcagggaggcggctggcctcgcgggtggtcgtgtcgcagatgaagtaggccttggcgaagccgtggtgcacgccgagcggcctgaggtagaacgcgtcgagggcggggcgcggctccgggtcgggtccctgggtggcgtagaggaggaggcggccgtggcgttcgtcggcggcggcgaggtaggggtagttgtcgatggccttgcggtccggggcgatgcggcggggcacggtgatgcgggaggcgaacggaggggcgccgaagtttaaccggagctcggtgcccggaggaaagtggaactcgtcgtgggcaacgtgcgggacggagacgaggatcacccaccaccccttcgccgcctccctcatctgcatctcctccgccgccctctcctcctgcagcctcgccatttgcagttcggcaatggccggaggcggagagatggttgcggtggtggtagctaggcgagtatagctgctatgacggtatcgatttgggggtttggtgtttgaaaattttgggcagcgaaatggagtttggctatttaaattgggaaacaggagatcgacggcaagtttggttgccacgtttgcgaagaagttttggttgtcacatttgtgaagccgtcactggtcgagcggagtcagccctgtattgagtgccaggccctgtataaatgaattttcgcccaggaggcagtgaggcacaggatattttcctgatccataccgaaatttaaaattatttactgtaaaatcctgcacctatagcggtaggcctgcttaaatggttttttggcacaggatatttacctgtttcataccgaaatttaaagttatttactgtaaaatccttcactactaatggttttggacgaagagcgcatttattatcagtactgctatatacatgtacagtgtaaaatacggagttcagaatgacaaccaatctggggacataggacgaacaagtaagtcatccagcgaccaattggtccactaaaaacatgtattttaacaactcgtttcaaagattaccaggtcatctctatcacaattcacagcccacaagtcacaaatgttacaagatttattccaagcaccataaaatttcagtccgtaaaaaatgtcttgtcttgcatgcactggccaacagaagcatatactctctccgtcccaaaaaaaaaagacaaacctggtttccgtgcccaatgtttgaccgtccgtcttatttgaaaaaaatataaaaaaaaattaaaaagacaagtcacgcataaaatattaatcatgtattatcatctaacaacaatgaaaatacgaattataaaaaaatttcatataagacggacaatcaaagttggacacggaaactcagggtttgcctttttttttttgagacggagggagtagatccgaatcatagcagtgactggtctctgacctgtatcatttttttaatggaagacctagatcaaattaaggaaagttagttatgtacttatgaaatcttctcaattaagatcacatgccgtttgaagttgaatgaaaaggtcgtctggtcatataagtggatcaatcaccttagtgagaagaggcgtagtcagatggagcagaatagcagatccttaggcctttcaccgtaagtccatgatcttcattttagttctcaaacatagacaatcttcctcatcaacatcagatgatacttgatacttcacagacaaatattcattgatcaataacgcagaaaaatcagtgctaattaataattttgtagatagggacaactcatttgaaacaataaagtccattttgagttcaagacagagagagaactctgaacagaaaggacaagaaatataatgattcatcataaatcctgatgctacatatataagagtttcaaatctgaaagcatgaattcattttttagcaaacatgtgaagcttatttagaaagcaatgcttaataaaaagggccaagaaagctttgatactgttgaccttaacactaataccccccccccccccccccaaaacaacaaaagcagttatgcagcacatctttgtgcatattcagaatgagcgcgttcttaaacactcaagcaacagctagcattcttatgttattgggttcaaaacgatatgggattgacacttggaaataaaagcggatactgaacagccaaacacacagcttatactcagagcaaatttacctagatcagtcatatgattttaaatgtattatggacaaatgtttgcctaaagacatgcattcatatgcatcctattaggagatgatctatcaagccaactcagttgaggagattgtctggtaacagcacagataacaaaaagaaaagatctgcatacacagaacccatggggccacgacattctgtatatgttcaggcagaaattgacattgtgaatttgtgaccagctgtactgatttacctttcctcatgaaacatcactacaaaactacagctacagcattccagagcagccaatcacagtacgcaagaagtaatgaagggacagaggaacagtatagagactacattttatctagcatcctgtttgtagatgcatgagatatgcttagtactatgaaaaatgaatatatatgtgcccatttcaatgattttgctagtgttcaacgaaattctgaaagcacatgttaaaaccctctctaaacacataatctgaactttgatccataagactgttctacgacatccatgggcctcagttgggtggagtaattatttaagcacgaaacatgtgtaactaacaaccaccacaccttgagagcaatgtaaagcatcctttagcactcgaactgatgatagtccatataatgtctagacctggactgatggcaaaatgcggtacaacagtaactgacaaggtagctataattatgtatatctgaaagtttctgaaagcatccactactaggacaaaggtaaccacagaaataagcaaccccaggtgaattattagctaaaaactcttgcctaagcagaggtcttgcataaaactctaccattcggcaatttagcattcttctacagaaaaaaaaacagcactgcagcagtaagcaagaagaaatgcaccatgctgaactggaggaacagtccgtggaagcgacggtggaacctcccaaacgcggacgaagaagggaagagtaccaacacttggcgtcttggtcagtggatcatcccgaagagctcgtactccagaacctccctccgcgccgcccaacatcagttggccctggaagaagtagatcacgtcggggtcgttggggtgcaagagcgccagctagcgcggggaccttgcgctccatttcgctcctcttgtacctcttgccgtcccaggtctcgacaaagggcacctcgtactcgcgccgccaccgtgcgtgcactcgatcgtgcagggtccaaatggtcaccacctgttcgtccggaggaccatggatctgcacgtaccgcatcttgttgcccgcgctcgccttgatgcagcggggcgcttggcgatgtcgccctcccctccggtggccagctgcacgcagaggaagtagctaggccgggaagaagtcggggcggagtccgagggccgtggagtcggaaggctccgccgcggccgggccatggatcactcagaggaggcggcgaacgcaggggtccgcgccgcggcggcgatgtaggggtagttcacgaggctggtgggcgtcaggggtgatgcggcgggtcgtcaagcgggaggcaagcgtcggttcccggcgggaggtgctcctctgagtaggccattagcggcacgcaggccagtaccacccacgggccacggctgcaccggcggtggcgcgctccccggcgtccccgcgcggcacgacatgcccagagccccagagcatgctatgaagaattgggagcggaagcggggagaattgtcagggcaggggaaatggtaattttgggattaatttgtttcttttttacaaaaaaaaggccgtgataaatcgctgcgaaacgtgtcatcgtcacgtatgagtttcactggcatgtcactttgcaaataggattcgttaaaatatcacatttaattctacacgttagaatactatctataaccaaattaccctccgtttcttttcttcctctctccaacgccagtagtggttgccagcagccccagtgcgtcgttcccagctaagtggacgacctccctcgctcccaccactgcttgagcgcaagctccagcattccaatcccgatcgcaccgtctatccaacgcccgtccattatcaatgcgttaccttccccgagctcgattaccgcttacgtggttgttgtccctgtaattgctccatccccaagctcagctttccagagctcgaccaccactgtcaccgagctcagggtggagtggatgacgacgacagcgatgagagggcgagctgctgcgttgtggtctcatgtgtcggagccttattcaccatggcctcgtcagagctagtattcatatgttgttatgcttgtgctgctgcatgtgttgccgtggaggctgcaccaaccgatgacgaccgacggaggttgaatcggcggctcaggcacgatggcttcatctcaaagtggcgacgctcgagctcgaggacagcatgagcaacgactgtggcgtccgctggtcgagcttaaggacagtgcaattgacaacaatgatgggcatgcttggaggtgagctaggcggcgacgacgacagacagacatgctcgggaaaggggcgtcctcacgtgggtgggcacacggcaagggacaaaccggagttggaaaagaggatgggtatgtaattaagaagccaacggtaattaatttgctcatgtatggtattgtagcaagtagctattggtcaatagtgacattttatcgagtccacttttgtgaactggtatttcaaaacctacttaggaaaatggcacaatgtcaaatttgttgatgcctatgagacaatcctaattccttcatccaaaaaatacaaatagaggaggtttgtttatttcaaattttttgttgtcttcttcaatttttatctttttttcttttgtaaaaaaagtaagggcccctttgatatggaggaaaaatatagaaattttggaggatttcaatcatataggaaaattttctatgaagcctttgaaacaaaggattgaatcctatacaatgctttgaaattcctatggaatggacaatcctgtaaagattttggaggaaatttagcaagagcttcaacctctcagtaatttttctttgagtttatctttctcatccaatttatgtgtttttcctgcggttcaatcaaacggccattcctgtgtttttcctgcattttacaatcctatgttttacacttacactcctatcaaaatcctacgttttctcaatcttgcgattctaaggggcccttagatctttcgtcgcaatcctggtctctctctccaatcaacttcgagttccgacttccaagtaaaaaccctaattcttccccaattcctccgaattgagccgccgtcatagcgatggccgagcttaataacagcgcaattaacaacaatgacgggcatgcttggaggtgagctaggcggcgacgacgacggacatgctcgggaaagggcgcgtcctcacggtgggcacacggcaagggataaaccggagttggaaaagaggatgggaatgtaagaagccaacggtaatttgctcatggatggtattgcagcatgtagctatgggtcaagagtgatattttatcgagtccacttttgtaaagtggtatttcaagacctacttataaaaatggcacaatgtcagatttgttgatgcctatgagataatcctacttccttcatccaaaaaaatacaaatacgggaggtttgtttatttcaagttttttttgtcttcttcaatttttatcttttttcttttgtaaaaaaaaagtaagggaccctttgatatggaggaaaacataggaattttggaggatttcaatcctataggtaatttttctttgagtctatctctctaatccaatttttacgtttttcctacaattcaattaaacagtcgtggttcaatcaaacggttattcatatgtttttcatacgttttacaatcatctaatttacacttatacttctatcaaaatcctaagttttctgaatcttactattctaagggcctttagatctttcctcgcaatcctggtctctctctccaatcaacttcaaattcctacttcccagtaaaaaccctaaatcttccccaccagttcctccgaattgagccgccgtcgtagcgatggcgaaccccgtcgtcccgtgcccttccgccgccgcctacggccccggcggctgcgatggcgtaggctgctcctccagccacaacgtctgggctcaccgtgtccgccacaacggcggcgtctaccgcctctgctcctcctgcgttctcctcggccaccgcgacgccttctgctccgtttgccttgacgtcttcccgggggacgcgcccttccaagatgatttctataaccccatcgtctcatgctcctgctgcggcgtcgagcccgtcgccgccgcccacctcgcctgcctcacggacccttcctacttcgtgtgcccagcgtgcgccgccgccgccgagggcaggaccttcacttacgccccctcgagcggtgccccgcacgcgctggcggagcgcgtgctcctcgtcgcggcgcggctcgcgcacgagtccgtcgcccgtgccgcggcggcggcgcgcgagcaggcggagcgcctgatccgggaggcggccgccgccaggaagcgcgcgcgcgacatggtagacgtggcctgccgcgtcctggaggcggaagccagggacgccaaagagcaggccgcggcgcccccctcacccgtgctgaccaagaagacgaccccgaagaacagcgcagcaaacaggagcagcgacaagcctctcaagatcaattcaatacagaagccggcgctggcgttcgccgcagcggcagccgcggccgccgccgcggccagctcaacgccattgtcgacgccgtcgcccgcgggggaaaggaagccaatgaaacagggaagaggtgagtcaacaagtagttattggctgccgatgatgaacagcaattgtgatttgagacaactattttttctctgtacagtactaattgccgtgtaattctctcagcttcagcaaacagaggagcaaaagatgatcaaaggacactgtttggtgcctttcaaccgtgatgactccatgtgttttttgatctttgaagctaagtgacattgaatggtctgggctattggccgtgcagtgtaaaaagaatcccaagtttagatctaataacagctagcaattggtgtatctatctacttggtgttcatattattaaaatttatttctaatgattttactgctgcgcaaatgaaatgcaattgaatatcccaattcaaaagtttatataactgatggcttcatttttcttaggaggatcaatggtggcagaatttgtgcttaaactttgaactagttggttttctaactcgtacatttcaaccaagcataagatccttaggtccctacgtgtacaatgtacattgttgttccatggtattacgttgcgaatgtacaattaattttgcaatatcaagaaaataggatcaatgttgtgttttactattatgttaaggtacaattgttcttttctatgtctcaaaaatttgctagaattgttctttggctgctctaaaccgtggttcggacgttctgtaattggtaactgagataactaattgatcctaattgttctgtactatactaatcgtcattgtatggttctagcaggttcagcaaaaggaggagcagagcaaactaaaactgaagagttagcctgaacatttattcactgatacacagtattaaaactctgtacgcacgtatagcagtgatagtaaagataagaattcacagatccaaaatttaaattctcaaccacgtgctagttcggaaatgtaaacaatcatccatcgaatatacgagaattagaactcagtgtaccatcacgaacaatgtcatcagccatccaccaattaacaaacactggttgtgtaagatagcagagagttaagccagatatctaattaaagacactgtccaacatcagtcagggtgtttggtttctcaactgcctagtaccgtggatatgtcaaacagaggaagcagggagaagaaacaagatttccaaacaaaactttcatctgaaactcaacactgaactattcatacaatactttcagctgaaactcgaggaactatgtttgaaccgtccatggagacatgtgacacgaagtttcgcatcagacacaatgcctcatatgcgtcagtagccttgacaatgacaaatgacaagtacctgatgaatgaaaaagaagataacacacacatgaggttcagtgaagaaaattctctcttgtatgcgagtgcatgtgaattgaagtggtcggcgatccaaagaggatggaaagaggctcacttaggaaaagcagtggcattcctcagttcctggaaccttggattgatgaagagccttccagtggttgacagcagttcgtcagctttgtcactcgaaaagttcaagtcaagctcatccgtcagattctgcaaattaacacaagcaattctagttagtcaaaaaatggtaaacctgtgttcaataacttgataggaacttagcttatgtatttttttccagaagctaaagatgcaacagtacatgcaccagtaaatatatgtctatattatactcagtgattttcagacttcagggtcattaatacaaacaaacgaagttgctgttatggaatatattctataagtattccgtagtgttaaatgacatacagatacatggccaacatacagcattactacaacattgtaactactaaaatgtagaaggtactaaacatgcaaattcacatatagtccttgatcgattcccattaatttacaatgtcaaaagaactatacagtgcaaatctgtatctgctagattagatgcaccctctggtgtgcaggattaatcatgaaccggccaaatgagatgtgcagaccatgcccagcatcaaaataactcaaacatgaatagcacaaatggacaaagcacatcagcatgcagcgatgagacagagcaaagaagtgaagaacagcgcagcgtacgtaccatctgtctcatcatcctctccgcggcagatcgaatgtggcagctcccaagcgcggacgtggcgagaggagtggtacatcgtcggcagctggggcatcttgtacttcttgcactcgagcacgattctggtgaccaggtcgacggcgaacatccacgagttccgcgaggtgatctggaagaagaacaccacgccgagctccttggggtggaggagcgcgagcaccggaacgcgccgcggcatcatggtcttccggtatgtcacgtggtcccagatctcgtcgacgcgcacccggtggcggagcgaccaaaccgactcctcccccgcatcagactgctgcagcgtccacatgctgatcatgatcgtcgatggcgcgccgcggccggcggcggtgtcgtagtcgtggatctgcacgaacgccagctcgccgtcgctcacgttcacgcaccggtgcttggcgtggtccgcgtcgctggagtacggtagcttgcatccctcagggagcggcacgaagcgcatgtctggcttcgcggcgaacgcgtcgcaggtgaggaggccgaaggagaggtccacccaccagagcatcccggcgtggacgatgacgccgtcgccgcaccacgaccggcggcctggcgggtagttgaccttcgttgaagcccaccctccgagtccgagctcatgggagtagcgtagtagggtggcacggtggatgccattgccggactctatctggagctcggccaacaagcggatcgggtggtcgcgatccgccgttctgcggatcatgccgacgttcccggcgcagaggagccggtactcgtcggagcagggcgggtagaggtaggccatgcggagcgtagcgtggcagaggatgtagccgccgtcgttggtgcagctcggtgcagggtcgaatccgagcgcgacgccggggccgaaatcgtgggcgctcctcctggcgccgcggagcaggagtccgccggcggagtcgacggcgacgacgtaggggtggtcgtcgcggtcggggcagaaatcccgaggcgcgggggagacagggacagagtcgctctggcgcaaggtgaggagggagacgcccggcgggtcgcgccagtcgaaggcaaggtggtcgccggcctcgaagtcgctgtcggaagaggacacgctcgggacgcaggccaggatcacccacgtggcctcccgcggcggcgccgccatcctctcgtcccgccggaacttgggcgccgcgccgtcgaacaggtgcgggctatgctccatgcgtctcttgctgctccgaacttccgaagcggcggcggcggcggcggcgttggagtggtcggtggcggcgatgggcggggtgggatgaactggaaatgggctgctcccctcgattggtttgccgctttaacggagccagaacccggaggggcgagaaggttctaaattctaatcgcatcccggtgtttggcaattggcactttggcttgctgaccaagccggttagttacggttatcaccatctaaccacctacagtgcggtgattttttttcactaatccatgtggttataagctctgacggtaatttttcgttaatctcatgttttttttagacaaaaaggttattaaaaactagagcattgcaaagctgtggatcgaggaggattcaccaaaccaaaccgcaccgatgtatcgtggtagtccattgtacgcttgtttgggaccatggattagtttcagtctttcagagaagaaaaaagaatgttacgcttgttgccttgtttcctatgctcgacttgtcgcggccggagattgcacggtgcgccaggccgccagttggcagatgccgtttgtgacggacgatgtggtgcggtccgtgtatggcaaaaaatggagtgaagctaagccaccgcgcgtgcacttcccaccgatcgcgattcacagccgcacgggcacacggcacactagtaccagtactactcccacgcgaacgaatcatcggaagtggccgtgcgcgcgttccggccgctacatcgcgccgcggcagcgcgcaagccgtggaagaggccaagcgtcttgtgcggctgctacatttgcctccgctccaaatagagacgttggtactgtactaccgtgtttttcaggctcaccatcagcagtagtactctgtaacaataggcttggacggctgccccaagttatcggtttatcactaatcaggttctctaacctcgaacaaatccccatcttatatgagatttagcacgcatcagccagcacacacagttgaggaatgccgtgaacaagacattaatcgatgaactgtttgtcataaacacgtggtttatgacaatatttcatcaatttgtcatacagaaagttcaaacagtcgatcttatttgatcctgcaagctaacacaagcaatgctagttgataaaaaaagggtgctaatttatagtatttgatagtttgcgaggaactagtcatctgtaaaaatgttaacaaaaacccaaatcaggtaaatgctatatttgtcacgtgaaatcaagcttcaaacccccagcagttgcaagttgcaacagtacattaattctattatacggttgcaccagtacatattacattcgctaattttcagacttcataactatggtagccactaacaccaactaaatgaggatatgctctacatgcagttgatgtttccatgatgaaataaaccagccttggtgctagcatcagtacacaatcatagtactaaaagtccctcgcacttcgtccttttttttagatggatctttgaatacttttgcacttgcattattacttattagacagcgataactgtctagcatgcagttttatgaatcagagtatgaatattcaagatcatatgaaaggagcaagcatgcatgcagcgctgtagcctttcaatctgtacggattactaattaccagcttattgttggaataatcctcacacttgtgtattttcaacacaaaacaaacatattatcaaaattgattcaacgttagaattaataaaactaatttatattttagatgctgataattttttctataagcttatcaaacttaacaaagtttgattaggaaaaaaagttaaacggtttataatatgaaacggtgggccaaaagtttgctagaattattctgcggctgctcaaaaccgtggttcagacgttctgtaattgtaactgagatagtaactaatagtctcctaattgttctgtacaatactaatcgtcatcgtattcgtatggttctagcaggttcagcaaacggaggaacaggagcaaactaaacgagttagcctgaacatacattcactgatacatagtattaaaactctgtacggaagtatggcagtgatatatagtaaaaatatgaattcacatatcataaaatttctcaaccgcataccagttaggaaatctaaacaatcacccatcaaatatgcgagaactagaactcagcgtaccatcacgaacaatgtcgtcagccatccatcagttaacaaacactggttgtccaagatagcagagagttaagccagatatctaattaaagacactacgcagcatcagtcagggcgtttggtttctgaactgcctagtgccccggatatgtcaaacagaggaagcagggagaagaaacaagatttccaaacaaaactttcatctgaaactcaacactgaactattcatacaatactttcacctgaaactctaggaactatgtttgaaccgtccatggagacatgtgacacgaagtctcgcatcagacacgatgcctcatatgcgtcggtagccttgacaatgacaaatgacaagtacctgatgaatgaaaaagaagaaaacacacacatgaggttcagtgaagaaaattctctcttgtatgcgagtgcatgtgaattggagtggtcggcgatctaaagaggatggaaagaggctcacttaggaaaagcagtggcattcctcagttcctggaacctaggattgatgaagagccttccagtggttgacagcagttcatcagctttgtctctcgaaaagttcaagtcgagctcatccgtcagattctgcaaattaacacaagcaattctagttagtcataaaatggtaaacctctgttcaataacttgataggaacttagcttatgtattttttttccagaagctaaattgcaacagtacttgcactagtaaatatatgtctatattatactcagtgattttcagacttcagggtcattaatacaaacaaacgaagttgctgttatggaatatattctatcagtattccgtagtgttaaatgacatacagatacatgatcaaaatacagcattacaacattgtaactactaaaatgtagaaggtactaaacatgcaaattcacatatagtccttgatcgattcccattaatttacaatgtcaaaagaactatacagtgcaaatctgtatctgctagattagatgcaccctctggtgtgcaggatggcaggattaatcatgaaccggccaaatgagatgtgcagaccatgcccagcatcaaaataactcaaacatgaatagcacaaatgga

SEQ ID NO: 67341 - DNA, 3758 bp, Oryza sativa
tataatgtaaatctcgaaattacatatgtaaatttcaaaattacatatgtaaatattaaaattacatatgtaaatagagtgtaattttacatgtagatagcaaaggaacgtgatcgatcggataaatcacagcaagcagcacaggtgcatgtgtatgtagtacgaactagtgcttgcacgcacgatggcaaattaagtagtcctgcatgaatctaaacgaaactttgagggctaacaaactgactgtaattagagaagatttatggcgacataactatagcaaaaccgattaaacaatatattgaagtttgctaaaatataggataaacgtattgaaattcattaaaagtgaggacaaatatattagagttcgttaaagtatattatagtgttttacggtatgcaagactgggaaaaaaggagacggagcaagttgcagtggtggtggagagcccctagcgcaaacagggcctatagttcccatcctctccaaattaatacagggagcctccacccccaccatttttgctatagaaaagatactactgcatgatgattgatgagtagtttcttttgaaaaaaaaatgattgaggagtagttgtaaaatgtagaagagtggtacttctggagggtggaaaaacatatatggaatatccttttatcggactgctccatgtttagatgtaagctgaacacatggacagcgtcaggcttgataatgtctttttcccccagaaaggaaggattaacactctaactaactcgtgatgaccttcggatatgatagagctttacagatatggagtatactcattcacgagccttgtcttaccccgtacatcacggattcacatcaagaccagaattctgcccaccactggcattattgtcctccaagatgaaggacagtggtaggcgcaagtgcacgactctacaagttctgcacagtaagagagcaacgacgacgatgacgggtcagtcagtcaagtcagagtaacatggtcactgaactgttctacatatcgtgcacgggagacccctctcctcgtcagtttcaaccaacggagtggtctctcttttgagatcctcgaacgaattctcaggtcttcgcgagagcgcgagcgtgatcagacgcgcctaagaacaaaaacctgccattcctgccgaacaaattgaaacgccgcacgtcgcatgctggccgtgatggtcactcactcatcacgcccagatggcgatcatggacatgagccctgcgccgagcagcaacgcgacgttcatggcgagctgcaggcgtccccttctctgcaccttggtcttcatgaagtcctcggcgaggatgtcgacgagcgccatgtagacgagtatccccgctgccgacgcctcgaggagcccctgcaccaccagcgccgttgggctgttcgcgtcgtagacggaggagatcccgatcccgacgacgatgccggccggcgtcgtcagggagaagaagagcgccatcgtcaccactgacctgacacggaactttgcctgcagaaacaagaaagaacaggttatattataagttattttaacttttttcttaatcaaacttatttaagtttacctaaatttatagaaagattaaggagtattaagaaaaccgcagtaagttttttgagtgaaaaattttcagatataactataatataattgaagtgaaattacatcgtaaccacactgcaactgcgctgtaactgtaatataacttatataaaacttatattctactatgttttggttagcatcaagttcttacgcgtgagatgggtgaaaatttctttctaccaattattttccttcatgcacaaatctcaatgcgatctgatggccacaaatctgaaagttttttgggggcaaaaaaaaacttgcggaagttttctagcaattccgaaaaattattaacatctacaatacgaaattaatttcattaaaattaacataaaatatattttgataatatatttgttttgggttaaaatgttgttatatttttctataaacttagtcaaattttaaaaagaaagttaaaacgattaataataatataaaatagaaggattacttttgattgagattaattagtggaggcccagccgcccagggaagtaggatgggatgcgatttgagtcgtgatttaacaactgggcccctcaaagtactaaggcccatctgtaaatctgcaaaatcggaacgtctttttctaactttttggtagtacaagacatcagttgtcctcttgtttgaaatcggtatcttcggacgagttagtaagcacgatggattgataggatatgaacaccaaaaacgttgaaatctttctctctctctctctctctcgaaaaaaaaaaaaaacaggttgaaattgacaattgtgagtgcggagtaaatgtgtgggtaaatcacctgaacgatgcatccgccgagcccgatgccctcgaagaactgatgaaacgtcagcgccggcacgagcggccgcaccgtgctcgggaagtcggaggcgcccagcgacatcccgatgatgagcgagtgcaccaccactcccagctccagcacctccaccatcaaggacgcacaagcaaaatcgattaagaaaataagaacagaaattttgattgaattttcttaatttggttgcgtttttttgttttcgcagctctgtttcttgaatggcgcggtggcgggagatgtagtatgacatacctgagagatgacgcggtggcggacgaggtcttcctcgccggcgggagcgacggacatgacggacatgccgtgggcgtggccgtggctgtgctcgtcggaggcctccaggtcgtcggctggctcgtcggcgacggccgcggccttcctcttggcgtccgtgcggtgaaagtaccccgtggcgacggtgtcgacgatgagcgtgccgatggcggagaccatggcgaccatgccggcgatcgggaagcgcttccacgggccgccgacgaggcacggcgagctgagcgcctcgaaggccgcgggaaggatgtgcaccaggcccgtggcgaggatgacgccgccggcgaaggccttgacggagagtaacacgtccgtctccggctggatcgccgggaacctgccgcccagggacggcagcgccgccccgacggtgctcccggcgaggatgcagaagatggcgatgaccttgagccgcagcgcctgcgccttgtcccgccccgccgtgtccgtcgcgcagtcgcactccgctgccgccgcgtgcgccggcaggtagcacgccgccaccagaaagagcaggacgaacaccttggtcatcgccgccgtcgccatcgccgatggctcacctgcagctaagcttagctcgcgcggcgagatgtcgcggcgtttcgcagcggaggttcaggttggcacatgcgcgagctaagctccgcttcgttcttctaggccttttgaacccgtggactctccatttcagtctccgatccgttgcatgtaaacaaacaaatttaaaaaagaagagaaataattgattgctggggcgttcgcgcgctcaactgagattaaattataactacttagttaattaattcttcgagcaacaataacagtttggctggccttgatgcgtttccaattttttgtgtggtttgcctttgccacaacaggtataagcatgaaaatgtgaaacatgcactaatccggttcttctatttcaatgaaattggtcaaaaaaaaagagaaagaa

SEQ ID NO: 67342 - DNA, 1406 bp, Oryza sativa
aataaattgatgcatagaatgcaaggtttgcacttaagatacatgccacttgaaagtttggacttagaaatatgccactccaaagtggaattattttgaaacatgccactacgaagctaaattggttgattaaattgcccctatgaccttcttcctctctttccatcatcccactccagaagttctctcgtccctctctccagcagggctggatgccggtgagatcctctcccctggccagcaggccgcagacctccctatgccctgtgactggccagccccaagcccctcattccccctccctccggtggcacattgattctgcaaaggaacttaccttgccagcttgcagcagcttggcaagaagagacctccaagccgaggcagccctcggtgcagacctccctgaggaagagctaggaggctcactggcggacccaggattttgccgagccctgggccaacactaattgctatcttgaagtgggctattggagtagctaggaatttttcgttggctagttcgacttcaaaagttcacatcactaatcaaaatttctaaacactgcaaatcccatatacaagtacaaatttgaataaaaggcgtcacagatataacaatagtatcttataacatcatagccaactaatttaacaagcaagttcaaaatgagcaatattaccaccagtgccggagggaggaaaaaaatttaggtgtggcctatgaattaccacgaaagttagcacagaacgaaaaatctcaatgcacgtcattatacgacacaatatcatctcaataagtctacattaagcatggcaaccaagaactactcacaagttcatgattcatcatccatttgcaaacaagtgtagatagaagaataggttctcagaaaatatctcatcttctcaagattcatgttttcaacaacacatcacatataggaactacagtactaagaatagatagatatatatgtggaatctacaaaacaactagtaccaaagattgattaatgttcacatatgtagaatctgttgatggagtgatggatacttggctagttggcttgcttgctgtcactgcttggtgctgcacgcctgcacagatgttgtgcccttcgtcccaccctgctcgcaggcccccctggtccctggcggctggtcgcgctgccgcctggttggagaggatgccgcagccgcagctttgcgccctggaggccggaagcctggcagccacgccctccacacctcacccagccctccagcgcgtggcgagcaccgcagcagccgccgtccactgatggggattggggaaggggattgatggattgggggagggtggaggagatgattcaagagacaaaacaagacaggccgcatttacactaaacaagcctaatggg

SEQ ID NO: 67343 - DNA, 1190 bp, Oryza sativa
catccatgcattgaacttagatgtgtatgtcaaatctaagatttcgaaataggaaaatgcatatgctagattctatgtggttgcatgtttcctcgctgttagattttaatctaatggctaggaagtcgtcttcaaccttacaccaagggagagggggactagggaaggcaagaacataaaagggagggtagcttaccgatgcagccaactagctccttaactatcctttcatctttccccattgttcgtgacaccagactccaatgaagaatttacagatgagggttaggattttaggataggggaaagagggcagattccttacgctttgagggatttccagggaggcggcagactagcactgcgtgacggacaaggacaggcggcgaggccagatgaagctagagggggatggttgatggggttagcggcagggcattatatctagagtggttaggaggcaagggcatctcgatggcgcaagccaccggagatggagaagacaggcaggatgaaagctagctctcgctgcccaactgagaaagaggaggaggaggagaggggagaaggaggtggaggagactagtggtaggtctcaccagcagtagtgtggctgggagggtaacacgctagctcaggcataggagacatatgttcgagtggtgcgcatgtgaaagataggaagaggaagagagataagataatgtgggtagggtaccacagttgcacaaatcttaatgtggtctggatcgtctaaaagctactaaatttatgggtattatcatgtgactaaaagctatacaatccctcataaataacgtacgtcaagcaaatacctactacatccctcataaataacgtacgtcaagcaaatacctactacatccattctagaatgtttcaacttagattgctatgtccagatttgtaggttgtaatatttcaggacgaaggacgaagtatagccattagagatctcatatccaattagtgtacccttctcttcttacacccaacgcttgtatattgggatcctctctctaagtatgtagtagaaaataggtactatataatattatatatctagtaagagggtaggtagttagacaattttggcagctcatcatcgatatctagtgccatacaacacacaactaatttactgtaaactactatatctatatgtatat

SEQ ID NO: 67344 - DNA, 6181 bp, Oryza sativa
tgcagagaaaaagatatgggagcactataaacaattagtaccataactgtctagttatcgataataggtctcataattaatggtgtgactatattgatggtatacataatgattaggaaggaattaagcaatatagggcatattcaatggtagaaacgggtatggtctcttaaacaatacaaaattatttagagaccatgtctttacaatagttgagacgacaaaggctctaatcattaactcaaaaaatattcctttgttaatattcttttcatatttttatcctcatgcaaccatatttccatattataatgactaagagtcgttgttaagccgttgtcatgcataacaacgatgttttatctctcctctttctctttcctccatgtcaacaagtattcctaattagcaacgctaagagatcactattgacaaccattgtacatgccgttagaccatttgtcgatcaacggatgacatccttctttcttctctttctcttcattcttcgtcgtacaataaatcctacgtgacatattctctcaatagtgacattattcacgcccttaaaagttgattatggattggattctgatgcgtatgggctttatatatgacctagtacgtagaatgatatggtttttataaatccccaatgaaatcttatatgcagatattttttagagcaatatatatacttacttcggtcctgggcacaactactaaggtgtgacaagaacaaggaactaatacatattgcatatcgaatcctagagtcaacggctatacatatttttaccaagctcgagtggagatttagaaacaaacttgaataaatgtatatctcctttagtgttggagtattagtctttgcatcattcctggattgtacctgctctctattgagcgaattgtgtaataagtggttgtagcttcactgaagtaaaggccagttcattatctaaaaaaaataaagacttatttggattgttaccaattttgtcctatcaatattttagtagaatcatttggtaagtgagtgtaaatccatcaggggttaaatcttggtgtacacaaatattatgcacatgtaggtgaactttcaacaagattttgatgagatcattaatgtgctgttggttttttaatcttagagcatgtgttagtggggcgtctaatatggtgtcaatttggtattgcgtatgaaatactccctccgtccaaaaaggacaaactctgagtttccgtgtccaacgtttgaccgtccgtcttatttgaaaaaaatatgaaaaaaattaaaaagacaagtcacgcataaagtattaatcatgtttatcatctaacaacaatgaaaatactaattataaaaaaatttcatataagacggacagtcaaacgttggacacggaaatctagggtttgtcttttttttttttggacggagggagtaatatatgtcagtatgtttctgcaatgtaatccaaaatagaatgaaaaaaaaggaaatatggcttgaaaagaacttaggtcccatcttttggctagctaaatgctcgtaacataccatacaacgtattaaagaaatcatatatgtcttcagcgatttaaatgtctttttttacgaacgcgcaaaagaattgcatgttaatctctatctcttctacttataaaaaaataaaaaataagagatgtttcctccatccgtcaaaacaaaaaaaagtagcgaaaaaaagtccgactcctaccgattccttctcaaaaagggaaaaaaaagtcctactctagatcggattcacccttaaaaacgaaaaataaaattgatgtgccggattgaagatctgtttgcaaaaatggaacctatcggttgagagcattccatttttatatgattttaatttttgatctgtacttttgcatttgagtccctgtaattttgtaatttttatatttacatttgagtccctataatcttgtgataagatacttgaggttgtttttgatttaaaaaataataaaagggaaagaacataggcagaaagctgcataaaaagaaaaagaaaaaccgcaaaaaaaaagaaaaagaaaaaataaacaacaacaaaactccgtttctcctaagtggcgaaaataaccgtagatccgatcctataaaaagcaaaaaaaagtgaaaaaaatactagatctgattcatttaaaaacggaaaaaaaaagtccgattcctataaaggcgaaaaaaattcgaaaaaacatataaaaagttcgtccagttctctaagaagaaaaaatggtttgtataaaataaaaaatacgcgtgaggaaaaaatagaaggggcgaaacaaattccgatttctaaccaatatatatctcttcgctacgtataatctaatctaactatttaaaaagagaaaatgcacgacaaaataaaaacggttcaaagaaacgtgtgagaaaaatcagaaaaaagcgcaaaaaaaacacgctaaaaaggttttccatcttccataaaaaataaaaaaacgtgcgagaaaaaaatatttccatcgtcagtaaaaaaattttaaaaaaacatgcgagggaaaaactatcagaaaaaacgcgccatttttaaaaaatggtttgaaaaaaccgtgtaaaaaaacatcgcctattaaaaaaacaaatcgatccgaaaaaactgtcagaaaaaagttaaattgatggacacttgagccggataggatccatcgattttttgtcatctactacacggcttttatttcgtcatatattctcctgtattggaaaaagaaaaaaagaacattcgaaaaaacaagcaaaaaaacacgcgagaaaataattgtcagaaaaaacatgcaaaaaacacactagaaaagaaaagcaaaaaaaggagaaaaatatggttttcgtcgtcagtaaaaaaaaagcaaaaagaacatgctaggaaaaaaaatgttagaaagaaatgcgccatttttgaaaaatggtttgagaaaatcgcgcaagagaaaaaaacatcgtttataaaaaagcatgtcgctcattaaaatacaaacattgtcattgacatgattatgcatgaaaaacgtatattatcattagaatttttttcacccgttgcaacacacgggcatttttgctagtatattagaaggaaaagagttttagttaaacaaacgcaatcagccagactggcttatgctaagggaaggaagaaaaagtaaaagaagaaaaaaaacctgaagcttacagaaattacggtggctaaaacagactccaagcagcgggaaggggctaagccatgctaaactcccaacaaatccccaaaagcagcgacgccagctaaagaccacagatggccctccacatggacggactccaaaaccactgtgaccgaagagagagcggagtcgaaaaccctagagttccgctccttccatagacaccaagagaccaggagcactagggagtcgaagctgtcgcggaggtgctcaggtaagcaggccctggaagacggccactagtcctggaaccaactgccacggagtggagagagggcagacaagccagaaggcgacaacacccggagccagacctgccgagcgaatacgtagtcgaggaggatgtggttcgccatctcaagatcttgagcgcaaaaggggcaagccgagtgactatcgataccacgcttctggagaagatcagccgtccagcagcgctgctggaaagcggaccaaagaacgaacctgcatttggtaggaccctttgcttgccagagaagatcagcacaggcaaaaaaaatgttggccatagaagaaagcctgttatgccgaacgcgcagagtagcgctggtcagccgtccagcggcaaacgagacgatcctcgtcaccggcgagagctgtacgtgaagcaccgcatcccagataagaagaaactaggagatgaccgggacagtgagggcaccgcggatatcagcgatttaaatgtcaatacttaaaaataaacttcaatagaaaaactttaaaattaagttttaaaatttaaattttgacaactactgattatgcatagacgaaacgttaggtgccttaattaagcgtgaggaaaatatagagatatctcgcccgtctttacctatcaaattgatgaatgcaacatttcacctttcccaaagacaaacgaaacgaagcaattaaaattcgaaacttcaactgaaagaaagaagccggccggctgccggcgcatctcgaaagcagccgtttttcaattccttttgaaaccaccgatgctctcttgcaatcgaccgaccaatcgctttgccatcgtcaaatcctccggaaagtcgatgtggtcgtcgccgtttagagcccaagcgtatacctgcaagcggcgacgaagaggtcgatttttttaaaaaaaaatattatttttttttggcttctacatccaactgggtatatgcagccattttaaattaggaacttagcccatcaaacaacccaatttgaactcgagattttgcgctactactcagatcactacaaccactaaggccccctttgattcaaaagaaatttataggaattttagaggattttatttctatagtaatttttcctatatagccctttgaatcaaaggaatggatcttatggaatcctatgaaattcctatggaatgcctaatgccatgcaagttttggaggaattctaacatgaggtaaaacctcatggaaactttcctttgagtctttatctctctctaattcatgtgtttttcctgcggtccaatcaaacgctcattcctatcaaaattctacgttttttttattcctacgttttttcattcctacgattcaaaggggccctaaactgcatctccttttacgaggaagagatagatagaatgaagcagttggagagggaaaaaaagaaagaaccccagaaaaggattagcacgccggcgaagcttctctccccctgtgcaaagcaagcaaagcacggcgcgcccaacttgcatggcaacttgcatgtgcgatgccgcaagctcatctaacttagcaaaaaaacaagaggagaaggagaggataataacaaagcatggaggccaaataaatcaaatccggcgaacggccgagttgttctttaatttttgttcctccttttcttttcttttcgcgaacacgacggtcgagttgctctagatagctagctgatcgatctttcctgtgtagcaagcttgaccgcgggaacgagcaaagagagatggcgggaaaaatgccagttgaacaacttggccaagtgcccaaatatataaactcctatgctactactctttttcctctccatatgtcgcaagctttcagtttgttaatgccaagtggtccttataaaacaagaaggggcaaaaaaaaaactgaagtaaatgttcataaccatactgccagttgcagatttttaacatcacggtacagggctagctagcatgacgtcgtacaatttggtcaggcatgtgtaccattttctttggcaacgggtacaaaagggctcgatctgtgagctgtgaatatcttaatttcgccggatcagccagcattgatacattgaaacaccagtagttgagcatgtcatcactactactgtaaccagctactccgtccctaaatatttgacgtcgttaatttttttaaatatatttgaccattcgtcatattcaaaaactttgtgaatattattcaaaaacttgagtagtagtaatatattttaacaatgaattaaatgatagaaaaataattaataattacttaaattttttttataaaacgaacggtcaaatacattttaaaaaatcaatggcgtcaaatatttagagacggagtgagtaattactaagctatacccaagaatcacaatgtacgcggcttggctggctccatgtttgtattgcctgccgccatgactggcatcagagcaagctccaagctttcgctgcgatattagcttgcatgcactcgcgtcaggtggcacagaccacctcgacctgtcgagcagaaagaatcctaagcgaacgcatacatacaccgatacccgcacggtctcctagctgatcgctgtcaagctagttcttttgcccagttgatggatcattgatgatggatggatgaagcatcgttccactttactt

SEQ ID NO: 67345 - DNA, 56720 bp, Oryza sativa
ataaaaagaatttaccaatatgcttcattttatcttaaatcaatccacatgatcaaaattgatcaaacttcctgtagagtgctttttaagtaaccatatatcacatctacggaaaaaaattaggtggttccattatttttacccattatatttatctaaaaaatcaccgattaaatttatcagttaagtagttacatacgtactaaaaattgtactacgtacatatgtacttacgcacaccaagccccacatctttcttttttcccctttctcacttaaattagatggaaaaccaaactaataattcaatgagcacgtgtgtcattaagcatctaagataagaaataatactaaatgagcaaccatcaataaatgataggtaagtagaggttaccatcaagctacagcaaataatacttgactacaaatagattgcaagtaagactaataacgttccaacaatcctaagatgacacgtaatgctttaataaataacacaaaatctaagaataaaagcaaaacaccttgccatcaatttacacttaaactggtggagcaattatattcaaccattatattagatctatctaagtaatcccttgctcctaaaaacaattaatccctccctatatacgtacatacacaagagatgtaaaaaaagagagtgtatctaccatttgccctgtatggtaggtttttttcagcgttagctcctagcgatgttatcaaggaagccatgtcatcctggcaccacttgacaccaccccgtcaattttcatgaatgtatttttttactaacgactatgtaaaaaccagttgggtgctcatataaacgcctatgcataaccatcttatgaatacacatacaaacattatctcctacaagaggaaaatatttgtaaaaaaaaccaagaaaaattatatagatccgagagactactatatattcaccatgaaaaacatacatatgtgcgtgcgtacgtacgtacatacatacatgcttacgatcgaaaatagcacgtggaaccacattatatccctttataattatgccaatatcatcttaataatgttaataactagcataaacaattttgacaatataaattattctttcgtatattacccatgaaaatgcagaagtgattagatgcataataaaagaaaaaacaaaacacatattagctcgtatgtttgtgaaggatgatgataataaagtgatatttgtttaaatataatagacattatcatatagtatatcaaagtttatggtctattttacggaataaatattttttttattctaggtaatgattcttatagtgaatatggtgagatatcttttagtattctttttataaacagtaagtgaattgcgcgggcttccttgatgcgcgggcttccttcctagtttatgtaaaaaaaataaacaatgaaaattcaattaaaaaggaaaaattccatactttaatttcaacttattttgttaaaattatttccgaaacaaaataatatgtatacccgcgcgaatgtgcgggctaccttcctacttatactataaattttgttaataaatttccaatacacactctatatataagagaattagcaacttttgttttatatttccaatacacactactagtttctgttaaaacaacaataaaacgagaaagaatcatatatatacccaccagcattgtttttttttactgccaacttttattctagcaaaatctgttagaaatgtcttgaaaaaaatgatcattatcacgccaataaatcctagcattattattgtgcatattagcctcaaattcgataagtacttgatcgttctacagcgcaacagttgatgtaaggccaaggtgaaagtcagattacgctgctgatcgagatcacctacatggtgatgatgatatgcatttcttgattaaaggatatagctttatttcatcaagtgaaaggtatagtaatatatagctagctatgtgtaaatgtttcctaatcagtctgttgatgagaacgacatgcgaaagctagctagcagcctaggtagtacaatgaaaatcatataccggctactgcaaatcgcctgcatttcaccgtggttcgttggggcctaggccctagaggccggtgattcagaaccgataagctaacaatagacgatcgacatacgaaagcgcttatattactccgtacctgaaaacttctccacgctgtttgacaattcgcgtgcacagtttccgttttacatatcgttgaaaccccctctcacgcccggcgccgcccgcccggccggcagcgccagctgaggcgtagacttcacctggaaaaaaaaattcccgtggagtcgtggacggacgacgacgcgcgccgccgtaaaccccgacctgccgccccggccacgtacgacgcgcgcaagcgaccgtgcaggtaacgccaaaatacaatcaacccagagccggtggatttttgccgtcgctcgcgtacgacgcgtgggccggctgcgcgcggcgaggaggatcgatcgaagactccacggccgtatggcgaccgcgtcaaataacgaactgtcacgtaacaggcggtaccgtaccatcgcgaggccggccgcagcgccgactgagactccgacggcttccgtgtcaaattcgggtgcgccccacaacgccgagctccccatgatttctcccgcatccgcacggcggcgccccacatttttcccgtgcgtcgccgcgtgccaggggaaaaagcccggaacgacttatcagatactccctccatctacttttaataataatatttcatcttgacacacagaccaagaataagtaattctacttatcatttatttaaacatgctactagtcattcctcgtaaacaagcgattcaataatatttacatttctcaaagcccatgtagctaatcatgtgtggaagaatggagagtcacgcattaaattcgagaaaatcattaagatggtaggttgttggattgaaatatgactatcaaaaataaaattttcagatttagaaatatgactatcaaaaatagatagagggagtaataactcaaccactcaactgagagctgacctgaccagtgcggtgcggcagtgcctagtagtacgtagtaccatcacttcttctacgtctcacgagcttatacaagtactctgcgttatatgtgtgtgtgtgtgtgtgtgtatatatatatatatatatatatatatatatatatatatatatatatatatatatgtgtgtgtgtatgtatgtatatatatatggcccatgccgatgtggaacacagtcaatacaggaattaacatatcccgtgttcaaagccaacgtatgcgtaacgttgtcagtatatgcacagtccaacggaagaccggtaatagtacaaatacgtgacgggccaggctaggctagctagctaagctgctggaaactgactgggtctacgctggggtctcctctaaaaaaaaaattacggttcacagatatcgcattcacatcccagagccggcccgggcctggccgtgactttgtttgaaaaggccaatgagaagaaagcgaaacaaaacaagcgatgaaatttaagtgttagatgaaaaacaatctgaggatatgaacaaacacgtagaaaagagggatctagtaagctgtcattgtttcttttgttttgttgctttgacaagtgtacataattctcaggaagatgctattattatacttattattgtactgattattacttactgcgaagtatcaacagctgtttttgcggtagaaaaagaactaagaaaaagcaatgaattaatacaactttttgctgctgcaaaaccaggaaagtggagaagaaaaaagaaagtgtataccatgtgcccactgcacagctcggccgagctatcgaaaccaaaggagagaaatcaagaacctatcctgaacaaagaagagtaaaaacttggaaatctatgtgaaaattactgatccgaactcgtttttactgcgtctcgctgttggtgttgttgctcgtcgtgttgttgctgcttgtgttgttggtgttgctcgtggtgttggtgttggtgttgttcgcgttgctgttgccagctgccgccgcgtgctggccgcctatgatggacgtgatcgccgccgcgagcgccaccgtgaagttggggtcagcggtgatcgccgccgccgccgcgctgacggtgtcggagagagggccaggcagctgcccgatcggcggcctcggttgcgcgaactgcgcggcggcggcggcggcggcggcggcctcggctgaatcggaggacatctgcaggccggagaacttggactggttgtacagcacctgcggcggcacggcgaacgccggcgccatccctccgcctggcagcggcacctggaactgcggcgccggcgcgcccggccgcgcggcgttgagcggcacggcgttcggcgcgcccggcggcgcgtgggtgaggtcgagcgtgaccgtcgggaacggggccgacgccgagatggtggccatgctggacgagcacggcagcacggtgcgcgccaggaagttggagctcatgagccccgcggcgccgtcggcgctcggcatggaccccgacagaagcatcgacgccgccgccgacgtggtggacgccatcgccatcgcggccggcggcagcgggtggttgtgcgtgccctcgtacgtggtgatcaggatggaccggtcctccgcgcaccgttgcacctgttggtcaattccgtcacgttcacaaagttagaccaatcaaacaacaccccttgcctacacggtagcactgctactcccagcccttcgtactctctacttctgagttttgacccgtatctcagtgagtcgtcgtgtccggtcattacctgcttccgcaccgggcagccggtggccatggtgcagcggtagtacgcgcgtggacaagggtttcccttcgccatcttctgaccgtacttcctccattggcacccatcggcgatctgcacggaaccaaaacgatttggaattcagcacgtctcgatgagaaaatgcctgtgatcgatgtggttgctagtggtggggtcttacgattggcgcttcggatcgcgcgcgaacggagacgcgggccttcctcatgttggcatcctgggcttgctgatcatggctcttgcccgccgcgccggcggcgcccatctgcggcgccatggcgcgtcccggcaaccacgccgccgccgtcgacggcgcgtccgggctgtcaccacgttcttggtccttgttgccggtagacgacgaccgacgcgggctgccggcctccgtcgacgagttggacggctcctccgccgcctcgccgccggcgccggaggacgggcccagatcgaggaattgcctcggcacgaccgcgccctcggccttgccatcctgaaacacacaccaaagtgggaaacccggttatttccactccaggtagctgtgtaatactactactaataactgtggtaatatagggtggttttacactaattattttacctggtgaggcggaggtggctccggctgggtcggaggctgcatcatttgaggcctttgctgcatgagcgcgacgagatgcatctgcagcgcctggtagctggtggtcacctgggtcagcatcccccggagccgctggttctcctcgttcatgcggcccagctccgcctgcatcgccgcgagctgcaaaacatcacacgagagagcgtaaatatcgagcgatccatccatgaccaccggtcggggtcagctcgggtcagatccaccatgctcgccgctgagctagcacggtcagggtcaaccccgtcgaataatcgagatcgcgatgacgatgaattttagttagctaagctgtatgtatcgatcaaccggccctgccgggctagctacctacctcgttgctgctccggctcttctcctcgtgatccggccgcgacgccgcgtcgtcgtcgaccaccatcgaccggtcgctcctcgcgttgttcccggcgggaagaagctgcaacgaacacggacgagcacacgcgttagatcgccgtgagttaaacaggtgtctggcgatcgacgagcgaagaaggcggcggcggctaacgttaatggtgaggtcctccttcttgatggcgaggccggcggcggcgggtcccttggcgtcgtccgcctcggcggcgacgccgcccgagacacggctcttcttcatgttcttcttctcgtcggagaagaagtccacctcgacggacctgcgtgccctgccgccgccaccgccgctgtcgtcggcctccatggtcgacctgtggaacggcggcggggagagcaggttcaagaagccgagcgggcgcggcgacgcgtccagagcgagcagcccacctcctcctcctccgccaccaccgaggtggcccttgtccatgcaactggagctcctactcctcttgtccttcttcccggaggcggagaagatagagaagagaagacgacgtggtagggagagagagataattaggggggagaagagagtgggagagtctgaagtctctcaccggtgggaggaggctcgtataaaaaagggaagcaccctcgactctgacatcaggagctgcgtcagtggcgaggcgcacacgtggcgagtccccattggccgacccgggagtcgacgacgactcgagcctggtgccgaggcgaccggatcgtcctttccggcgaggcgcggagacggctcgtttacgtgcgtgtctccactttagctttccgccttttctcttccggatcagaatcccaactcgttaagaaagcgtgagattttttttttccgtggagcggaaagcgaccgacggctcccgtcgtcgcaacgccaaattaaccaaagcgaggccccccgcaacggcgactcccaccccgcgccggtctaccggttttcaacatccatcatccatccatccaccgttgcgctgtcactcgcccacaccacgtagcttgatgaaagaggttttgtgtacatttgcacgggcagatggacggtgcaccgtacacgtccactccgccgctcgacgtgtcgatcgatcgccactactacggttatctcggattcgatctccggcggtacgagcgccgatgcaggtgtgcaatagggaagaaatattgaggtcagcatgtactgcacgaggggcgttttttttttccacggtcagaaggttccttccgtagattacttgccccccaaccgagaaaagagaaagaaacgcaggtctggattggtcagagacgagttcgggaggatcgtgcctgtgattgatcggctacagctacagggtcgcgagtccacacagcggactcggatcttaccctttctttattgccgctactaaaaactttctgagatcttctatggccaggctgggcccaccagtttaacgtataaataaatttgtttctttgtgtattttgctctgagttcgaggagggttagggtttgggtcaatgggtgcagggaccagttcttccaccgttccacgaaacctccgctcccgattgggccgccgggccgatccacgtggagaaaacgtcaacgcccttgactcccgcggcccccaccgcccaaaacccccccgggcccacaccccgagatgcaagtacgtgacacgcagcctctttttttcttttttcttttttctttcttcttcgcgtcgttttcggataagactgtcactagttgcatacttgcatgtcgaactgcaaataagcagggggatatatatacagtgggagaactggagaaatattatgttgtgggaacggtccaagatgcgatcgctggtgttttgttaatacacgaatctagctaaaagttggctcctgcctttttgataattgggataaagtcggtgtatgcatggcatatcagcatatgcttggacaatattggcatgtgtgaactttgagtttgtagggtaagtagcccacaaaagtttctctactttttagaaattaattgtttttgttggagagtggaggaattatataagacacatgcttgaaagagaggttgcaatttctctctcgagtccggaagaaattggtcctaatctggttgagttaatttcaacacgatgatagcacaaagtccaaaaggcaaggcaacgctatttcacatgtgcctatctacttatgctggattgttccaaatgggtaccatataaaagttttaaacagctactagttgtctaatgcaagttgcatactcaaacacactgtaaactaaaggtgtcgtgggaggtagaattgttctttagctgagaagtgatatcagagccgaagagttgaaaaccaagaacatctatattcaagattgcacgatcatgcacgagacatatgaatcaatatgatgggagagattggtgagattaatcccacactgatttttatttaatgtagttctatttgtctccagtaagtcgttataattggtttgtatgtgtgtgtcgtatgtccggcgaagttctggaataaaaccatttccactatctaaataggtaattctaataatgatagtaattttctttcaagaaaaatctagttgtctcatatttaattaaaaaattgataagttattgacgatcgaaattttagaagtttaactaaatattgtcctaagcatcagatatattttagtagagtagtagtagtagtagtattttcttaggctgtgttcgggagtgagggttgtgtgcacgcaaaacgaaatagtgtttagcacataattaattaaatattagctaaaataaatttaaaaaatagactaatatgttttttaaaataactttcatataagatttttttaaaaaaaacacaccatttagcaatttgaaaagcgtgcgcacggaaaacgagagaaatgagttgggaaagtgttaggctgtgttcgatacatggggttgggaacccatctccttcgcacgaaaaacggagcggtccattagcgcgtgattaattaagtattagctatttttaaaaaaatagattaatttgatttttttaagcaactttcgtatataattgttttttaaaaaaaaacgcaccgtttagcagtttgaaaagcgtgcacgtggaaaacgagagacaggggttgggaacaccctaaaacgaacgcagcctaaaagagaatatcaagatttattgaatatttagtccctcctggttaaattttacatgttatccatgtttccagttggttggatgattttttttttcgaacggtaatgttgttgccgatattttatattaagaagaatgtgtctcattttaagagggttggaagactacttgtttatatacaggttagagctaattctagcctatttgattggtttttttaaaaaaaaatcgtgagttcattcttattgttgaaaaaaagaacatcgtggttgattgactttttttagttaaggcttatctgaactgtgtagaccatagaaatttcaacgaaaataattttctcaggactacaatagtaaaataccctccttgaatcggtgaagatggaaggcatagaaatttcaacaaaaaataatttttctcaggacttcaaaaaaaaaattagcccactgaatcggtgaagatgggcgacaaagtggaggccgccggcgtgcatgacccgcgagtatacgtaaatacagtggcgtgcgacgagtcgacgacgtacccacacgccgagtccgcgacacgacgcccggtccgacaccccgccagcggccagccagtcccaagtcccaaccgactgggacccgggagggagttagagcactactagctctaatttttctatagctaatctaatagccaattcatacaataattgcttactatactactccctccgttttaaaatgtttgacaacgttgactttttagcacatatttgaccgttcgtcttattcaaaaaaattgtgaaatatgtaaaactaaatgtgtacatgaaaatatatttaacaataaatcaaatgatacaaagagaataaataattacttaaattttttaaataagacaaatggttaaacacgtactaaaaagtcaacggtgtcaaacattttgaaacggagggagtattactatatggtctcacctgtcatacacacactacgtcttgaagtccgtgctacagctggctatagatttatagcccgttgctcttctctcttattttttatatctcattaaaatatgtttacagctggctaatagactgttattatatctgcccttagcaactccgcgttacgtacgtcccctccctgacaccgggcgcacgcgtcgaccggccgcgtccccacccaccagcgccccgaagaaatgtgctacaggaacaggagagaaaccgtaggagatgacaggctccatgcgtcgttgcgcgtgctggctgggcgtggattgcggcgccgggagagctaggccccacgcgtcatatttactcgtgcggaaacggcgaaactcccccccccccccccccctgggcaccagctggcagccagctccacccccccaaccgtcaagccggccaccggcagttgaccgcgcgctcgatcggatccgcccccgcagccggtgcgccgcgctagcatgcgacgaatccgagcgctctccttgccgccgtcgcgtcgcgtgggcgtggacaccgtcgacgcggtgtccaacgaaccaggcgcgcgaagcgatgggagcacgagggcggacggacggacgtacgggcgggccgggttttacaagatcctagaccctaggatcggtagcttctagagagaatcactgtgcgatcgagtcatggaccggccggcatgggcaagtgagcaactgatgattctttccggtttctacacgagcggccccccggtccacgtctcctctaccggccaaaaggcgcgtctcggcctcccacctctgtagtctttctttgacctcaactgattagtagcagggggtgttttagatctatggtgtaaagttttagcgtgtcacatcgaatatacagacacgtttaaagtattaaatatagactaataataaaacgaattacagatttcgcctgtaaacttcgagacgaatttattatatctaattaatccatcattagcaaatgtttactattgcactacattgttaaatcatggagtaattaggtttaaaatatttgtctcacaatttacacgtaatctgtgcaattagttatttttttcgtttatatttagtattccatacacatgtctaaacattcgatgtgacgaggtaaaaattttgggaaggcatatgccctcgattgcgcagggaaagagcgcacatgcgtgcacgctgcatgccccggtttcggagcaccggtcgtcgttgcgttgagtttgcctggggatcaaggaacggcaaaatcactcatttcaggttgcatctgaagttctgaacgatcttatctgagcttctgagagacttggttttacagagaagagtggtaaattacgagagaagcgtgtgtaactggaggatcagtcaactgccaccgaaatgggcaactatgtgcaactgcatttcgggatggtaggctgcccagtcgcgtgcgtaactgtccaaggctccacttgcatgcatgggacggggatcgtcgaacgcgcacgctgttcggtgttaggtctaagtgagtcacgatcataaaacgactcagaaaatacagttatgtctagatagcggagaaaatgcaatgagctgttgtgtacctttacgtccatgcgccgatgcacggtcggtctcatcttcagtttagtgcaagggaagaaaaatccggttatctacaaactaccctattcgagtagtatataattcctttctgaaattcttgtattccaaatgactcgttgttgtttagcttctgctcctccgagtgggaaagaactagctttaacccgctgacgattgtggaatttagaaacgcagcttaattatatatttaaaccgaacaaaaacaagcgatcaagttcaaaccacgtaccaaccgtggaggattagttatatatattcttccgagttctgacgccggagtagtactgcacggaccgatcgatcgatcgatcgaccgtcttgggcgacttaattacccgcagaattgatccttctttgacttaacctggccgccaacgtagaagatctcaagatgaagcaatcaatggaggagctggtcaatgggggtttcattattacctccccctgatacggattaactggcgtgattaacttgatcgatcggtcgatcgacgcgtgatgattccatggaggacacaaatgtcagcgtaaacaaaccggtcgcccgttgacaaaagaaaggtttccacgtacgtacgtgccaattgtcaccgtgaccacgtacgcatgtgtagcaacgacctagctaagattagtttgtttactggagtagtagtgcattgtccaggctacaggtacacatctggaattatgtgtgtatttttttttaacgtaacgccgccttctccctcgtctgttcacatttctagctagctagtttggtttcttcaacgagattttcacgagtgtgctgacgaattaagctagcatgtggtgtgctgtcacgttcttgcacggtttttgtgtgcagcacttgttgcctcgttggttagttccctgccgtacgtttagtataagcaaaatcaacactgcaatttggatgggagcagcttttatttgtcgggagatgcatcggggatctggccgatgatttcatcgagggaaatatcatatatatttttatgtaaaatttagtatcgtcaattatagttatgtcaagtgtataattttttctttaaggaccataaaatttctcttttatccaacaacatttattggcaacttgttcgagtttataaagaggtggtagatgcatattaagaattcctgcaaaaggcgtattgtaacatttcggaacttctctgcatctaaaaaaatgtttagtatacggggagtcatttagtggatgagggaaaaaaaagtgatcgtattattagctctactccaaaaccttaaaaaaaatcatatggaatagtaatatatagtacaaatataaactaatatgaagcatttgtccgaggattttttttttcttttcaaaagagagccaggggttcatgtagaatcaaaaaatctcaaaaatcctcattttgttttccccagagaaaattactgtaggggtccattgagcatatcgtacaaatatattcctcttctctcggatattaatcgcctcttttttagaccagctattggacttagactgagaaaactgtatatataatacatagcactgattaaaaataactttatttattgattttgcacataccattcgaggatagcaccctcaacgttcgcattttctcgaacaaatgaaattatgattcaaggtgcagctcaatggtttagccccttgttttggaataatgcacgactcatttacggcacatgaacttcataagtaacctacattcactactgttgactttttagacgtagcaaaaataccgcgaaactactactcttatattatcttcagtttttaatagatgacacaattaattttttaatacatgtataaccattcgtcttaataaaaatacataatttttattttgttgtgacttggtttatcattagcttaatttacactctcatatttgcacattttttatacggcgaatgattaaatgtgtgtgaaaaaatcaataatattatctatttaaaaacggaggaaatataagtctcaacaagtttcaaatgaaaacatgttccgggacggctggactatatatgtaagcaaaaacaaaagtttacccgtattataaagcaggagttttcaaaggagctggatttgttaaactcaaattgtaggtgaaatttcctgggtcggcaccactcatttccaaattccaatcgaccacaggaaaaatcaagaatgagaagaagggtcagagagggtagaacggtagaactgcccacgtcgtatcgcactatacggttggaaaatggaggcatcgccccctcgaagcggcatcccctgattggtggatctggtcttcatgtagtcacctggaacgcgacttccgcagctaatatatctactccttccatccaaagaaaacgagaaaccctgatttccgtgttcaatgttttaccgttcgtcttattttaaaaaaaatatgaaaaaattaaaaagacaaatcacacataaaatattaattatattttatcatctaacaataatgaaaatacgaattataaaaaaaatttataaagacggatagtcaaagttggacacgaaaattcagggtttgttttttagctgagggagtagtaattaacaaaattcgccgaaaacctctcccaatccatcatgcacgcacgtacgttctaacgtgtccccgttgattaatttgttaggcttatgctaatgcttagactaacctaaccgtgtaggttatagcagataacgtagacaaaagcacctgtccctttcgattagcaattagcaaaccgggttaaccagctatccatcccatcgcgatacaaaccacgggatcgagtgccttgttagaattaatctcgtgatgatctggttgagatatttgtggcgtcgtttgaccagatgtaattacgtacaagagccaggaggaaattaaagtcttcttgctctaatcagttaggaaacccgggcagcttgaagatgccgatctgcgtcaagaagatgccgtgaaaattagcaaattgtactccttcgttctaacacaagttattttttcacaaattgatttttaaacctcttacaaactttttattaacaaatcgataaatttattatctattcaatatattctagctacacctaataattgatactccatccctcctaaaatataatagattttggttatatgagatatatatcttataaataaatacggtctaaatctgtacgattaggatgttaccattcaatcaaaatcttttatattttaaaacagattagtattttaaaacagagtattaacgaagcccgttcaatatttttctttaagtattaaattttattttacacacgagaaatcaatttattttaggacatgaagagttctacagagagtgtgaattcaggggcaggatggagatgcacgtacgggtgctaagcttgggttagcgacgacgacgcaccccgcacgtctcctgcagctgatttcttggaccggcgctttttgacgccggcgattgaacccgcgtagaccagacgagcaccgtgcctactcagcaactaacacatctctctctctctctctctctctctctctctctctctctctctctctctgcccatgcagcctatggaaattgataattgatttactatcaattaggttcacctaattggagaagaaaactggatgtgcaaactgcaaagtgcaaaaggctttggctttgggaaaggctatggctacttggcgagggagctgggagtttcagctacaaaaaatgcattcaaatcggacgcagaaaaaggcctgttctttttccaaaggtttccaaaagggaatccatgcataccggacacttccaagcgtcttttgttgtgatttactactcctatctcccccagaatggaaaatgtgaaaaacaaggagaatcaatcttctttagcccttttgaccaatgtaagaaaagaaaattcttatttgcagtgatgcagaatttcttcttgtgagtgaccccggcccagttcttacgtgcacactgtacctacgagcctagtatagggtcctttatcagctcggttgatcatcctcattaccctgccccttgttaccttaagaatgagatcctctaactttgggggttataagcagaggaataataccatgactctgaggtgtttctagctgtctgattcacagcaaacgaacgagatcgattactaaaatatgctaaaatactgaaaaaacagtgatgcgatgctatatattttactgttttacactgttgctacagaaaatatatgcaaaatcacaatttcttattgtaccatcagacttattttattgtacgcccctacctttagtgcctaaagtcagaggatctggatcctatcatcttctgctttatttgttccttattagacgttgagttgggtgtcacaaacactctctccgtgattttgccttcgagcttgaattctcccaacacggttgaaaacacctcagctgatgcttaataacgatagagtcagtatttgtatacctataactcgattatttcctataacaacgatagagttaatcaacttatgaaagttgactagcccaagataaaagaggaagtaaaaacgtggagcgttacgggtgcgagaagcctcgctgcatggctgtcactgtaattagccttttcagcagggttgcagctctgtttttgcttttgtaaagtttccttttgtacagttttcttcttctctaatcaataaaattggcggcctcgtcaattcgttaaaaaaaaaagttgactagccggctaattagagcataattaattaagtacgactaagtaaaatatgtggttttgtaaaatttatgttgagtattatatgttgcaaagttaaacacggattcaataaattgtttcaaaaataccgacgatgaaatattctttagaaaaacgtgccatttcgtagctttagaaacgtgcccgcggtaattttagtgggagcttctttacatacgcacctcacatgacaaaatggaagatatggggtatcaggtaccgactatcaaatcatgggagagtttgatgacaatagggaaagagaaagctgagatctactcctagtactactacttgggaatcggaatacaagacagatttttgatgatgtacaggtgacgaaaggaagctggttgaagagcatggacggcattgaccgcgggatatgattgtctgtgtgtgtgtgtgtgtgattcacgccccccatatttcttctggtctccacaaccacgtgggctcgagagttgccaaccaatccaccaccactagtcgtcgtcgtcgtcgtcgtcaccaccaagcgacaagcaaagcagctagaggaatattggagagacgagtagacgctctctctctctctctctgtgtctgtctagacccggatcgatcggtttttgccttgcatttataggcgtgatggcgatgtcgacgactgttcgagttggaaaggaagagaaacttaattcttttctctgagaaaaaaaacatggctcactagtctctgcagcttggaaaagaaaaatgaggtgaacagcttggtctgaacttctctagtctgaagaaaaggatgggcaactattttgtcaagagctactcgctagctaccgctgtctctgcttactgactctccgcgatgtgtcgagttttttctgaaagtatccgcgtcactgttcagactattgggctatgcctatgcggaatacaatatagattcagtaggaggatcaattgatcgagtgtgtcaggtttataaaatcaaaacaagtgtgtcaggtgtattgtatattcagggatcatgggggattgcaagtactgatacggtggagggatactaaattagtggtactaacagcagccatgtttgtacttcgagttgagtctttgactgcaattattgaaacatgaaacttggccatggctactgatacagttagttgtgcactttctgaacttaacaatgccaacatggccgtctgattctgcttaggtttgtcccatgttgtcatcggcaactcccttgattcatgaacagaagagatgtcgtggtaaccggtttgatatttctttagtttccagagctgttttcagtgttctatcctgattccatcagttacttctgaaacacactccaaatgtagatcaggcttattcaatatgtcccttttaagttattaaataccgtatgcgttcacctcaatcaattggttgattttagcacaccacagtactattcaacaacattacttttttgcctgttgctgcatcattatatgcaagataaattgatcagtgaatgctgaaatggccaagtttttcaaactgcaactggtaaatataaattgaatcagcagttcagcaccacatcaagtggaatgcattgggatccagatacacccaggatcaacctccaaacaaagtcttcaaaatggtttcagtcattgaatcttttgcagtcaattttttaaacacatttttcctgaagaagggatatttagattttagaagaggcaattcactgattcaccctagggtttacaaaaccgcgtggttaccacgcggttatcacggttaccatgcgcggtaacctttttagtttttgtaaccacggtatgtctcgcggttaccgcgggagtgcgataagcgcgccaaaaacggtaaggggagccctgattcaccttcattaacatgattatggttcatgccaaatgcttagttcaacatgtactttacctacttgcatgttgcagaaaatgtttttgcaggacatgagcaccgtgacagttgggtccttgttttttaatgtttttgcaggacatgagcaccgtgacagttgggtgcttgttaggatgttcgagtacttaacaattaaaaacgcatcacgcttattttccctcttaacagctgagctacttcgaagaacacgggcatctgccctttaaaacgctctaaaaatcacagtaattaagcatccacaagtacgtgacgacgcgggcaaaatctttgacgcgaacatgggcgtggtcaccgcgaacgacgcggcggcggccgcgccgggcaagctccggcggccgagcagggcggcggcggcggcgctgtgcccctgcaagggccgcggggcgccgaagccgccgccggtggccgtgatcgcgcacgagtgccccagcgcgatgcgcgccctcgtcgtggaggtccccgcggggcgagacgtggtgtcgtgcgtcgccgcagtggcgcgccgcgcgcggcgcggcgcgctggtgctgggcgcgtccgggcgcgtcgcggacgtggtgctccgggagcccgcggcggtggtgctccgcggcaccatggagatactgggcctggcggggtgcttcttcccgtccccaccgccgcatgcggcggcagagggcgcccccggaggcggaggcgcttccgcggcggtgttcctggccgggccgcgcggcggcgtgctcggcggcggcgtcgcgccgggagggctcgtcgccgccgggccggtggtggtggtgctggccacgttcgtcgcggcggcgttcgaccggctgccgctcctgaagggggaagagaccgcgaattcggaagggtgcgacgtgcatggcgtcaccagacgccggcggtgcggtgctcagccgccgcagcagcagcagcagcggtgcgggtgggcgctgtgccggaagctgggcgcgaagagctaaccggtgtctaacgcaatgggccgagtgagatgcgggctatgtggcccaggaaaactgggcctgtttagttttctagtttgggcctaatgtcgcttacattacctcggttggccatttgaaatcagaagaggaaatagccaaataggggagaaaaccacaagaatgtgatacaaactcaacaaaggattggcgaaacatatgataacagtgagatggggtgtttgaaatcgtaggcggaatccgtaaaagctggtaaataagtaaacttgatgctctcacttaaacttgtgataaaattacggttacttggagttgcatagattgatttgccttgggacctggcataggggaaaaacgttatgcgttagctgatatttgaacttatatgttccaaatggtaaatgaaaattctgtgcacttttcatgtggtgcaatcctccattcccagctggggtaatgagaacacacgaggaaacctattcattttccctgtaggtgttcacaagagtattctagcaaatgagccatcacattcgacacatgataaacatgagaaaaaactaacggtgaagaaatccgtctccttggatatctacaaccattataccaactggagaagtggagatcagcccatcaatgacgatttaactctttaaataactgacatacaaccagtattgaagataaccttatgaaaaccttcatcttgagtgcgagcaacaaagcagggtagagccaacgcttcaacgagcttcgacatggtaacctcgttgacctcctgatcactgtattcactcacatccgatgatgagtctgctaaaaaaatacagaatcaacatctatgccaaccgtgtccgttgacagcggaactaggggtgggcagaaaaagaccgaaccaaaaagaccgagaccgagaaatttggttctaggtagtgaaaaaccgaattttgttcggtcaattcggttagtctcctcggaaaaccgaatagaccgaaaagatcaaattataaaaaaaaagtctaaatgcaacctacaatccactatgtttaataggattaaattctaattttcacatccctacttcttcaaggcatgcaacctaataaaagtctttacttataagtgcttatgattttttttgtgatttttgtgttgaaatttccattatatctttgcatatatgaaaatgttgttgaatttcggtcaagactgagaccgagaccgaatttgtcagtcctgacattttttgcgctgaaattcggtcttcacttttcaaagaccgaaagaccgaagaccgacaccgaaattttttggttagaccgaatccccacccctaagcggaacccattgatgaactgacgagggctagggagtaggggatcacacctgttaccactcgcggtcttttaaacattattgccacactcttttcatatgcacaaaaataacctagaattatgtcctaaaattgaagcaattttgctatatatttgtcgacaatttttttcctaaaaagttaacatatataattacagtataattataatgtaattacgtcgtaacgtgcatataacttttatataattttaaaccgttagatttgtttcaaaatttatgcaagtgaagaagaaaaaagtcactgcgtgcacatatgtgagaggattcgttcccacgacctccgtttcacgaaaatagcatgttacggagagatttttgaaaatttaaaattatgtctattaaaattttaggaaattttttttcgacaaatatataggtgaccgaaactgaagtactcgcttatcaaattttgcagaggacttctaccaatccgggccgggcccaaaatgctgtaaattattcccagattaaagggggcccacctgtctgtgtaaccaaaccctccagtgcagcagagaatccaatccaacccaagaaaaaagaagaatccaatccaatccaccacacacgcgcaccaaccgaaggcgaaatccccaaatcgaaatcgacccagccagccagccggcacgccgatccgatccgtcccacccacccacgcatccggccgccaccgctgcgctgcgccccgccctcttccactctcccactccatccccatcccaaaccccgcgccgcctcttaccgcttcgcgtcagcttcgatttgattcggttcggttcgcgcgcgccccgatctatcccgcgcgaagtcgattcccacgccacccgcgctgttatgtgcgcggctcccatggcttccactgcccagccgcagcagcagccgcagcagcagcaggagcagcagccggtggcggcggcggcggtgccgactccggctcctccggcttccgaggcgcagccgcagaagccgacgagggtatcgttgtcgtacgaggagatctccaagctcttctcgctaccaatcgcagaggcagcctccatcctcggtaatcccgcccgccctcgctctctctctctgtccttctccagatgtgggcgagatccgtcgcctggctcgatttgagggccgcgcagcagctgaacgaacttttgggtgggggggggatttgcaggtgtttgcaccagcgttttgaagaggatttgccgcagccacggcatcgtcaggtggccgtatcgaaaggtatgttttgccctgtttcatgagccgattcctgtgttctcgagtgattgtgttgaacttgaatgtcagaactgacgaggaattcagcagattagtttcatgagctgattcctgtgtttttgagtgattgtgttgaatgtctaactgacgaggaaatcactggtgcgagaaggaagaaagaaagctatttgccgatgagaacttgcatgcttgttctaatttagggctatttgagcaaagagaagtatgcagtggttgtatcctatatgtaaacatggtgctctctttgcttatatattttgcagcagttggtggctttaacaatttacaaggtagactgctttaggaactgatatcgtactcatcagaggcttatcttaatagttgaattaagcgtatcccaaaaagtaagcaaggagacgaatgaattatgtcagatgttggctacttgaagatgttcatgaaagattgaagtttgcttcgaaggaagaaaagaggcgctagattctatgccctagaagccctattatgtaggtggtaattcattgctttccactaaatttgatgtgcgctctcagtaaaactccacctcccttgtcctcccatgctggctgcctctaaccagaacagatagcgaccaccccttgctccgccatggcaatcatccattaattcagagctcttcctgacacaggccgaatatatcaagtataatctacatcgaagaaatataagtctaattccttggtattgactagttactaagatggatgaattattttattccacaatcagctgctaacagaactgctgctaagaaacaaaaggccatcatcagaagcttcaatcacagcacctgtggcttttgggatgcacttggtgcgtgccttgattgagaactggaggtggcagcctttgccatggagaaaacagactgaggacatggtaggatgaagggtaaaacaggaaggagaataggcgaatccttgtgtttaggtgggaaatagtaaacaaaataggtaacatggcattttattaagagtgcacgtctgtttagtggcaaataattaattggcatctgtaaaatggcaaatcgttgaagccatcactgttgagtggcgaatagttaaatttccctaataaaatactccttccggtaaatattcgataactgaaatatgctgtctagctgcataattggttaaagcttgttcaatggctattcgaatgcccatagtgagttggttcaaactgttattgaagatggtatttactctattctgcatgcaaacatagaacaactacagtctgaaagctatttctaccccatgttgtcttctcttccgcatattgattatgttttcccagctttgttcttagtttcttctttgcaatccaattatttatattatttttcttaaatattcatgcttgcagcttgtatctgggaagtctggtgatgacacaaaaaacgctgaaagagagaaagccaagggacttcttgagatatctaaagttgcaaaacagaaggctctaagcgcatctggtctatcaacagtgtgagtagtgcgttttaacttgattgtgttgatgcccatattttattcctgtttcctgtgcaataataaatatgtcttctctcttctgcaaatgttaactggacatgcttggttctcactgaatgttagccacgacaactgcttgctagtgctattttcttgataatcaacagagtatactgaggtagttgatggaataattcaaagctttttctactcgcatgaatatttcagtgtaatatcacgcttaactagtacaagatgtgaagaaagtagtacttgaaattccagcatttccttgttctcttatctatctggactgataattatcatctatggtagatctggatattctgttacagtccaactccatcccagttgtaatattggctgttttatggcagtgtcctatggtaattcctattgcgactgattgtagcttgtactgccagcagattcaagttatgctgaatgcactatgttgtaaacaacagtgatgaacatatatgtggccaagtaatacatatatcataagggatggaactaatttacaggacaatctgttttttcataaatttacttattaattttaagaagaatttgtcccagttttttttatctgctactaagatttctgctctggatcctgtataacttgagagtctatgcacgttttactgcagacaatatcaccattaacttaagctatgtagtgcaatagaagaagttaatgatatgctcattcttgccttcttgtcgctaatctgtattataaatctaaaagcacatgacaattttaattgtacttgtagcttctgcttagtaaacttttactgctactagcttttggcttgtctgatttaactgctcaaactcggttgttggtctcatgacccttaggtgttctattattccttttatggctactttgagctgtggacatggataattgtgcttatgaatttcagctggaaaaaaaatatttgcgcaatacttgcatacagtgtgtttttgtagtggttcattgctcaggattctactgaccatccgctgtctgagtatggatgctggggcagtagagtgggacattgggttggtaccaggtaaacctgaccacaacaacagtttagaccatccctctgtgggactctctgacccgaggctgcgtgtttctatgttttcacacttggatgctatcaactttccctctgttgttaccagttaccactattgtagtctaatttggtttctcagttctctgcatcaagcaccatatgatgatctattgtcactattgaagcggtttgcagcatttgttctgacacttaaatctggacatattgatagatcaccaggcgctttccaaggagtggcaaaatctcaacagggaagttcgaaggcaggacaagtctcacccccaggaaaacaaaatgtgttgggtggatcagcaatcttgtcctatggtacccaaaccaaaggcatcccaacctacatggacgacttcaagtacggatttccatcatctggcttgtctttgcaaactatgaaatggtgggggactgacagccacacggagaccacacctgcgaaagacgataacggtgaagcccctgaatcagcaaatgaggcttcgaagggtatgaccgacgatgagttggactggggagcagatgaagctgaagccgaagccgatgccgatagtgcgatcacaaccgaaccatctgcacagctgtgctccctgagaaggaaagctgtagacgatgggcgcaagctgctgactggcaagtcctgcgggggactggagctgtgcaggctgaataagaggcagaagatggccctcgcccaggtgttcggagcctcactgccggagcagttgaggagcaagctcgggtgatgattttgcctgccatttgtacctctgtgtaacactagttactagtagtagcgaccggcatggttaagctggttcctgatgtaacttgtcctgatccatttgtgttgtgagaactagataaattcgttgtgaagaggatggtaggagttttgcctgcctgctttcccatttcacgcataattcctttcgtctcaaaataactttatttattcataattttatttgtctctaaataattttatcttttaagccataattgcattaaaagtttataaaagtagaggacatatattggggtatgttaaaataatagacgattgcattgagatttgtattagggtttgttaaaatgagagacaattgcattaggatttgttaaagtgatggacattttagtcatttttatttctttgtaccttacaggtaatacgattttactgagctatcgttgatacagcaaatgaacaatcaacaatcgtacgtgttgtacgtctacctacgtggagtgaggctgggtcgtcagtcacgccgcatcgggctattttggtttgttgccaattcttaccctttatagactgtagtcatttcgattggaatcaatattagctggggcaaatctatctaaagttggcttaagatttgacacaactattttttcttttaaaaaatattgtacaaacacacgtgaccatataaacacatacaccatagttagcgtctatcactaaattacaagtacatgtgctaagtttagaaaattaaattaaactcgagtggatagacttcttttttttttttaaaaaaaagaactaacccattaagctgcacccgcttcgtgaaacaaccaaaattatggcatgctttaaaccaaaatgagtttcaagatcgcatttctatatatccattgtctttaaaaaaaagacaaaattatgacaagcttcaaaccaaaattgcccatggagcctagctggggtgattggggtccatgttcattggttgctcaacgtggacatcgaggccaccgcgaagaggtcatatcactgatcatgcaccacccggcgtggctagttagcagcctccatctccatttggccaacaaagtggcagcaatttccgcatgcaagaacgacaactcgagaggagacggcaaaacaatgttagtgaccgttttattggcgttttgttccatcattttctttagcgctgttctagagcttaatttgtgccgtgcatgctagcttaattgattatgataacctagctacgggtgtaaaactgggatctctttataacgattaacgaaggaatgttatgggatattttaatgtttttcaattaagtgtccataaaaatcctgtaaaagttttttcattactccattcgtccaaaagttttaaagcttatttattttctgttttttttctccaaatgagatatgcgtctccatatgcatcaaagacttaaatgaaggacttgtactttttacaatgctaaattaaattgttaactaaaattcaagcaaacattgtaatactagttgcatgaatcatgaatgcatattattttttctttgttatatgtgaaataagttagtttctacttggtctttgtgataaaagaaatatgctataaacttttggttggggggagtatgaataagccctcttataattcgactaattaatcagagggcttttgctgcattacacttagttatggataacttcaatcagcatttaaacatgtgtagaattatatggcatccatctcagcgtaacatcttataactgactaattacaatctaccttctttatttccattttttttcatgaaatgtatagcatttagatataaattaatttcatagagccattgaaggtttgaatattcttttaaaaaatgccatggaaatattttggttgctctaggaacgaattgtgctctagaagagagcgaagacaacgatgcctaaaacagtgtcaattgaaatttgtttatcgtagctgttagtttgtactacgttactctatccaccagtactgttcacatcagagttcaaatcgtagtgtccaaaaatatggttgccactacatttggttcccctatgcgagatggatctgtatcaaacatccaaatttcccacgaatattttgcgagtttcaaaatttgaattcctttttcaaattccaaggtagtacaccaagcactatcaagcttgctattggctacagtgcatacatacacatccctagctatctacccagtacacgcatacgtacatgcacgtattgtacgtacagcttaattaattaattaattaaattagacgttgacgagcggcgagccggtgaggaactcggtgaaggcgagcgcgacgaggccgagcatggcgaaccgcccgttccagagctcggcgtcggcgctcatcacgccgccgctcctcgcctccgcggtctcgccgcggagcagcggcaccagcgacgccgcggagagcacggcggcggtggcggcgaaccacgccagcccgctccagctgccggcctggtccaggagcccgccgccgcgcgacgcctccacggccagcgccgacacgaaccccaccatcgccagccgcccgttgatccgctccggcgccggcccgctgaacgccagcacgtcccacagcttcgtgctcgccgccggcttcgccttgggcgccgccgccgcggggctcggagtcggggtcgtcgccggagacggggacgacgacgacgtggccgtctcctccttcgtcggctccacctccggctgcagaacgatcaatcccaagttagcaaattaagaagcaatcaccagaacacacagtgatcaagtcaatcaagcgtggcatgctcagctcacctcggactgggccctgacgacgagcgcgacacgccggcgaggcgcggcgcggccagcggagacgacaccacgccatggcgcgccaccagcagcagcggcggcgacggcgaaggagctgctcagcgccatggtagcggccgccattgcaaataactcaaacacaaaaattaaccaactaaaacgcagagagagatcgatcgagctggaggaagcttagcgaggatcgaattgaagcaaagaactcaggcgagcgagctagctagatcactcttcttcagttcttctgctgctactgctgctgcgggtgacgagacgagcataaataggcggggagatcgagaaggtcacggggaggtggggagcggtggtggtggcggaggcggcggccacgtcggcgggggagaaggaggcggcgacgtggagggcgacggggtcagaggttggtggtcgcggtcgacgtggacgtcaagggcaccgtgcgtcgcccgccaaaaaagggtcaggaagagtccagaaggcgcgcgccagtagtcgcgggggcagggtggcggtttatggggccacgtgtcagtgaccggtgatatgcttatagccttatacaaggctagtagcacaagtggctgtgtatggtttttaggtggacaacatgacgagagacgcgtgatcaaactcttcgttacatgtggttgtgaaaattttgaagacgatggtcatttttataatgattttttattatttattgcttaattttaataatcttcttccttatatatatccggcttcacgattttttaagtccttcgcacagcatatctggtttttagaaggacccctatgtaaaataacatttcaggagaactgtttgtggggaacctagatctaattacgcataaatcagagggttttttcgaaaaattttcactccgcgcactgttcctatccgacgtggcatcgcccagcggccgctccatgcgccgtcactatagccattttagttgagtaatattcacatcaacttctgtaaatggtaactttgctcaaaatgtacattaatatctatttttttatagtatgcaacattgttttgttttaatccaagagcttcataattgttcacttggtgggttacaaattattttctttgtatagctaagtttattgttggatcaatgttccggaacttatttatttcatttcatgatctggaatataaatttaaagcagaaagattctccgtagaattgaatatgttgtcgaagggagactccaggaccctaggttactgttacttatcacaaatggcacgcaagaaaacaaaggagcgtggtgggcatcgacggtctcttcacctcctcccgcgcatacagcagttggagcttcatgctcaccttgaattcgatttcatatggtcaattggaggaggccagatgctggctgcgttgcccctagctccaaaccaggtcgtcgggcatgcacatgagaaggcacatggcacacaagggagaaggctagggctgggttgtgacttgggaggaagagggggctgtccacacacccgtgcctgcttatcggtgccgtgcgcgcgagaaggtgaggctagagacaaagaagacatatgggttaggattgggagaggagaagtggtgcgaagtggaggtcgccaggccatggcgttgcggcggcgaaggttagggaaggtgaggaggagcgatagaggcatagggagaaatcatgatcatgaggccaaaggcagtcggacttggatgatggatgaaacggagtatgacgaatagaaaattacaattttttaagtagggttagatatccattgacataggggcaatctaacacattaagaatcatagtccactatagataaatttttatgccgggttcgtcaatatttttgcattgctttgagaggcctgtttacgaaaaacgatttttctatacgtgtctgaaccaaacaacatccaaaatatttttacatgtagatgttcttttagcccgcatgtaacaaaatagggtgtgcgtccgcaaaaatcatttttatagtgactaaaacaaaacaatgttgcatacttagaaaaaaagacaaatacattatattatattaatgttaaagtgtacttttgagcataacattgataattctcaactagaacggctataatgaattgaaccatctctgtgaaccgttgccaaggatatagaaaacgtgcagatacagccagtatcgtaggcaaaccatcacgaacgacgtgaaaatctccgacgcgttcgcccgtagtatgggcttggccatctccctcgtgctgcgccagccgagaaacccaatcgcagcggcgtctacggcccacacggtgccggcaatggcgacgagcctaacgtccggtgcggctgcctgccgcgccgccgtcacgaggcggaacagcagcgctagcgccgccataggcaccgacacgttgcaccacttgagcaggctgggcatatcggacatggagaaaccgtacttctccctgaagtagaggaggcacatggggagcgcgaagaagacggcggcgtaggagaggcctatccaagacacgccgccgacgaccaagccgccggctatcgcgcttgcggctgacacggcggccacgaagcgaacgcaggcatagcggatcaccttcaggtggggccggtcgtaggcggcgaggtgcttgggcatgtccaccgggtaggcgcacgtcttctggaagtacgagaggcacagcattgggagcgcgaagaatgcggcggcataggagagacctgtgtatgacatgccgccgccgccgccgccgaccgccacgccgccagcgaccgcgcacgcggccgacacagccgccgcgaggcggacggacgcatcgcggatctcgcccaggtcgagggcgaagaggaccgcggcggggtctttgggattgtaccctttcatcatccgctccagtgccttcccgctctcctcgtactgtttcctcctggtgagagccatggcgagggcgccgccgtgcgtgaggcaccacgcgagggacaggacggcggctacgtcggcggcccagacgacgcaggtggcgagggcgacgtcgccgccgccgccggccctcgcttggttgagcaccgccaggacggcgacggagagcgcgacgggggtgaccgcgacgcacgcctggacggacagcggcgtccgcgcgatcgggaactcctgccgcaggaactcgagcgcgtagacggagaacgggagacggaagaggagcgcgccgtagccgaggacgaacgcgagcgccagagccgccggagcgccggaggccgggtaggcgaccgcggcgccgaaggccgcgtacgccatcgacgccaccagcgtgatgtgaaccacggtcttgaaccgcagccctattgcgtcgattctcggctgtttcgtatccattatggctcctcctcgatcaaatcgttactacgtctacgtgaaaagatcaaaagaagaggcaataataggttgccttatatatataggagtaattaaggaccgtttcgtttcgttgtcggttggaataagtccatttgcctccctcaattcttgccctttatcgaattacatccctcaaccgcaaaaccgggtatattacctcccccaagtgttaaaaccagtacaaaaacaactcccttggtggtttttgacagtggttttactgacgtggcttcctagtcataaaaaaattaaaaaatacttgaggacccacatgtaagtggcatttctattcttcctctcctccaccactctcctctctcctcccccttctctctccccgaacagagcacggccaggggaggcgccggaggcgcgtgaggtgtggggactgccggaggatgcggcgggcgcacgccgcgagggagaggatccgctgtcagcagcagtagatgcaggtggtagcggttgcagcgggggagaggaggatgcaggagctaggaccgaagcggagctcgaacaaggacccggcacaccaaggtggacgcccggggacggcggatccggatgccggtgctgtgcgtcgcctggatcttccagctgacgtgggagctcggccacaagtccgacggtgagaccgtccagtggctgctccagcaggcggagccggcaatcgtcgccgccacggggacggggaccataccggtgtcggcgctgacatccgtcgcaccatgccggggctagagctaggactctcacaggacggccacatcagcgtgctcgccgcacagtcgctcagccagttctaccaccaggtcggcagcgccgatgccgccggtcaactgccgcacccgcaccaccatcaccaacaccatcagcagcagcaggaggacggggaggatgagcgctacgacggcgagtccgatgaggagtccgggcagtagtaggcgcatagccaattgttcatccatgcatctcacgttgtctctttggagaagaaaaatagaattccaggaaggacatgcagctaatggaggggggatgcttttgttactgttgggttgttcttcatgaggttttttatgtctgatttgttcctcgtgaggtgtcgaagctcgaaagaggctaccacttgctccggcgacttgttgggatggatcatgatcatcttcagttgttactcctgctgctccatggatggtcgccagtttatccccctccaagtgtttaggtgaaagcttaatcttttgcactccacagtcagcacatgacatgctcttcgaaaggtagcctgatgagcttatgtattttgctggaggttggcggcgcggatagacagcaggaggatgtgttgccggccgagcagatcgacgccgtggcaggtgaaccctccccgcgtgggcgccgcggccggtgatcctctcccttgcggcgtgcgcccgcatcctccggcggtccccacacctcccgcgcctccggcccctctcctggccgtgctctgtttggggagagagaagggggaggagagaggagagtggtggaggagaggaagaatagaaatgccacttacatgtgggccctcacatatttttaagtttttttcgatgactaggatgccacgccagcaaaaccactgtcaaaaaccaccaagggagttgttttgtactggttttaacacttggaggaggtaatatacccggttttgtggttgagggatataattcgacaaaggggaagaattgagggaggcaaaatggacttattccttgtcggttcgatgtttttcttttcccctctttcgagggggccgcctatgcatcactcgggtgatttttgagattttttctttccttggatttgcatccaacggactacaaaataaaataattaatacaaatttacttacacaacatttttatcaaaattacagtgcacttacatgttatatcaactaaatttacatatgtaattttagttatataggactgtaattttatatttgaaataaaataactaatgcaaatttacttacacaatatttttatcaaaattacagtgcacttacatgtcatatcaactaaatttacatatgtaattttagttatataagactgtaattttatatttgaaataaaataactaatgcaaatttacttacacaatatttttatcaaaattatagtgcacttacatgttatatcaactaaatttacatatgtaattttagttatataagactgtaattttatattttaaagaaaataataagtacatatttacttacacattatttttatcaaaattacagtgcacttacatatcaaatcaactaaatttacaaatgtaattttagttatatatgactgtaattttatattttaaagaaaataatatgtacatatttacttaaacattattttttatcaaaattacagtgcacttacatgtcaaatcaactgaatttacaaatgtaaatttagttatataggattgtaattttatatttcacgacaacgacaagagagacggtgtctctcgtcgatcagtattggccgtgctaccggcggctggctcgccggtcagaggccactgtgtcatcgtgcttctccgacacggtggccgatgtgctggtgtccgacgcgccggctgacgagcctgaaaaaaacgtgaaatgtcagaaaaaaatcacgcgagtgatcgttagcaaaatcgctttcgggtgaatgggctccgcgagtgaaataaatttagaaattgggccgtattggcccaatgtgagattcatcataggcagacaggccggccgagccgtattcggcgccaaattctggcccatccactgaccagcagggccaacccctcgacaagtgggccggcacggcacggcccgttagttgttccgagcccaaacgtggctgggccaggacgtaaccggatcaatttacatataggaaagaaaagaaaaaaaccttagcgtccaaaaatcattgtgcctcgagcactcgagtatctccgccgtcctttccgcgtcaaagaaaatccccccgtctcgtctcgtctcggcctccgcccctttcgtcctcgccgatcccccatctcgcgagcacagcaagggttagggttggggcgcccatctccatctggcgagcagaggccggggagggaggggcgccgtcgtcctgctgcatcctggtgagcatccacatcctccccgacctaattttgtctcgaatttgcttgcgctaaccctagctttttttttttttgtgggggagttaaccctagcttcaattctagatctggaagaagctcctctattaatttcagggcctaaactttaaaataacagtttgtttgttccccaaaagaagtttgtgagggttcaactgaacccccatgtcccaagttggatccgcccctggtttgtttccaataaatatatataataatagtaaattggggattcacttgaacacccatgtccaacatgaggtccacccctgtgtagcattggacgctgattgagtattgcaatgtgtagagaattcgaagggtgatcctgtgctcgggatagtggttttcacgcgctattgtgtagtagcaatatgcgccatctactcgttatcaccattttacctagtatattgcttcttggtaggcgcattggtagtgatattgactgtagtttaggagatgcgatgtgtttctcttccagaactgacattgtttgtatgagtcacagtagaatcgtattatacttgctactatcctatttctgctctgttgccatctacctgctggttatgtgttggctgcatgtaagctactgatcaagctcgtaatgggtttattctgcgaattccaggcgagatagaagcatgatggcaaagaccctgcaagggactcaacagcaatatgcagcaagtggatttcctacccagcaataccccacaagtggctggacacaatctgcagctgaaattcttcagttggataatatggatcaagatacatccgtagttcgcaatattattcaccgtaaaatgtaagttcttaaaccaccaatattgggattagctttgactcgcagattactagttgctttatactagcatgccgtaccaacaaagtatacactgtacatatgttttctgcaactttagttgaacatttcaaaaactgcaatgctactggcacgattttatctaaaatctgtgactgctagtgaccagtctgtctgataacatcacgtgcttttggtggcttgttgcaacttaagttgtagcaaaccgataacttattgcagttattatctcttgttcaactatatcctgattcttttttcttatccagtgtagagtacctaaatgagcggaaggaattctgcaactttgacctatcctttcttatggaaattggaaaatgtattgaccgacatctttttgagaaagctgattcaaaggtttgtgttgtctcttgctgcattagaactattataggatatatgatcacctatggtgctttaatttggtgtggtttctactctaatattggacaatattgaacttatctacatgctttattgaataaatacaaaattcagcatattcttgtaatccttaaacagaattgttactgctgaacagtttggtgtacttagaagttgattatttggattcatttatctaaatagttctcagtcacttgctaacatctgattctctctcagattaagtatatggatcttgaaactttaagaaccaggttgaatgctatcgtcaattctgcatcatttcggggtagtatgtttcattggagtgcttcagcagcttcatccaaactaaactcacaacagctgcctgtgatggaggtgcccatctaccatgatagagttactcctggacctaataatctgccctcctgtgcatataatgtatcctccactcagggtgagttgagatgatgagttacctattttaacctcacaatacaccttaatttttttaattctttattggcttgattttggcaggatataaccaatatgaaaactgtatgggtgctgctaactttgctcattcgttggctgataaacccaagcagatgcctgaaagattagcaaacaccatttttacctcatgtgcatcaactctaccgaaatgtagccctagtattgatgtactgcatattggccatataaaagaacatttctcaggtgagtttacatcccctttcttatgtctgaaacagagttgagctgaagttatttggcatcataaacactatggtcaaattttgccaggtgatgcgtatcaaaatgatagttcacaaccatcaacctctgggagttctagttctttgtcagcagtgtgggatcaaacaacatgttctagtgcaatgagaacacttccgatggattctttctcaacagtgaacggacaaaacctttccacaaacaataaaagtttgtatcccacaaccggtcagggacctttgttgcaacaatacatagaatgtgagatgaagcaagagacgtggagtcggtcactagagcaatcagatcagtcaaacattaccactggaaaccgtgacttgtatcatgctcaaattcatccgtacatcaatggagagcacaaacgggatcgatgcattcaaatgaaagaaaaacttgggcatacttctgatcatgaaggtttctccagggagaaaagctcaaatttaagcaaccactttatgcatcatcagcagggcttcatgactaattatggtgcttgtagccctgtaagcaagacagtggatagagctgaacagacatcaaatagtactgtatcaaagccgacttcacctgcttcagatggatcttctggcaagcattatccagcaaaacgcttgaaagttgatgttccccatcttgtccatgtcaatgaaatggaggcttcaaaggaacaacaacctgctgccaatgagacttatgcatctgctgaaacagtacaatctgaagtcactaattcaccaacaaaatcaccatgttgtacttccttgggggacaacattgcttgcaccgataatgtacatggaatggatatggtcagattgtcggggagtgctgtacaaactgaagaagaatttcgtcgtgaaaatagtgacattgagatgaaggatgcaaaggttgatttattggaccaaacattgtcaggggacagcctgagggcaaggaagagaagaggggcctcagtactttatgcattaacttctgaggagcttaaagatcacttgtgtactctgaaccatgatacttctcaggtgagtgaataacctgttggatcttgtatgatttatctagtattgtaaagcacttgattattattggttgatgtagtctagagaaattttcaaactgagcagctgcaaaattaactaaatattatgtactttcaattgattttcatttggtactaagattttgggttttgttgtcactcaagctttcttgattatattgtacagagtgtgtgcttgttttaagcaaagtttatatctcttaacatgattaacttattttttgtagagcaaagtgccgactgaagagctgctatcagttgaaggcttgcctgatcagaacacatgcaatttatgtgggatggaaagactcctctttgagccccctccacgattttgcgcgctctgttttaaaataattaattctacaggatcctattatgttgaagtggaaaatggaaatgacaaatcttcaatatgtggcagatgccaccatcttagtagtgccaaagccaaatatcagaagagattcagctatgcagagacagatgctgaggcagaatgggtaacatatgcttctcttatttctctctagtcatttggaatcatatacgaattactcattttttgtttaattatgccttttcagtgggtccagtgcgataagtgcaaagcttggcagcatcaaatctgcgcactttttaaccccaaaatcgtggatccagaggctgaatatacttgtgcaaaatgtttcttgaaggaaaaggataatgaagatgttgattcacttgagccatctactattctgggagcacgcgagttaccaagaactagactaagtgatcatattgagcaaaggctttctgagcggcttgtgcaggagcggcaacagagggcaattgcttctggaaaaagtgttgatgaggtagttgtgttatgcttttcttttataccttgtcccgtgtacagaatatgctggtgttgcattctgctaccgttgaacaggctacctcactgttaacctattgaaccacagccaaaagttacatacgtctttccaattgcatttttgtgcttcttgctctatgtgctggattgaaggttacaagtaacatgttagtccttatattatagtcttctaagttgacttagataattcattacatgaatgcatctttactgtcatacgtttctttttattttttacaatgtactgatggcatttcacttaatcatgttcttaatacttctcttggtgcatctagcaatgtgtatttatggcttcaggattgcagctgattacacatgaattcatctttggaacacatgttgatgaccatatatttgttgcgtttcagtatcctttttagtgaaactacttttttcttctttttccttgcattttattggattccgataaaagttggttctgcatattcatctgatttagctgaccaagatgtcatattacaattcatggtcaaacttggaacataaacttgtggatgctttgcttagtcttatctgatcatctatgctgatcttaatgttatttttctgcctctaggatttttattacactgtaatatactggagaaacttattgggcgaacttttatggtccaattattaggtaccaggagttgaaggtcttactgttagagtggtatcttcagctgatagaacactgcaagtccaaccacgtttcaaggatttttttaaaaaagaacaatatcctggggaatttccgtacaaatcaaaggtgattatgtgatacttatactttactaatgctattattataacatccatttaaattatgctttcattatttagtggataatgtgggttaccatttccgtgttttgtgcttgtgcaggccattctcttgtttcaaaagaatgaaggtgtagatgtatgcctgttcgccatgtatgtgcaagagtatggttcagcctgcccatcaccaaatcaaaggcacgtttatcttgcatatattgattctgtcaagtacttcagaccggaaatcaagtcggccagtggagaagctctccgtacctttgtgtatcatgaaattttggtatgagaatgcataatcattaaacacttagtgttcttgatcttgatttcagtttatggatctcatgttggtctgattatcttccaatctgttttcccccagattggctacttggatttctgcaagaaacgagggtttgtaagctgttccatatggacttgcccatctacaaagcgtgacgattatgttttatattgtcatcctacaatacagaagatgccaaagtctgacaagcttcggagctggttggtcttcatcatcttttacagtcaatcctaaaattatttatgggccttcatttgataatcttttcaatatatttaggtaccagaatttggtaaagaaggctgttaaggagggggtagttgtggaacggaatacactctatgacttcttccttcagcccaccaatgaatgcaagaccaatatctcagctgcatggttgccatactgtgataatgatttctggcctggggaagcagagaggctccttgaaaagaaagatgatgacacctcacagaagaaagaaactcaactaggaaggcttctacgggttgccaaacgtgatgaccggaaaggaaacctcgaggatattttacttgtgcataaggttggttgtttaaatcatggtgctccctttcttcagaattttttttcgccgggccttcttcagtattttaggcacttgaccccttaattttcattgttggcagcttggagaaaggttgcgaaccatgaaagaagattttttaatgctttgtctgcagcaattttgcaagcattgccaccatcctattgtatctggtagtagttgggtttgcaccagctgcaaaaacttctttctttgtgaacggtaagcattcagtcatgtaaacttttgtgaccatatagaatgcatttcccatactgaagaactttctggaacagcactaggggaaatgtctgctgttggtaaaaatatataattgcacatggcacttgcatagttcaaccattctagcttatacagtgaccgtttgcctgtcaaattgcaaaatgaatctacattcctactcttttgttgttattcaattactctttgtcgttaaggcacccattatttatgatgccattcttatttgtcctcgtagttgttatgctgaggagctgaatacccctctgaaggacaggcacccagctacaacaaaacaaaagcatgcatttgaaagagtacgtatatgaattcatctatttaaggtagctacaatctgcctgcatggaaatactaaccagattactaatctcctctgacagatagaggaagaacctcttccagaaacggatgatgtagatccaacaatggaaagcaagtactttgacagcagaatagatttcctgaagcattgtcaagacaatcaataccagtttgatactctccggagggcaaaacattccacaatgatgattctttatcatctacatgattcaacttgttcttcttgtcaccgtgccatggatcaatgcttggcatggcggtgcttggtttgcctaggctgcaacttttgtgattcatgctataaacaagacggtgaaagtttgcatattcataagttgaggcagaaaaaagaccatcacgtattgcagaagtacactctacaggtatccttaaattggtagctgaatctttttcatctcctatttgtgtttttcatgaatgtttattatgcactcgaaattaacatcttctgattttttgggaacaactctggggatctgatttttttttggttgtttgctcttcgcatgattatatttggcataaactgtagaatataagtgagttgcactattattatttgttccataattttatccttttggtttaatcttgagcatatgtgtgaagtgtatgcttcactattcttatgtgttgcttcatgttatgttttgtcccagtattttgtgactgcatatccaaattttcaatcaggatgaaaaatattctatgagcttttagattctaatgtggtaattatgtggtttcatcccaaatattattttctgctagtgatatttacggtgcctcttgctaatgaattggatgctttcaaagcaggactaccttgaaggcttggtgcatgcatcaagatgttttgatcgaagttgcacttccaaactttgtttgacgttaaagaaactgttcttccatggtgtacgatgtcatacccgtgcccgtggtggaggaggttgccatatgtgtgtattcatgtggaaactgctgttcacgcactcactgctttgtgacaatgcagactgttcagctcccagatgcaggtaaagtgtgcatcacccgcaatattgatctgccttccggagttgtgaaataattttcacaattttattttttccaattggcttgttaattatctttttcccttttaaatcttttcagggatataaaggcatatattgctgacagaagcatgacagaccttagtatatctggatgagcttcatgtgaacttgtagaagttttgttagacaatacaatttgttgctagagatgcaataagctggtgttgaccatagtaagtggcacagtagtggcaatagcagcatagtttcgctggtttccccagtatttgcatgaaggcatgcagatggtggtggtttggggatcaactttatcctcgtattttcttgaatcgcctatttcgactttcgatggaggcatagcaaaaaccttacgtaggcaatctgacatgttcccgtaaatacctgtatagttccttattatagctagattaataggatagaggattttcattcctttttattattccttttcttgattgtattgaacaaaggcacattttgttcagtgtttctgtgccgtggcaaaagtccaaattcaatgaatgtgtatatttactcccttgtcgatcgacatgtcttagtttatgagaccaatctctgactgtatctatacactgacctttatagaaccggatattttcctgataaaaatgaccctgtaaatctgtaaaaatggaggcaagctaatcgaagggtgcaaacgtgcaatccttaaattcgaatttcactcgcaacaccaccgtctacgattatattgaagtcgaattaagagcacccaccccccccaaacacgcgagaccacacggaggagctccctcgaacgtcggcaacccgacgctgctcacgtcgacgacgtacgttcgcgaacgacggcgtccggcggtggctttggccatggacgatctccgagtcggaccacagacgatgatctccacgtacgatgctgcacctcctcccctgtcccgctcggtgtgtactcccctgtcccgctcggtgtgtactcctcgatcccggcctttgtccacgaggacgggacgtacgtcgcggtagccatagctcatcggcgcgcacggtgagggcgatgcgcgtgggagggagccccagcgcgcgtgttaattaccttcacgtagcgatgccgagggagagttcgcctcacgagtcgaggagcctgtgtgcacctcctgcgtcgccgtcgtcgctgcctcatcaggatctgaaaccgcgtattataccagccagagccaggttggtccggctcgggtgaaaacgcttgggcgtggccgcgtcgtgagcggctgagaaggcacggtttgtgccgggatgtccttttttttttttctagcccaaaaggctcagcctaacttgtctgcacctggaaaatgtgtccatgttttcgtgtatgcgagtttacagagcgattcgttcgcacgggccggtgtactagctaaaaagcgtgcttgtgtggctgcgcggcgattgttgtacggtaaaagcacacagcggcttccagacgccggtacgccggccgcgcgcggcccaacctcgtaacggttttccccctcaaaacatgccagccaagcgaccgtaagagcaggtacaatagcatgctataagccagctgcaaatatattttaaacagataaatgagcagagagaagagcagcgggctacagatttatagccagctatagcacggactccaagacgcagtgtgtgtatgacaggtggggccaggtattattagtgtagtatgtaactattgtatgaataagctattagattccccgaaaaaaaagctattagattgactataaatgaattaaagctagtagttggctatactattaaacttgctcaaaaccaaaagtccctgatctcaaatttagcccctctctcccaaacaccccttaaatgacctagcgtgacaaacattttatgatctccggatataaaataaaccacctcatattttaatttgtgccatgataggtcgcatcaagccaaaaaaaaaccctgaacaccgtcgtttaaggaacacatacaacttttgttttaggatcaccgaaacaatagttgacaaagactgatgctctatttgtttcagcttagaattattataattattagttgataccccgcgttttgttgcgggatatgtggattaatgcatgtatatatgatttacggttttgctagctaactgtcgatagttttcaatcctgaaaactgtcaattttttggtcgttgattccgcgctaagatttgtgctgagatattttgctatcagatctaaaccctctttttcacaagctagtctcatcatcacatgtttatggcagatttgttcaagttacatctaagttacattctagttacatgctaactacattgtagttatactattgttatatacttatattgtaagtatagtgtaactacactataactaaattgttatctctatataagatataaagttgcatatattgttttaatacatatatacaagttattattattatagtatagttctaatgaaattatataatgtagttagattcgaaagtttttcctaaaaaatactcgacagctttttagctaatcccatgatttatggagtgaaatggtagatgtatatgtttcaataatgtaaaaatggtgtagagatatataacgatttaatattgcttgcatattgagttctaaaaatacaacaaaattataattgatatgtcatgtttgcatgatatttaaaatactctaaataataattgctaatgggtgatgatatggtacacttgcatgtgatttaaaatactctagataataattgctagtggatgatgacgtggaacagttacatgttaagctttagtagttagtggacatcaactatataataagataggatttggattattagtaataatatgaagcaaataagtggattattatgatagattattataatttataaaccagattagtataatctggtagtctcatctaaacgtttttttttcatattattgtccggctaaagacccactacccttaaaaattttatgcaaattatccaccactaccatcgaacctatcaggttgagcgcatccgcttcctctctctccagtcgcgcgcgaatctccctcggccgcacgtgcatctgctttctctctccctagtcgcgtgcaaatccttccctaagctcccaccctacactccggctccttcccaagccatgccgccgccgtctctcatcctcctcccactccgcaatagcttagggtattatagacattagcttttcaaacccaataatctagagaaaaaactcataacttattataatccagcttatagtaatctggtttatattagattacaataacctagtgaaaccttgagttgaaacaaacaaagcttaagatccacgagaaaaaaacaagaagaaacacatgcccaaagatccaccccataagaacaatgagaaacacagcgccccccacaaacacgcaggacgacgacgacggcatgcaactgcggcggcgaacgtcgtcgtcgacaacgacgatccgacgatgcccacgtcgtcgacgttcgcgaaccacgtcgtgcggcggcctgggaatcgatctccggtagagctcgacgatctcgtctatcagcgcccggacctcctccctgtcctgcacggtgtactcctcccagctctccatcccagcctcgaggacgcggtggtagtaggaggattgcagttccttcgctcgaatgacgagagagcgatgggagcccaggcgtgtgaattttaagtacctaccctggcatatcgagtagaggccgcagttttctctcaggagtagcctggttcttctgcctattcgccgtttcgtgtcgatctgaaccgagtaccaccacggcagccgccgtctcctccgcttggggcgatttgcttgtctttcctgtaactcgttttcatgttgcccctccatgcgatgagtttaatttggtcctagatgcatgtcattatgttgtgtatatatatagtttgggaatatcaagcgaaagagagagagagaatagtaaaagaaaagcagaaaagaaatttgacaacctctctcacctgcagattttcgcctgtatagtatattgatgagaatacggtacgtcctgtccggggaacacgtcgagaacacacggaaagatcgatgaaccaaataagcgactctcccatccgagataccgtgtgttgactctaatcgcattctactaggattaggattagaaatatacgtactagcaatagagttttgattttatcatgaatacttgtacccctccatttcagattataagatattttgactttggtcaaagttaaaatgctttaagtttgactaagtttataaacaaatatagtaatatttacattatcaaattagtttaattaaattaataattcaatatatttttataataaatttatcttgggtaaaaaatattactattttttttctataacttggtcaaactcgaagtaaagtcaaaacatcttataacctgaaacggagggagtaaacattaaattgaaattccacttgtataattgaacaaggttaaaccattgagatcgtcggaaactgtcaagcaacgagcagcaagcagcaaccccgcccgcccaaaaccggataaataccaaactgaaactgagaccgaatttaccattcctgatatttttatgttgaaattcagtcttcacttttcaatgaccgaattaatcgaaaaaccgaataccaatcgagacctaagtttccacccctacttctcacgcttcatcttcatcatcttcttctcccccgacctcggtggtgccttcggctgctgccttcagcgtggaagacagagcctccagggccgcagcggctgggtggggattgcgtcgtcgtgcacgcagggctgggggcgtgctaggatgcatgttcggtggggctgggggtggcgacagaaaaacggcgtggaagaggtatgccgacaccgtggcgcgtaacaactccatggaacccgaggtctccacgctctcggacaccggcctccacgcccgcaccgccaagctgcaagagcacacgtgccgaggagtccctcgattccctcctgcccggagctcttcaccctcatggagaagggagggaagaaggggagagagggagagagagaggagggagaagagttggccgctgacatgtgagacccacgtggattccacccaccacgtcagctaaaaccggccattatactaccaaggaaccaaagttaacattgtactgtgagttggggaatgagctatacttcagtgtttttgtctagggataaatattagactcgacaataaattgagggaccctaagtgaacttattggttacacctttatgcgatatggcccaggcagcctggcccagccagctatggcatcgtcttcctcgcaggcgcccccctcataaggaataagttcaccagagatccctcaacttaacatcgagatttttcaaggtcccttaaccacaaaaccagaaatctccacccctaaactatacaaaaccgttcactcaaggtccctaggtagtatatatgggtggtttcgctgacgtggcattctagtcagaaaaaaaaattaaataaagcacgtggagcccacatgtcagctgcatatcttattttcatctcttttcttctcctttctctcttctctcttctcttctccctcctgctgctgctgctgctgctcccatccctgccccggctgcggtacacgagatccgccgccaccgccggagtcctcgtcgttgttgccggctggagagtgtgccgtaatgttgggggaggtcgcgccgggctcctcgtcctcctcgctgcagctgcccccctccccccccgcccccgcaccgtcgtcgtctcccccgctggcgccggccagttcacgtcgatcccccgcaggaatggcatctcgacgtcgaggcacgccatcatcgccgtcctcccccgaccttcgtaagatccatgcatgaaattgagacgccaagattgcagcatgcatgcacgcacaacatcgacgtagtccgtccatctatactcaccggaggaggaagaggaggagaagaggccggcgccgctgttccagccgcacaattgctgcgtctgtggggcggcaccacgggaaggctcgggtgaacccaagcctgggaagcgcgtgcaggtgaggtcccacgccaggtcgacgcggcggtcgccggcggcgcggaaccgcctcgtcccgcgctgccgccagaggagtcagggacggacgcggaaggccaagtgtctcctcgtcgggtgtgggtgctggtccacgagggcgtggttcctggagtccggcgctgagcacgacattgttgtcacactggacggcgaggtggaggcatcaatgctgctgctgcttttcgctcaatcagatgattcgatcacattcactgctactttccgtaaaaaaaaacattcactgctactcgagatcaagacttggtactactcatcgattaattaacttgtactcaagacactgatactgatcaatcaatcaatcagtggttagtgctcgtccgatatagaaaggcaaaagacgcaggcaagaacgaggagaggacggacaggaggttgcatagccatcagaaaaggaaaagagacgggagagagagagagagatcacggtgatggtcggagatgcggaggatagcgacggcgagagggtgcggctgttcgtcggccaggtgccctgcagcatggcggaggaggagatcctcgccgtcgaggcggtcacggcgtcgtgcacggcgaaggacaacgccgtcccgtcgggaggaagatggctgggccccgcggggacggacgctgccgtcacggacggcgcgcagcggaagcacgccgccatcgccgctccgcccgccgccggcctcctcactgaataagggaagagggaagagagaaaaaggaagagaaggagaagaaaaaaacgtgcagctggcatgtgggtcccatgtactttttttaaaaaaattgctaactagtgccacgtcctatatatactgcctacggactttgactgaacggtcgttttgtatagtttaggagtcaagatttctgattttatggttaagggaactcaaaaaatctcgctgttaagttgagggacctccagtgaacttattccccctcacaatcgccaccgattcggcaattcttacagtccgccggcgactgcggatgggatatggtatccagttcgtcggcagccaccagatgtgggccccgacgggtagatttggattcgctagtaataatttttaccttttatccaccttcgagagttcgagttactgctactgattagagtaattaagtgagtatactaatgtatgacatttagattactgcaaaaattgatacatcggtgcggtttggtgaatcctcctcgatcaacagctttgcaatatacatcggtgccgagtaatgctctagttttaaaccattttttccccaaaaaacatgagattaacgaataattaccgtcagatcttataaccacatggcttagaacatgtacaaaggtagagactaatatgagttctctatattaattaatatcactagagactatccttctataataatagagataataagatttctaaaccattaatacactaaatatttttttattatacttctttccttttctataccctcatgcaacaaactttctgttaataaatgcaaagagtcgactctgagccgttgtcatgcgtagcaacgatgtttctcattccttccttctctttcttccacgtcaccaaatttacttacatgacaacgaaaagagcctgttattaaacaccactgtacatcccttagtgaaaaaaaaatcaccgcactgtagggaggttagatggtgataaccgtaactaaccggcttgttcagcaagccaatgtgccaaacaccgggatgcgattagaactttctcgcccctctgggctctgtctccgttaaagcggcaaactaatcgacgggagcagcccatttccagttcatcccacccctcccatcgccgccaccgaccactccaacgccgccgccgccgccgccgcttcggaagttcggagcagcaagagacgcatggagcatagcccgcacctgttcgacggcgcggcgcccaagttccggcgggacgagaggatggcggcgccgccgcgggaggccacgtgggtgatcctggcctgcgtcccgagcgtgtcctcttccgacggcgacttcgaggccggcgaccacctcgccttcgactggcgcgacccgccgggcgtttccctccttaccttgcgccagagcgactctgtctttgtctcccccgcgcctcgggatttctgccccgaccgcgacgaccacccctacgtcgtcgccgtcgactccgccggcggactcctgctccgcggcgccaggaggagcgcccacgatttcggccccggcgtcgcgctcggattcgaccctgcaccgagctgcgccaacgacggcggctacatcctctgccacgctacgctccgcatggcctacctctacccgccctgctccgacgagtaccggctcctctacgccgggaacgtcggcatgatccgcagaacggcagcggatggcgaccacccgatccgcttgttggccgagctccagatagagtccggcaatggcatccaccgtgccaccctactacgctactcccaggagctcggactcggagggtgggcttcaacgaaggtcaactacccgccaggccgccggtcgtggtgcggcgacggcgtcatcgtccacgccgggatgctctggtgggtggacctctccttcggcctcctcacctgcgacgcgttcgccgcgaagccagacatgcgcttcgtgccgctccctgagggatgcaagctaccgtactccagcgacgcggaccacgccaagcaccggtgcgtgaacgtgagcgacggcgagctggcgttcgtgcagatccacgactacgacaccgccgccggccgcggcgcgccatcgacgatcatgatcagcatgtggacgctgcagcagtctgatgcgggggaggagtcggtttggtcgctccgccaccgggtgcgcgtcgacgagatctgggaccacgtgacataccggaagaccatgatgccgcggcgcgttccggtgctcgcgctcctccaccccaaggagctcggcgtggtgttcttcttccagatcacctcgcggaactcgtggatgttcgccgtcgacctggtcaccagaatcgtgctcgagtgcaagaagtacaagatgccccagctgccgacgatgtaccactcctctcgccacgtccgcgcttgggagctgccacattcgatctgccgcggagaggatgatgagacagatggtacgtacgctgcgctgttcttcacttctttgctctgtctcatcgctgcatgctgatgtgctttgtccatttgtgctattcatgtttgagttattttgatgctgggcatggtctgcacatctcatttggccggttcatgattaatcctgcacaccagagggtgcatctaatctagcagatacagatttgcactgtatagttcttttgacattgtaaattaatgggaatcgatcaaggactatatgtgaatttgcatgtttagtaccttctacattttagtagttacaatgttgtaaatgctgtatgttgatcatgtatctgtatgtcatttaacactacggaatactgatagaatatattccataacagcaacttcgtttgtttgtattaatgaccctgaagtctgaaaatcactgagtataatatagacatatatttactagtgcaagtactgttgcaatttagcttctggaaaaaaaatacataagctaagttcctatcaagttattgaacagaggtttaccattttatgactaactagaattgcttgtgttaatttgcagaatctgacggatgagctcgacttgaacttttcgagagacaaagctgatgaactgctgtcaaccactggaaggctcttcatcaatcctaggttccaggaactgaggaatgccactgcttttcctaagtgagcctctttccatcctctttagatcgccgaccactccaattcacatgcactcgcatacaagagagaattttcttcactgaacctcatgtgtgtgttttcttctttttcattcatcaggtacttgtcatttgtcattgtcaaggctaccgacgcatatgaggcatcgtgtctgatgcgagacttcgtgtcacatgtctccatggacggttcaaacatagttcctagagtttcaggtgaaagtattgtatgaatagttcagtgttgagtttcagatgaaagttttgtttggaaatcttgtttcttctccctgcttcctctgtttgacatatccggggcactaggcagttcagaaaccaaacgccctgactgatgctgcgtagtgtctttaattagatatctggcttaactctctgctatcttggacaaccagtgtttgttaactgatggatggctgacgacattgttcgtgatggtacgctgagttctagttctcgcatatttgatgggtgattgtttagatttcctaactggtatgcggttgagaaattttatgatatgtgaattcatatttttactatatatcactgccatacttccgtacagagttttaatactatgtatcagtgaatgtatgttcaggctaactcgtttagtttgctcctgttcctccgtttgctgaacctgctagaaccatacgaatacgatgacgattagtattgtacagaacaattaggagactattagttactatctcagttacaattacagaacgtctgaaccacggttttgagcagccgcagaataattctagcaaacttttggcccaccgtttcatattataaaccgtttaactttttttcctaatcaaactttgttaagtttgataaagcttatagaaaaaattatcagcatctaaaatataaattagttttattaattctaacgttgaatcaattttgataatatgtttgttttgtgttgaaaatacacaagtgtgaggattattccaacaataagctggtaattagtaatccgtacagattgaaaggctacagcgctgcatgcatgcttgctcctttcatatgatcttgaatattcatactctgattcataaaactgcatgctagacagttatcgctgtctaataagtaataatgcaagtgcaaaagtattcaaagatccatctaaaaaaaaggacgaagtgcgagggacttttagtactatgattgtgtactgatgctagcaccaaggctggtttatttcatcatggaaacatcaactgcatgtagagcatatcctcatttagttggtgttagtggctaccatagttatgaagtctgaaaattagcgaatgtaatatgtactggtgcaaccgtataatagaattaatgtactgttgcaacttgcaactgctgggggtttgaagcttgatttcacgtgacaaatatagcatttacctgatttgggtttttgttaacatttttacagatgactagttcctcgcaaactatcaaatactataaattagcaccctttttttatcaactagcattgcttgtgttagcttgcaggatcaaataagatcgactgtttgaactttctgtatgacaaattgatgaaatattgtcataaaccacgtgtttatgacaaacagttcatcgattaatgtcttgttcacggcattcctcaactgtgtgtgctggctgatgcgtgctaaatctcatataagatggggatttgttcgaggttagagaacctgattagtgataaaccgataacttggggcagccgtccaagcctattgttacagagtactactgctgatggtgagcctgaaaaacacggtagtacagtaccaacgtctctatttggagcggaggcaaatgtagcagccgcacaagacgcttggcctcttccacggcttgcgcgctgccgcggcgcgatgtagcggccggaacgcgcgcacggccacttccgatgattcgttcgcgtgggagtagtactggtactagtgtgccgtgtgcccgtgcggctgtgaatcgcgatcggtgggaagtgcacgcgcggtggcttagcttcactccattttttgccatacacggaccgcaccacatcgtccgtcacaaacggcatctgccaactggcggcctggcgcaccgtgcaatctccggccgcgacaagtcgagcataggaaacaaggcaacaagcgtaacattcttttttcttctctgaaagactgaaactaatccatggtcccaaacaagcgtacaatggactaccacgatacatcggtgcggtttggtttggtgaatcctcctcgatccacagctttgcaatgctctagtttttaataacctttttgtctaaaaaaaacatgagattaacgaaaaattaccgtcagagcttataaccacatggattagtgaaaaaaaatcaccgcactgtaggtggttagatggtgataaccgtaactaaccggcttggtcagcaagccaaagtgccaattgccaaacaccgggatgcgattagaatttagaaccttctcgcccctccgggttctggctccgttaaagcggcaaaccaatcgaggggagcagcccatttccagttcatcccaccccgcccatcgccgccaccgaccactccaacgccgccgccgccgccgccgcttcggaagttcggagcagcaagagacgcatggagcatagcccgcacctgttcgacggcgcggcgcccaagttccggcgggacgagaggatggcggcgccgccgcgggaggccacgtgggtgatcctggcctgcgtcccgagcgtgtcctcttccgacagcgacttcgaggccggcgaccaccttgccttcgactggcgcgacccgccgggcgtctccctcctcaccttgcgccagagcgactctgtccctgtctcccccgcgcctcgggatttctgccccgaccgcgacgaccacccctacgtcgtcgccgtcgactccgccggcggactcctgctccgcggcgccaggaggagcgcccacgatttcggccccggcgtcgcgctcggattcgaccctgcaccgagctgcaccaacgacggcggctacatcctctgccacgctacgctccgcatggcctacctctacccgccctgctccgacgagtaccggctcctctgcgccgggaacgtcggcatgatccgcagaacggcggatcgcgaccacccgatccgcttgttggccgagctccagatagagtccggcaatggcatccaccgcgccaccctactacgctactcccatgagctcggagggtgggcttcaacaaaggtcaactacccgccaggccgccggtcgtggtgcggcgacggcgtcatcgtccacgccgggatgctctggtgggtggacctctccttcggcctcctcacctgcgacgtgttcgccgcgaagccagacatgcgcttcgtgccgctccctgagggatgcaagctaccgtactccagcgacgcggaccacgccaagcaccggtgcgtgaacgtgagcgacggcgagctggcgttcgtgcagatccacgactacgacaccgccgccggccgcggcgcgccatcgacgatcatgatcagcatgtggacgctgcagcagtctgatgcgggggaggagtcggtttggtcgctccgccaccgggtgcgcgtcgacgagatctgggaccacgtgacataccggaagaccatgatgccgcggcgcgttccggtgctcgcgctcctccaccccaaggagctcggcgtggtgttcttcttccagatcacctcgcggaactcgt

SEQ ID NO: 67346 - DNA, 2021 bp, Oryza sativa
aacacctttgtccctcttttcatgttacagccacgaaggtagccatacaatgttattttcctgtcacactttctgttcaagcgcacactttctggaggagttacatcttcaaatctatcgactagcagataaggatgtgccatcctccaactcagtgggataggcttgataacagagatgaaccttgcaagattatggacttctcttttcgtgtacctgcatgagacaaaaaatgaaacttctacactaaatgaccaaatagtagaaatgaaaagaacataaaaacaagcattctcacttataactgcagcatgaagaaagataatgtatagtaactccctgctaatatggtgagcttaaatcagcatagatttgtttactgataagtatcgattgatagttcagctataaccactcctccgtccatgatataagggattctaggttattttggagagattttaaggatgaagggaaaagactgtgatgctctttattaaatgagaggtggttggaagtaagattgggtgaaaattacatgagggatggttgaatgggcaagtagtactctacaatccattatatttgtgtacaaaacttgaacctcaaaatcccttatatttgtggacagagggagaacaaacaaagagtctgaaggaagaaataccagctttatgccaacttactttccatgaatgagaccagacaagtagaaaagttttgctccctcctttatctcagcccaaaatcgatgcttcaggcgctgcttggttttcctaagcttttttacatctttaaacttatcaagatgtgtaaggactcccatcaccttggggaatccgtgcacttgcataatatttaggaactcaaatgtatcctggaaacaagcagttatttaggtgccagtagtacaataaagcataaatggaattaatcacgcggatagaaagcagtgaatagatcagcataataaatacagtatgtcagctccatcactagtaggagtggtaggcagtaatggacagcactttaattgctagtaatggaactttagttaaatgtataagatgaaacttttatcggggatgtgctcctaagggcgaaaaaacatatttcagactacatcctaagctagaaatatttgtgaaaatataggcttcaacagcacaccatttcaaatccatagcttccatcaataagcagcagagcaagatcagctattttagcagcatcaatcattccgttgatatcatttggacactccaagaactgtacgcgcctgcttttacctgcacatgatgaaaaaattgcatacattagtttcatatcttcacaataattcaattgttcagaagaacaatatagattgtcctcaagtacaaggttcagagggttcattaacctgacacaacagtgattggaccacggacttcagacaaattttgtttcgtgtagtgctttactagacattttatcagcagcgacttcccaacctgataaataatgtaatgatcagaaaacaatccacatacatcatcttctccaggtggcagagcatacctgaggaggcccttgaactacaacaacaaaaggtggtggttcaccaattgagcgatccataattggcacatgaagacgacgttgttcaatctcagccgatcgtgcttgtagacgcttggcctttgcagctgactgaaaggcaaaagcctgggacaaggaatggtaacctattaaaataaatactccaaaactagagaaggaaaaggttaaacagatagacaaaccattcttgagttgttgagttcgtttgcacagtgtaaagaaccatttagttacagagatctaaccgtgtcctttttaaggaggatatttaccatttttctttaaaaagcatggatcatagccagtgaccacatgacctccaaccaaactcataaaattccatatatagacggcagaaaatatcaccaaagcataaataaataaatgcatctattgcaatagcttgctaataatacgag

SEQ ID NO: 67347 - DNA, 38610 bp, Oryza sativa
  unsure (1)..(38610): unsure at all n locations
cttactaattattccatcctgatctcctcagctccatccatcgatcatttccaacctaattcctctaagagaaagtacaagctagctggttagtcatattgttaattttggtctcaattatgtctagaattaatcaagacacaacctagctgcactgtctagcgtgtcgagggcggttgcgcggcgccgatgcgcggaggcagggcggttgcgcggcactgatgcgcgggaccgagccggtcacgctggaccgtgccggtcacgcagcgccgtgatgcgggaccgccctctagcgagggaccgccggtcccgtagaatggaagagcggcacagagcggcaccgtctcagtcccgcattcctaatatgcggagaaggtatatttgtgaaaatatttttcatgcatgtatataaacataaaatagtgaaaaaaaggtatattttcaaatttaattctacagttacgtagaattccctatttgctaactgccaatgaattataatgcgcgcaagtaaacatggatcatcgtgtgggagtgcagtactcctaattactcctatgaactaagataagcacgcttaacatgttctttaattttgtactagctttgcttggacttgtgcaagattaattgctggagattgattagttagtgctccgattagctggagaaagttttcgactgctcaagtaattaaacgggctgaatggataaatggtggatatattatttattttatgacaatatttaagggtataaacaaatatcctacgcaacttatgaatagaattttctttccaaaaagttacggagcttggaaagcgtgcccacaataatttataatatgtaggaaaacaacgtgctaagcctctttggaatgaaagaatttgaaggatttatgtagaatttggcataactccacatcttatatcatgctaatctagaatttgcaagttgcatagcattggtttaaaatattattatatatattatttttctaaataagaacaatatgaataatccgtatatatggatttctaaagctaggaatacatgccttcaaaatattttagtttgaaataggaatacatcctaaattctatgaccattttataaattttttgtgttccagaggagcccatttttttttcataaaactccacagatttggcacatactactgtactacacaataggtttacaacatgagtttcataagaatgaacctggaaattttcataaagttccgtagatttgacccatatggcctcctttgatttgatggaaaatcatatgaatatttactaggatttcaatgctatagttttttttctcctaaatgccgtttggaacaaaggatttgacattattgaatcctataaaggctctttggatcgcagaattctagaacacgaaaatatgaaaaacgagcgattggaatgtcatggtccaatgaatcctcgagaacatgttgtctggttgcttcaaagggaaatatcaaaggaatttggagagagctaacacacaagtgtgatctccatgagattagacttcatgttaaaaatcctcgaaattacaatgaaatgagataacccaaaaggagtttcaaaggatttttggtggctcaatccctatgatcacaatccttcaaaattcctcaaaatatcatttgttccaaaagagaaattttttttcttggaatatcttaatccatacaggttagagcaaatttaacatggattaaacctaatgaaaagtttccttggtctttctcttcttaaaattttatgtttttccagcggtctacccaaacaatcatactatatatatatatatatatatatatatatatatatatatatatatatatgttatatatatatatatatatatatatatatgtttatcaactacatacgtttaaaaaaatctctaatagtggattggtaacatactaaaacttgttcgattaatcccacccgcaagagaaataaggaggatttgaagggctgttgtggaattatttcccccatatttatggtgtaaaattatttttcctcagtctcctttaaatccttcctcttaggaattaacgaaagtatcacgtcttttttagatgggataaaagcaggtgcatgcgtgcatttttagcgtgcgcgcttacatgctgcgtacatttgaaaagaaaaatgatatgagttttgagatataatgataaacagccagtataacatcatttaaaagttttttgggataacatttcaaagagttaaaaaaacacttaggccatatttggataatgggtttgggatatgattttcaacccctcaaaaggtaagtttcaatcttgggcttattcggtttgtaggattttcaaaccgtaggaatacagaaaacgtgtaatataggaatgcatgtgcaaacctatggattagaaaacataggaaatttttatatggttgggttgcaaacagtccaaaaggattaaaaacattgggttagagtggattatttttttcctttgttttccccctaaaagtggagggataggaatttttcctttcatgcattcctttaaaacgaatgatagtatagtgctcattccaaaggattgaatattcctgtaatttccctttacaaatcctctaaaacgaataagctagccatttattctactcactcatttcatcatattcctccactcatttctatttctcaatcccagctctcctaatccattattcaaacacatcattatagataaagcgttccggtatagtattagagaaaagaaaaagggtgatttttgagagatgtaataatgataaacatatgaagtaacattacaaagagttaatgcgttccgatccggttctttcttaggatggcaagcagttcagtggatcacattacacgtcgccctgatttctcaatcaacagccgttcattcacccaccgaacaatcaccagccgttcgatcgcgttcctgacgtccacggtcaaactcaaaaacagaaaaaatcaccgcgggcgtgcgggtttaatttatctccctcttacgccaacgacgatcgaacagagataagatcgatctaaccaccctaacaaaccgtagatgcaaccgtaataacagcctaaccccaaggaatgcgagatttatccgcccctgcaatgcgctataaatttacttcgaactcacggtgaaaaagtaattagcatcacctcccttcttgcttatcaacacgtacgttgcgtttcttggcaatgcgtgctgcaccgacgacgatgtggcgttcgccggcggagccggtgtgtatcctcgtcgccgccgttctcctgtcggcggtggcggcggcgacagcgggggaggagtacgtgaagtacaaggacccaaagaagccgatcggcgagcgcgtcgacgacctccttagccggatgacgctcgcggagaaaatctggccagatgtatgcagatcgagcgcgccaacagcgagccgtccgccgttatcagagaagtgacttcgtcggtaagccctctataggcgccgggcgtcgccgccgttgcgcgcgttcgatcgttgtacactgacattgtgttttgttttgtgtttgcaagggagcgtgctgagcggcggcgggagcgtgccgtcggagaaggcgaccgcgaaggagtggcagcagatggtggccaagatgcacaaggcggcgctcaagacgcgcctcggcatcccgatcatatacggcatcgacgccgtgcacggccacaacaacgtccacaacgccaccatcttcccccacaacgtcggcctcggcgccacccgcgaccccaagctcgtcaagcggatcggccagtccaccgcccacgaggcccgcgccaccggcatcccctacaccttcgccccatgcgtcgccgtaagccgcccaaaccggacgaacacatcgttgccagtgaaaatttacgtaatgttcaaggtgttcgaccgatcgatcgcatgtgtgtgtgcaggtttgccgcgacccgagatggggacggtgctacgagagctacagcgaggacacgaagctggtgcagctgatgacgtcggcaatggtgcccgggctgcagggcgacgcgccggcgaggtaccccaaggggacgccgttcgtggcgggggggatgaacgtggccggctgcgccaagcacttcgtcggcgacggcgggacgcgggacggcatcaacgagaacaacacggtgctcagcttccacgacctgatgcgcatccacatgccgccctacgacgacgccgtcatcaagggcgtcgcctccgtcatgatctcctactccagctggaacggcgtcaagatgcatgagaaccgcttcctcatcaccgacatcctcaagaacaagttgaaattcagggtaaccaatgctaaaacctctcaaattctcctcaaaattcaactgaacttttaaaaaatgtgcagggatttgtgatcacggactggcaagcggtggacaggatcacgacgccgccgcacaagcactactaccactcgatccaggagacgatccacgcgggcattgacatggtgatgatcccgtacgactacccggagttcgtcgccgacctgacgacgcaggtgtcgaacgggtcgatcaagctggacaggatcaacgacgccgtgagccgcatcctccgcgtcaagttcgccatgggcctcttcgagaacccgctcccggacccgcgcctcgccggcgagctcggcgacaaggagcaccggcagatcgcgcgcgaggccgtgcgcaggtcgctcgtcctgctcaagaacggcaagcacggggagaagcccgtgctgccgctgtccaagaaggccgacaagatcctcgtcgccggcagccacgcccacaacctcggcttccagtgcggcggctggaccgtgtcctggcaaggccagggcggcaacaacgtcaccgccggtaaatcaagcacgattccgatctcgatcgacactcgccgtcgcgtttgccactaatgtgaatcgtgatgcagggacgacgatcctggaggcgatcaaggcggcggtggacgagagcacggtgatcgactacacggagcacccggacaagagctcgatcgccgagagcgccaaggagtacgactacgcggtggtggtggtgggggaggagccgtacgcggagacggagggggacaacctgaacctgaccatcccgtcgccggggccgaaggtgatcaaggacgtgtgcgggctcgtcaagtgcgtggtggtgctcgtctccgggcgtccgctcgtggtggagccgtacatcggcgccatggacgcgttcgtcgccgcctggctccccggcacggagggccacggcgtcgccgacgtgctgttcggggatcacggcttcaccggcaagctgccacgtacttggttcaaatcggtggaccagctgccgatgaatttcggcgacaagcattacaacccgctgttcccatttgggttcggactaaccaccaagccaagccatagccaaagttagaggtcaaaacattttatctcaatgtgtagccagagccggagttaggggttaaacattgcatctgatggactattatattgttcggttaaaagtaaaatgagtgtgagggtatggtattttaaaaataaatattagtaggattttattggtgagtgattctcgtaccattttttttctacattattcgctacgcatcttaaatatttcctcctccaactataaaccccccctccctttccttccctctcctccaatggcggcggcgcgggccacagtggtcgtgtcggcacgggccacggcgtcggttgtgaagaatgttctcgcaaaatcgagagggtaagtcgtgtgcgctcgctctgcttctcgcttcccttactcatctgctagtgtgcgtttatatgtgttgtgttctttttgtgcgttgtgttgttcatctgcattgtgttcattcatctgcgttgtgttcatcttcttcttgcttgcgttcgcgcgtgttgtgtgcgttcgtgcgtgcgttgtttgcgttcatacgtgcgtcggtgcgtgtgtttgtgttgctcatcgtagtctcatgatgatgtgtgcgtgtgtttctccttatcgtagcgtgcgtgtgtttcttctcaacttatcgtagcgtgcttgtgttcgcgcgttgtgtgcgttcgtgcgtgcgttgtttgcgttcatacgtgcgtcggtgcgtgtgtttgtgctgctcatcgtagtctcatgatgatgtgtgcgtgtgtttctcctcaacgttctgctgctcatcgcttctcttgctcgagtggacgtccacccatttattgcatgtcatctaaatagttataaaaaaattgaaaaaatatgaactaagatagatatattacaaccacaaacatggaagttaaaattcaacttctacaacttgtaacaaaaataacaaacaaaactcaaattactatatgtatttttacaattaaatttgttatttttgttacaacttgtagaagttgaatttgaacttgtttgtttgtggagtgatatattacatattaatctatcttgtcaatttttttgaaaatttttcgtaaccatctacttgacatgcaataaacggatggatgttcaatcgagctattagaatccatctcccttgcgtgtgcgggaagtgtttgtgtgcttgttgcaaccattgcagacgctgttccgatttagttggtgtgcatcgtgttcgtgtgcttgttgcaaacgcttttcactctagttggatttagttggtgtgcgtgtgcgggtagtgtttgtgtgcttgttgcaaccgttgcagacgctgttccgatttagttggtgtgcgtcgtgtttgtgtgcttgctacaaaatatgtttcaattccaatcatgtttcatctaatatttttttggattttgtcagttgtttgacaaatcatttaaaaaactaaccgagctcttaaaaaaaaagatacgcaatataaaagacgaagatatgattggaaaaatcactaacacatgagacattatgacccgctggatgcaaacactgtttcaattccatttttgttctatgtttcaatcagttcatctaatattttcttggattttgtatattttttgacagatcatttgaaaaactaatcgagctcttaaagcaaaagatacacaatgtaaagggcccgctggatgcaaacgttgtttcaattctatgtttcaatcagttagtatctaatattttcttggattttgtctattgtttgacatatcatttcaaaaactaaccaagctctaaaagaaaaagatacgcaatgtaaagggcaaagatgtaattggaaaaaccacttacttatgagacattctgacccactggatgaatttcggaaaacacgtcaacgacaccaccgacaagactttcgtcgtcgctaacccccaccccgtcatccacaccttgcaaaaatcactcacttatgagatattctgacccgctggatgaattttggagaacacgtcaacgacaccaccgacaagactttcgttgtcgccgacccttaccctggatgaattttggaggatacgctggttacatcggcagcagaggaggcacgggcagcggtccggcggtcccacttgtcctcatgtgagcggtggcggtggctgctgattgcgggaggaggcacgggcagcggagacggcggtccggcgggaggaggcgctggcagcggtcccactagtcctcctgtgagtagcgacgccggcgacggctataaaggtgctcaggcagtgagagtcaagcatttgcgacaacccccacttggcatatcattctttccttttatttttttgcgtggacctttattggatagatcttgatactaatatgtttcttctgttttttcagacaaaagagggtcgtggttaactagaagtttcgatggtcatccagtgaaaaaataaaagttgagaaaaattcacggttagtaaagtagcgtggcacatgagcagtactactttttctaaattgtatttatactcgaatttttattttattttattttctaattttggattttattttattttttattttgattattagttaatctcgtattgggttcttatagggactcttctttcaatattgcttatttttaatttcgaatttcagttatttttaaattgtatctctagttggactctcattttatttttctccaattaatgtggtaatttctagctcctacagtgaacgtggtacctcctttcaaagctgatataatagatagaagattgaggtctgcagagctttttaaactcggtttacatcggttttaaatattgaggagacttatatcggttctaaggttaaggttaagggatgttgtgatacaaccaggagcttacataagaaacaaaatagatttattctaaaaaaaagaacggagtaagcttttttttctcaagatttattccaaatttttgcttaataattttgggtttactatatattctatagttatatgagtagtatcgagtaggcgtaggatatttaaagaagggaaatgaatgtaaatttgttgttatagatttattttttgcttaataattttgggtttctatatattttagagttataggagtagtgtcgtgtaggcgtggtatatttatagaaagcaaaggagtagaagttcatgtggctggaaagggaagatagttttggaagcctctagaatctatatgtgatatttttctctagatttttcctcacatatgattgttaggtgttttttctctagtataaatttatgatttttctttaaagaatgaggtgccaagtgggccaatcaaaaactagcaaaataaattgtatttatactcgaactcttattttctttttttcctttttgctaatttcagattttattttatttttttatttcaaatattaattaatctcgtattgggttcttatatggactcttctttcaatagtgcttatttttaattccgaattttagttatttttaaattgtatctctagttagactcttattttctttttctccgattaacgtgggaatttctagctcccacagcgaacgtggtgactcctttcaaagctgtcttaataataataactagcatggtggcccgcgcagattgcgcggctagcatctttatattttttctcatataatagcttaaatattttcacattttattattaaaatatattaaaatggtaacataattttaaattcttggttgaactaacaaacgtgtgatatttttaatgtattgtatatacgtgataattatttataaattgtatttgtatatggactcaagactcatatttcaatattccttattttctaaatttcgaatttcctttattcataagttctattcctatatggattctagactactcttccaatattcatttttcttagctttgaattttagttatttataaatagtatttatatatggactctaaactcttctttcaatattttttttaaaaaaattttgaatttcaattattggtaaattgtattcctatattgactgtagacattttttccaatatttctttttttttaatttcagtaatttataaattgtattcctatatggactcttttttcccaatattccttatttgttaatttcgaatttcagttatttataaattgtatttctagggtctcatcttttcgcttatgcttattagccaaaatttgaattttaacctattttgaggtttttttcattgaagtttattttcagcctttacttttagatcgctaagaacaggtatataaaagttttattcacaaattacttttcatttgtaaatgtgtcgtttcgcttattccgcgaataagcgaaacgatggctccactatatggacgctagactcttctcccaaatctttcttattttttcaatttttaatttttgtaattataaattcaacttctatatggagtctaaactctacttttagttttcttttttttagattcgacattcagctagttctaaattcctgtctggaccgtagactttttttcccaatatttctacttttctaattcccaatctgttatttctaattgtatttctatatggactctgaattcatttttcaatattttgtttttttttaatttcgaatttaagttatttataaattgtattactatatggactctagacttttttttctaatatttcttattttaaattccgaattttagttattgataaattgtatttatatatggactctagacttctctcccaatcttgtttttttttcattttcaattttagttatttctaaattatatttttatatggactctaacttctacttttagttttcctatttttttaattccgaatttcagttaattctaaattgtatacttgtatggactctagtctcctctttcaatatttcttattttaaattccaaatttcagctatttttaaattgtattcctatatggactctacttttctttttctctgattaatatgaaaatttctaggccgtgagagaaaacgtggaggctttcttttttattactttaataagataatagatagatgatataatagatggaagattgaggtctgcagagcgttttaaactcggtttacatcggttttaaagtttgaggagacgttatatccggttttaaggttaagggatgttctgatacaatcgggagcaagagataagaaacaaaatagatttattctaaagaaaaaagaacggagggagctttttttcttactagatttattctaaattggactctttagagccttcacgagctagtgagaaaaaaagaacgtagagtctgagtgcatcgaagacatcagcgtccgacgatgcataattattatacatcttattaaaatatcttataacttacatgttgggcaagtattccattcgattactaattaaagataggatccgttacagatagcatatcctgtgtaatatcatttgacgtaatatatttagttgagaaaactctcctcccgatgacttagttaaaaaaaacagaaaggatccgttaccggctggtaatgagatcaacatggtggctatgtggatccggtcacggcataaatatttacggcccgccgcctctacacgacagcgtggcgttcgcccaccgccgtgtgctgaatttcgtccggcgcgagctccttggtttcgtcgacgattcaccgccaattatcgctgatttactttttattattatatgccaagaccggccggtacgcaccttgctactcaattctttctttctttatgtataatatatgtttctgtccagccctaaaattgaagttgtagcttatacactatgagagtattagatgtactactatgttttattatcactgcgcccctccaatagtatagtctggttcgaaaatcctcaaatctttataaattattaataaattgtacaaatatgcgatacaacagttacgttttggtggcctccgattattgctttgtatgggattaaactagctagctcgatataatagcacattgttataaagttttattttctcatatagtagctactttcacacttttttacgaaatgaaaacattggaagtggtgatataatattgagttacggcatagctcgatcaatcttttgtgcaaggtgctctgatcagcatgataattcctatgctcataaagcaaaataattacagcaaaccaaagatataaaaagttaatagtaacctcccaattcgtataaaaggatatagcaaatgtgatatatggcttttattttcccttttcctcctatttgcttgagtcgatgcattgtatgttgcaccttcgcagtgactcttgtctttcctagtccttttctcttcttcccccctccgttttagtactacatgtttttggtttgtcttaaatcattttttatttgatcaaatttatagaaagaaatagcaacatctataattttaaattaccacggaatatatttgttttggtgttaaaattgtcgctacagtttttacaaacttagttaatttgaaaaaaaaactcagaatatactcaaaatgacttataacatggggaacaaagggagagagtatacgagtagtagtaactttatcgactagctcattcaagttaaggtgaggagccatcagcaacggttaagattggtgtgtccatccgtaacggcgccgtccgctgcctgtcatcgtccggccgtcgcggggtcggacctcgcccgccgccgcaccaggcgccgccgaccgtcgcgagaagtagtcccttgccacttccccgccagatcccagatccaggatcggatctggcagtcacttcaccgctgccatcacctccacgcgccgccgccacccccaccaaacgccaccgcccctccacacaaccccgccgccgtcatctcccccaccagatccggccaaatgacacggatctgtgttagagtttgtgtcgaatatgtgtacatagtcggttacagtttaagacttggagttgtaataggtattaggactagagtatgagtcggactctatcctaggatctctcataaataggggcatgtctgttgtaaccgcatagcgacttagcatagcgagagggagcggctgccggcgtcgaccagccgtgagtcgttgtaactctaatacgttgtatatgctggatcggggaggagtgcccgtaatcagtgccccgaagatgtaggctacggctgaactctgttaccaaatatcgtgtcttggtgccgtcatcgttttagatctcctatagcgttttcttccgcgtttagctaccgatgtcaatttcggggctggttttataacaatctgggcgccgtcccaaatgccgagcagcgccccccttgcccctgcgtggtgagagcgaagcggagggagggagaggcgggcaacgacggcctagtcaccacccgtgtcacccggggagagggcgacgcgaaggcttgcttcgtctacttcttagttttttgccgtgtagtagtagtattccgcctcatcttatcaaccaaaatttaaatttttaactttaaatctagagttgattttgaggttttttttcattgaagtttgtttttcagcatttgcttttatatcactaagaacacgtatataaaaaatatatttataaattatttttttggtttataaatttgttgtttggcttattcccctaataagcaaaacgacgtggcctttcgtgcaggaagaacctgctttgggacggccatcaccgtctcttctcctccattccccagatggtcctcccgaactcgctcactcgctggccttcgttttttttagagagagagagagaatggcgacactctattcattaagttgcataatgacagagcatctcccggatatactccggggtcacagagcgaaagatattactccctccgtttcgaaatgtttgacaccgttaactttttagcacatatttaaccgttcgtcttattaaaaacttgtgtgagatatgtaaaattatatgcccacataaaaatgtatttaccaatgaatcaaatgataggaaaagaattaataattatttaaattttttgaataagacgaacggtcaaacatatgataaaaagtacatagtaagtgctcagaacgacgagccaaagtgtgtgtcctacattggataaacggttcacatgtatgaaggaacatgcaaggaatgaactcttgactttcttgatgtcgctcaccacgcaaccagcagcagaacgatctcgttggagactggaagcgttggatgaatgagaggcagtccgaggccatgataacctgctggtatccctcctccccgtgccaggatcagcgcacgtctaatcgccaaggcttcagctatttcagggacaacaacttcgggcttattcattttaaaggaattgtaaagaaaaagcatagaaataggaatgggttttaaactaccattcgtttcataggaatgtaccataggaaaactataggaaagttttccattcctccatttttaaaggaaaagcataggaaaaaataattcactccaacctaatatttgtatttttttggttggcttgctcaacaacatagaaaaaattcatgtgttttttaatctataggtttgcacatatatttctgtagtattcctacgttttgaaaatcctgtgaaaagaacgagcccttcttgaattcgctcgtttcacgtgaaaaaacgattcacggactcgccgtgagcggcagcacgcacgcccacgcgcaacaatggcgcacgacccaggccgtttttggtgtcacgtcgccgcattattacgtgtgatttcggcggcacgcgggcgtgtgctggtgccctcggctgcgacgcgtctggttggcccgtcccctttacatgtgtggcaccagccggagatggaccaacgcgtgcacgctaaagtttagggcctttgcaacctggaaccttctcatcctcaccatcccattccgcggcggctaccatcgccccggcccagtggcccacaccccccagctgtggcggcacaaatcgacgatgccaatatgcccattcatgctggaaagtggaaaggtgtactctactcctacgtatagcagcagcacacagtgaagacagactgcaatctttcagtcatcagtgaccgtagtagtttcaggcagcattcagatgcatgggaaggctgcaatggtcactccagtgcgtgacaaagcttaatgcgcggctttcacggatccggtgattggtcggccgatctacccgagtcaattccatgtagctaattaacaatcctgcactactagtatagtgcaccagtgctgctgctgctgccgacttgagtcctaacccataatgcagcgtcgtgcgtgcattgtctccctttatattgctgcagcatagatgcagtttaagcacaaggatggttagtagtaacacggcactaattcgtggaaacaattggtagaacccacgctgttcggttagcttaaacccttcgtaaacctgctctaatggcaccgacacgcaaaggcactgcatgtccccgccctaatgacgggcattaatccacgacagcagcagcagccgcagccgcaacggagacgttgtgaattgtgatcgtggaattggatttggattcgctgtgagcctcctgttttttgcagatctttccaactgaaaaaaaaaaaggaggaaaaggctctcttgtgatttagcaactcaccaatgggccagcgataacgggtctagtacgtaggagtactagtgctgctacagcgaagtgcgaggaaaggttggccattaaaactgcccaacctttgctgtgcgctgttccgtggcgccctgcattttcctcacctgccatagctgtccgggggccttcactgcatgtgcagctgttacactttagtactccgcttaattcacctaccaaatgtactgacagtaatgtgacactctagtaaatgctaatggtggagtaatgcgctactatgaaaataattaactactatttgtcacccttacgagttgttctagagaatttaacacttaatacatagtttctccatcccaaaatataataatattaagccctcaggatttgtcttaaaatatacttcctctgttttagattataagattttctagcattgcccacattcatatagatgttaatgaatctagatatatatagtgtttaaattcattaacattaatatgaatgtggacaatgctaaaaaatcttataaactgaaacgaagggagtaacaatttctccaccaacattctcttcccaaccaatcacaaccctccaccatttattttttccacctacctccactattcatccaattacaaccctccatcactcacttctacctactttcttaataaccgtgttcaaccctaaaacttcatatattctgggacagagggagtatgtcataggcagcgaatgacaaattattagttgctatatcttgaaaatttcaagtaggagtacgttaaatgtcccgctacggagggagtatgtactgatccacgtcctcgctgatattcctatcgtgtgtgacagatttctttttagacagcgtctggttggttggatcgtagtactactactgttgctgcatgagcgtgaacaacgcgtgatcccatcatgctttatcctaacttctctgacgagcatgtagtagacgcctcgttgtcctgccattattctctgacgagctgagccactctggtttaatttactctgctctctggtttaacttactcctactctgcttggatcgatcccgtgatccgtggaacatttgttaatctaagacgcgatctggatctttcaattagtggtagcccaaaccctgacgcgatctgaaggaaattttgtcaacgacgcagccacgagaacgagcctgacgacaaagggcgcggacggacgagcagagcagtgccgggacagcgtatacgtgctgtgcctgtgtggcgccaaccccctccgttccaaaataattacagttttgtactatttacgttcaatgtttgactgtttattttatttattttttttattaatatttttattgctattagataataaaacatgaataataatttatgtgtgactaaatatttttatttttttacaaaatttttaaataagatggacgtttaaacgttgagcacggatatccacggctgcacttattttgggatggaggtagtattattctttctcattagagcaggtacaatagcaggctattagccagctacaatcatattttaatgagataaacaatgagagagaagagtagcgggctacatatctgtagccagctgcagcacggactccaagacgcaatgtgcgtatgacatgtgggaccatatattaatagtatagtaagccactattatatgaattggctgttagattgactatagatgaattgaagataatagtgggctatactattaaacttgctcttacaaaccggaacacggagtatctagatttatagttatagttagaagtttgctttatttttctaaatggagagagtatatctatagtctccatttcaaaataaatttacttttatatatgaatataaatatagactaagatcatatttatatataaaagtaacttatatatgaatataaatatagactgaggtcatatttatatatataattaaatttatttttaaacggagagtgtatctactatccacaaaactaattttgaatctgatcaaacatatgtacaaatttatttttataaattgattttttttcttggaaggaacactatctactcccatgcgtcgccggctgtatctgatctgcaggcacactaaaataagagtgaaaagaaactgcacgatgctttgacgatttctgtatttgcatttgtgtgattgggatttaataggggagatgcgaatagtagagaagtcctttttcttagcatgcctggctggaaggataaggaaaggtgatgatggtccatgactccatggatgatatagaagaagcagaagaataaaagtcatacatagagaagtttctgacacctgtagcttcttttggattcagaagcttcctcagcaatttaacttttcattcgaattatgagaagttgtagttgtagaattcaacaaataaactataggtaagaagctgtaaaactcggcttctccagtttatcaaaaactgtctactaatcaactatctctcacagaattttaagctttcctgaacaaacctaagatcactccccttgtggggaaaagatgagagaacatcacatgcatgcatcgctctgtctactgtctcactttgaactttccatctgttttcgtttttctaagagaaggctgcaagattttgatttcttttcccttgcatcatcatttggctatgaaagctttattcatcctaaaataaaaatcaactttttaagaatgaatataggctggtgcttatctagatattacatccttacttatccatattcattcgtataagtgagtacttttcttgatagaatgaatactggatcaaagcagctgtaataacaccccagcacatgaattctttctagtactagagcagtcgaaaaaggcaagcgatgccagaagtagcaacgaacgtgtgttgacgccgaagttaatgacgacattaaaaccttggagtaacacctcattgatctactaccttgtctgtcttctttccatttttttttccgttggaacggtcggtcctggataagttcaaaaaatgggacatttgatttgaaaggaaacggctcaaattgaacttttttctacttctacggagtgtactgcccccaacgtctctacgttaggtgcaaaccattaattaaaagcgtaaacagtgtcgcgttacacggacctgccacttgatcagggtacaaacactgttctttagttagaggataaatagttgaatacggttaaaaatacagtatagtccactggcgagacttatgccggggaaagcaacaaaaaggttgcctgtcacaactcccgagcagagatcccacgtccactaggaactaaaaaaaattaaacaaaaagacgatgacgaatgcaactgacatgtgggcaggaaccgaaacagctgcatgtgggccccactggacagtgagagttggcctttttgacaccgtggcatggcccgacatccgcacggtcaaaattaccgtcgccgtcgcgtagattctcggagataaaaagagagagagagagagagagaaaaagcgcaggaaaaaaagttgcaagtgaaaaaaaaatctgagagcaagcagttggttgtcaataaagcctcgcgttattgtcgtctgcctcccctgccccgccgcgccaaccccgtccgccgccgccgcacgtcgccatcgccggatctccggccggtattccggtgagcacaaggtacccgccccctcgcctccaccgtgtctccttgacctcttcctctccggcaacttctgtgtcggcggtgcgccggaacacgcgcgccacgccaccgcgaatctatcgcgtccaaaaaaaaacaaaaaaaaaatctcgcctgagaagacggtgatctgcgagctaccctcgcgttgtctccgcgtggtggcgagcgcctcgtgcgctctagccatcgcccaatcgcgtcgtcgtactggtatagtggccgacgacgacggtggattggtgattagttcccatccatggcgatcgctagcaagctagcttgctagatggatagatacgccacaatacataacaaatacatggggcttgggcgtttgtggagtagtggagagtgaccaccagctcaccaccacctcctcctcttttggctcgttgctccgctggttcgatcgattgcccgcacgccaacctcgcatgattttcttttccctccccatttgtgacacactaattaagcaattctggttggactcactcactaatctgccttggctctctttgagatagagagaaaaagaagagaagattttttttttatgggttaagatgcttgtgctgtttcttttttcagacaacggagcaaaattatttcaggctctaatattaaaaagaatatattatatatgtgatatacataatgtggagatgcttgcactatactgtattttgtattactagaggtggttagtgacctgtgttagtgagcctgctcgtgcgagtccaaaattttctcctaatttaattgagctaatctcctatatggaggaggttaagctgtctcaatctgcagcctctgacccggcaaagcagagtgcacacaagctccctcccgtgtcgaagccgccgtcgcatgattagacaaacgattcgtttatagctctcatgtccctttcacccggaggagcttgacaaaaagactcgccgccgcggcacagctcgccggtgatgagacgatgcaaaaataaaatgggggaacgaatctctcgcggtcgagccgcgagcgacctcacacaagcggccgcgtggagcgtgcagtgactgcagctctcacgcggcctgtagaagcagtttgtggagttttgtggccggcgtgtgagaagagaatttcaacagcaataatcaaagattagtctcttggctgatcttatccacagcgacattgcaccagattggatggatggatgcatatcatccctcttgcgggcgatgtggaggtcgccgttcttgattggcttggctggctttggcttccctgttcgatattgatttggtttgtactagtagaatactgctggtattagctaggcgttgatagtggccggggcttagcgtcaggtccactgaccactggggcactaatcaaagttgctgatttctttcgctttcttttttcgttgcaatgcgatcctcatgtcggcgcgggtatcgcgggggagatcaaagttcgtagcttcgttagccgcttagcctactagtgctctcattagtctataagagagaataggtcttttgctttgctttcaggacatggtcacctttctcaggcagcaagcgtaagcaaggcagaggagagggaaagaacctctctgcagtgctgctgctgctagcttgcagaaaaaaaaaactctcatcttttgcaggaagagacatcactgtttctgcattcgtgtgcatttggattaagctttgcttatccctttttagtggagattgttgagtatatcaggtaaacacatgtgcagtcttgctgtgctgtatgtatgtgtgtgcatgattttgtcgtttgttttatgcatgctgcgttatctgctcttattcaaactcttgttatgtgctggctggctgattcaattaatcaggttaggtacatgattgtttcccctgtaagtcatgttggttttcagcaacttgatgcgattggataaacaagtttgaaaaaccgaccatgttttgagtatgctgttcccttgtttctgttttgattgcaacctaagagactcttgagtcttgactattctaatgtttgaagatgttgttgttcaagcaagagacgtgcactactatgctcctatgtagttaccctcatactagcctgaaaagcttacactcatagatatgcttctctcacaggtctatatattggcagctctggttggagatagacactcacactgagccaagatggggagtttgcacaagttcagtgttattctcctcatgttatgttttgctacgttggggagcgctcagtatgtcaagtataaggatccgaagcagcccgtctctgttcgtgtcaaggatctgctcggccggatgactctcgctgagaagattggccagatgacccaaatcgagagggagaatgccacggcggagcagattgccaagtacttcataggtgtgtcatggtttactactcatgctcaagtaatgtgaacgatgaaatgctggatactatatgttttgtgttttgacattggtgtgctgtgatgcaggtagtgtactgagtggtggaggcagtgtgcctgctcctcaggcatcagctcaggcttgggcttcaatggtgaatgaaatgcaaaagggtgccctttcgacccgactaggtattccgatgatctacggtattgatgccgtgcatgggcacaataacgtctacaaggctacaatcttcccccataatgtcgggctcggcgctaccaggtatgaagtgattttacttttgatatgataattacctcttacacaacaatacgtggatacttttttatgtttgactacaagactgcaacatcttaaggtgataacacagttgtgatgcacacagtgcttgttctaaaaaacagggtgcttatgacgcatttggtggtctgtatttaaaaaaatcttgattcttgatttgccgtgttgcagggaccccgacctagtaaagaggataggagaagcaactgctcttgaagttagagctactggaattccctacgtctttgctccttgcgttgcggtaattaatactagatgatacctcttctatagtgggtgatctcaatctggttagggtgcgtgttcccttttcatcagcactatgaactcactgttgtgtttacatgatacctctcaggtttgcagagacccaagatggggacgctgctacgaaagctatagcgaagacccaaaggttgtccagtcattgaccacactcatctctggcttgcaaggcgatgttccatcaaatgatgtaggaagaccatatgttggtggaaggtatacctctgatactgtatagctttaaaatcatctttgtggcttgtacctttctgcctataattgacaggtgaaattggcgtatcactgcaatatactactatatgactaactttggtactacttgcttactgtgcagtaagaaagttgctgcatgcgcaaagcactatgttggtgatggtggaacggtcaagggaatcaacgagaacaatacaatcatcgatactcacgggctgttgaccattcacatgcctccttattataattctatcattagaggagtctccactgtcatggtttcatactctagctggaatggagtaaaaatgcacgcgaaccatcacctaatcactgattttctcaagaacaagctccgcttcagggttagtttttctaaaaaaacaaaatagttatcttgatttattttcttcaatgtatatttggagatattgcaggcgtatttaattgctttggatcttgtgcaaacagggttttgtgatttctgactggcaaggcattgaccggatcacttctcctccgcataagaactattcttactcaatcgaggctggaattggtgccggcattgacatggtgagatatgcagaccatgtgcattaacttcttcccttttttttaggaagattgaattatatccctagcctctatgtcaaggacgcataaagtcatagttaatttctcttttgaaaatccaataaagcatttgatttgttagtctgtccaactttagtttgtgggataaaaggtggattcaacaattaaaacatacatcatgttagaagagtggtcttgtcttgttattacgagtttatgacacatcattgatgagccttttttctactatactaatacagatgcgatgctttattccctttcttatcaatttatcatgcctaatgtatatgtgctgtttgcagatcatggttccttatacctacacagaattcattgatgacctgacagagcaagttaacaacaaaattatccccatgagcagaattgacgatgctgtctacaggattctccgagtcaagttcaccatgggtctatttgagagcccttttgctgactctagcctcgccgatgaacttggaaagcaagtcagtgctgaacacctcaatcctcctattactcacacttcatatatcaagaatttttactgaccaattccatctgaaccaccataggagcaccgtgagctcgcgcgcgaagcggtcaggaagtccttggtgctgctgaagaacggaaaatcctcctactctccggtgcttcccctcccgaagaaagccggtaaaattctcgtcgcgggaagccatgctgatgatttgggcagacagtgtggaggatggaccatcacctggcaaggacagcccggcaacaacatcactgctggtaaactattcatgatcaaaatgtttcaatgcttgtaacttcatctgagttttggtgggtggcaagaattaaaatccacggacaatgtgcaggcacgacgatcctgtcggcgatcaaggccaccgttgatcccagcacgacggtggtgtactcggagaacccggacagcagcgtggtcaccggcgacaagtacgactacgcgatcgtggtggtcggcgagccgccgtacgcggaggggttcggcgacaacctgaacctgacgatcccggagcccgggccgacggtgatccagacggtgtgcaagagcatcaagtgcgtcgtggtgctcatctccgggcggccgctggtggtggagccgtacatcggcggcatcgacgcgttcgtggcggcgtggctgccggggacggaggggcagggcgtggccgacgtgctgttcggcgactacgggttcaccgggaagctgtcgcggacgtggttcaagtccgtggaccagctgccgatgaacgtcggcgacgcgcactacgacccgctcttccccttcggctacggcctcaccacgcaggcgcacagcagctgatgcggcggcgatgtcggtggagagtgacgttggttgggacgtgacgccgtcgtgacgagagagatggcgatcatgtagtactacatacacatgttgttggggtggatttgtttgtggtgggggaatgcaataacgatgagagtgagtgatgtgctcaattcttgaggctgtggctgttgttagtgtcatagtgttgggttgtggaataataaaaaatcagatgcgcttttgccttctttctctcggcactcagcttgtgttgcgtcattcttttatgatgaaaggtagttcatgaaaacttagtactattagtcgaaaataaggttaaataaataaaatctactaccgagtagctccccactttgagaagaaagcgaaatggcacaaaagctatcacctgaagaatccttcttggctatcactatcagcgctgtcatccgagccaacccggtgccatcgcgacaagcaaatcgcgcccccgctgctcatcgagagattctgcaatgcactcagatcgtcgcggaggcgatggttccttgggagttgggacaagtgtagtcccagatttttcctgcattgaatcgatgcgtggcggagccctcttctcccggcgacatcctcgccgttctccgttgagcgccgcacacgatcaggctcccgccgcctcagtggccgggaggacggggaggggaatggaattgcggcgtgagtgcggcccaattatatttgggccgaaacggcattgcggtctacgtgcgacctgtcatacacgggccggaaatcgactgtggccactttgagtcccttatgtcagtggccccacaattttttttttgaatgacgaataggtcccatatatatgttttaaattctaatgtcgcctaagtctgggagatatagaatgaaagaaatcgtaggaccttctaacaaaagaagctcctagcaaccagcttgctagccaagattaaggaggaagcaaagacatgggttctagcggacacaaaatttttttggcaactgtcttctatatagttagcacggtccaaaggccctgagcttgtacatttctttctttctgccatcttgtgtagtttactcctttctctattcaatgaaattggcggctcgacgattcgttaaaagaaaagtcacctaagcgtcatatcaccgccacaaatcagaacaacactgccatgtcagcaaaatcgtcaagggagtaaaattgtaccggttttaatagttgatagtttgagatatctggttgttatcgaccaaatttggtaatatcagcatcagaaaaggagattagatcgaagtggagtcggaggcagagatcgattcaagaacagagcaagaatcggctggagtccagatcggctacaattaggattggctgggtctgagtcggactaggtaagccgatgcagccgattccgacagtataacttggtgtatgccatcgggttgaattgaggtgcttcaagatcattgccacacatggatagagtcctgagaatgcaattgtatctattaattaggatgttttatgtaattttcttagagatatgtttgggcaaaagtctgccgcaaagacttatggtatcttagaatttgttagagataatggtcgtgtccggtatggacatatcttgtaattctcgggtataaatagacctcgagccctatgttatttttaacacacacgttcaatacaatttcggcgcatcatcaccttttgctttagttttatttcgacgagttcttactttcgggttgagctgcatcggtttcgatctttaacaagaggtaaaacttgttatgacggcttgtgttctcgggattagtgcttccatctttatgatactctaatcctgtttatataattcgtcgagttatcatatatcttacataatctctagcaatatcgccatctaacttacgatcggctaacatctgtcagtggagggcagccgattaggttagattccgatgttgatttagattatgtaagatatctaccactctatgaaacttccagcggcttgattgtctagatattgttcttcttttcatacttaatgctgcatcagttgagtttgatccattaaatcgtgcttagaatatcaatctctagcctgccttctggttgccgattagggtagtatcggagtttcagccgatcttatctgatttaaccatattcgctctatatgcttcagtgacatgttaaatccgccctttatgttaagatcttattgcatttaagtatattaggcttttatttgatatattatacttgttttgatattgtcggtgacatgggatcaggagtatcatgactagaggtttgaggcagacacaatcgcacacatggcctggtacccccgagggacgtcgggcccgagggtgatgtgttcgccctcctcttagtccccccgagggggtcgggcagcacccccttcggccagaagggcaaaggcgccccgacccctagtgggtttntgctnngggtgtatgggttaggtgagnacagtggggctcacctaaccacatttattgcggttgggctgagcgtgtcacgccacatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacgcgtggtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaaagagagaaatggtgcatgtggtatccccttaagatataaaaggaggaccttgcccactgagaaggggactggacttttcgagattagaaacccagaacaagggagaggctggctcatactttgtagctccttcatacacagatctcccacaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacatccacaggaggtggagaagggcggcgagatggggagcgtcgcctcctcgtctacggcgacggcagcacgccccagggcgtgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcgtcatcaagacggagggcgcggcgagcggcagccgctgttcgccattcggccgccactccttcgtcaacgcctccgacccgggaagatctgcgtggggaaccggatgctcgcaccagtatcgagcgccggcgtaatggccgacgtgctccccacgcaacggagggcgcctcctcgtccggagtgtcacctcaccacggacgcggggatcagccctccgtgcccctggttggtggtgtcggttgtagggcctttgtggcgagccttcggaatgtccgttggcccccaaggttccggcccaccatctccgaaaaatatgacgggagcgtcaaccccgccgagtttctccaggtctacacgaccgggatcgaggccgccgggggtgacgacagggttatggcgaatttctttcccatggccctgaaaggacaagcgcggggttggctaatgaacttgccacccgcgtctgtttactcttgggaggatttgtgccaacagttcaccatgaacttccaaggcacatatccgcgcccaggtgaggaagcggacttgcacgcagtacagcgaagggatgatgagtcacttcgcttgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcctaaccggcaagtggtgcaccgtccacaatacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcaatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctgtatccaagcccgagggtggcgacgagaggcttggcgcttccgcccccgccaccccgaggcaacggatgatcacaggcgacgaggtcccggtcaaggaggttaccctgggcgacggcccgtccaagaccacacggatcggtggtcttctggacggcaaataggaagacgcgctcgtctccttcctgtgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgtgaggaagtggcgcgacttctggaggccggattcatccgtgaggtcatccatccggagtggctggcgaacccggtggtcgttcccaaggcgaacggcaagcttcggatgtgcatcgactataccgaccttaacaaggcatgtcctaaggatccttaccccctgcctcgcatagatcagattgtcgactccactgcggggtgcgaccttttgtgttttcttgatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctcagcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggtgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacctgggaaagagcagggagaagaggcccccgagccaaacggaggcctaaggcccctgacgaccggagttggccctttgcccgcttgtccgacgacgccaggagcccccgacccccaggacggccccgaagccaccgtgggaaggccgcccctgttatcctccgaccccgaggtcatcagcacagaagataagtgcgccccgtgaggctgctgggacgaagagtgcaccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccaagcggagacgtcctcagatacttggtccgcctcgactttcgagcgaccaataacatggcagaatacgagggactccttgccggactaagagtggcagctggactggggatccgccgcctcctggtgttaggcaactcccagctggtcgttaaccaagtctgtaaggagtaccggtgctctgacccgcagatggacgcctacgtgcgccaaatacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccgacccccgaggcccgtcggagtccaggcctcgggacccgaggggagtgctcccaactcccttagattgattgcttggatcgccgagatccaagcatacctcacagataagactctacccgaggaccgcgaagggagtgaacgcgtccattgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccaggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaaaggccaagtggagcgcgccaatgcggaaatcctcaaaggccttaaaaccaagaccttcaacatactcaagaagcacggtgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccatgtccgggcccgatcactctgcgtcgacgacctcgtcctacgccgcgtccaaacgcgtgctggattgagcaagctttcaccaatgtgggagggtccatatcgagtggtcggcgtcccccggccgggctccatacggctggccacgggcgacggcactgagctgcctaacccgtggaacatcgaacaccttcgtcgcttctacccctgaggggggggtcgggtgtcaggttttgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgttcagctccttcgcccgcgcctcgagctcagcggcccgttggttcagtacggccctctcggcgcgggcaccttccagattgcggcgtgcctgctcctcctgcgctgcctcgcggagggacaggctaaccgccagctgttgcgccgcggcctcggccccctcgagagctcgctcccgctcgatgagcgcgtcctcgcggaggcggagcgtgaattcttcttcggcgcaagcagcctcgtgcaccgccagcgttgcttcccggatggtgacggcggcctcgcggtccgccagatccctctccacgacgcaggtgcgctcttccagcgccatggcgcgcgcctcaagggcctcttcacgctgccgggacgccgcttcggtctccgccgcccgctgttctcgggcagcggcagcgtcaagcaccccctgggcggcgtcgagcttcttccttagctccgcctcccagctcccgtattgaaggcggagggtgtcctgcgcctcgttcatcacggtggtggcaatgagggcagccccccgctcctcctccacttccttggcgatctccgccagcaccttcttacaggtctcaagctccgagacgtgccggcggtgagccttacggcccacctccaccatggcctccaccgagcgtcgcccctcttcgacatgcgcccacgcggcgtcgagctccgcccgctctgcctgcaggacctccacctgggcacttaacccatccaacaccgtggtgtttgcggcggccaaggcctgcagaaggggctctgcgttcagtggggcgatagaaggcgtggggaagagccgccttggagaggatgccacgcggctcgggccgctgatggaagtgccggactcggggatgtcccccggacccggttggtcctgagcgtcgcccgagggagtgggcccaagcgacgcgcccgcagcctcgttgccagctgccccagaagttgtcgcctgagcgtcgcccgagggagtgggcccaagcgacgcgcccgcggcctcgtcgcgagctgcctcggaagtcgccatcgcctcgtcctggcgaaatccgacttcctcccgagtggcttccccggcctggcgggctcgggcggcctcctcccgagcggtttcctcggcctggcgagcccgggcggcctcctgggcggcctcctcggcttcccgtaggcgatccgcggcctctcgccggtcagattctcgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttaagagaatacagtcacgatgggtgagagacgaacctgcgggggggtcggttaaacgaccactttggaggggaaatgaggtttccccgagatggttctgtctcccccatcttgcggggccgcttcttcttgcgctccccctcgggctgcgatgttggcgcggccccctccgggcgcctgctgctggcacgcgccgccccgccccctcggggaggagatgggggaggtgttcctccctgcttcctcttcccccgggcgtcggcagggcggctgctccccggacccctgtcgcgggacccagaagcacgaccccctctcagggtagattgttcccccctgcggctcccgcctgcgccgtcgtgaccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatctgacgacggagatagtcgccgtacaccatggcccctgtgagcccctgggatcgcaggcccgccaggcggtcgaggacggcgtcatagccatcccccagatctaccgacgcccgccagctagaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaatagccgaagagatgggcgcaccccaatgaacatctcgcacagatgcgcgaagatggccaatgtcatcaccgcgttgggggtgaggtgcgccatctggaggtcgtagaactccagaacatccatgaagaaagaagaaaatggcggaatcagccctgccattgcaaagggaagaaagaagacggaccgccccgggtagtctggcgccgggcgtccctcgcccagcgtgactgtctcccggccggtggcagattccggcatgaagcggcgcgacagcccagcctgcctctcgctcacgatccggaaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaagaggaataatggcgaaaggaaggaaacagatcccttcctcagtgcctttatactcttgccagtgctgtgcccggctcctcgcttctcgcgcccactatttcgccccctcgtttatcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccagttgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgtgttcgccctcctcttagtccccccgagggggt

SEQ ID NO: 67348 - DNA, 12252 bp, Oryza sativa
ttatttattcgcatgcagagttaatttacagcacgaaccgtgctaccaaagaccaacaaggcttactgcacacagtcaccgtcatttattccactaccataatatatacacatgacatgtcactcttttaacagagctcgatcagacactgcagcctgcaaccacctccaatgagatggacagtgaaagcactcctcatgcgtctgagcctgcaacggagggtgggaagacccctctcccgggctggcgatcagcaaccgatccgtgccgagttagcaactacatgcagcgaaacatcacatccattatattagcatttttttagaaaaaatattattttaataaaaacttgtaaaaccacaaatttagcaccatgtcgaacacatgacacatggtgtaaggtagggttgttgtgcagtaaaaaaaagtgatatcacatgatccatgagctatgactaataggaaagcaagcaactgtactataggtggccagtgggtaggacctatcgaacaatgaaagtttgataggccatgcactccctttttaccaggcaaataacttcgtcgaacactagctcttcgatgctcttatgtggcaccatgaaaattcatatcactcaatcaaattttgatcgatatacaccctatcaaactttgcttattcaatatggtgctaaacttacaattttagcaaaatagtctctacttttgcaatttcccattaatatagtattatttctaaaaaatattatatatatatatatagaataattagccgctgttcaccatacatgcattaatcaacttggttataattttgtcgtttcgagcgatacaccgcggtttcgtacgtaccttggcgttgacgccatcgggcacgatgcgtccctcgctcttaagcttgaggtactcgtcgcgcttgaacctggtgaatcccctgaaaaccaataaaaagttaaaaaccgagacacatcatcatcagatgacacgaaagaatttatatcatcctggccgtccatcctgacgaacgtaccacttggcgctgaagatgaccctctggcggccggggaacttgaacttggcgcggcgcagggcctcctgcgcgtgcgcggcgttcgcgtcgcggcatcgcacggagaggagcacctgcccgatgcggacgcgggcgcacgtccccgtgggcttcccgaacgcgccgcgcatcccggtctgcagccggtcggcgcccgcgcaggacagcatcttgttgatgcggaggacgtggtacgggtgggcgcacacccggaggtggaacgcgtccttgcccgcgtgcttggccatgtacttgttgcacgcgatccgggccgcctccagggcctcgctcgacacgttctccttctcccagctcaccaggtgcacgcacagcgggaagtcgtccgcgctccgcttcttctgcccgacgtcgaagatgcggatcttcgggtcgggcacgccgcggcagtagcgcgacttcgggtacggcttgttcttgatctgacggtagcaccgcactggccctgcacgcacgatatcgatcgatcgatcacgtcctcgatcgcgttgtcattcaagaaaaccaggtaacaacgccatgcacggcaacggccggcaacagctacgatatgatgtctgtgccgtggtaagttggttggttcggttgttgcttactcctccccatggcgatcgatcggcggcgaaaagtgtggagtcgcgggtgctggtgatcaggaagggtccaggtgcgtgtgtgattttgaagagatcatgcggaggccaggtggttgatgtgcgtatgtatatagatagacaaagaggagggcaggtgagtgcgcgaatgttctggttttgccggtcgggaagacgggaaggcgtggcggcgagaggccaatagacgcagcttgcgtttggactcgacgtacgcggacgcctcggcagcaggtgggtgggccgacctgtgagttgggctgagagggcgtgagttgggctttcaccgagtcgtactcttcgtgggcaagcgagaaacggccgcagcattctcaggacggaacgagagtactcatctatgacatagacggattgtaatggcaccatctctgttgcataaagcttgaagaaatgtagagatagttggcagtttctcttcttttgcattaagaagattcttgcatttgccgttcgtttacacggctcccggatgcgcccacgcgaaccgatcaatcgatcggtccggccatgtggtccggttcagttttcaggggacgtagtacatggggttggggatcttgaagacgcggtcgccgacgtagtcgccctgcaggtcgctccactggtcgccgacgttgccgcggatcctgtagccctcctcctccaccagccgcttcctcatcgccgacttgaacaccgacgagctctgcccccggtactccgggctcctgcattgtaccatgatattgcacgatcagatatcttactttctgaattttaaccatgcaacctatgctactaacaaagtagtattctgccatgggattgcgatatcttgtgcagttcgtcatctgaatgttcagctcagctgccagtatcattgatccattaacttggcagtcacaagccagcacttgacacgaatgctggggccattgaagcataaagattcgcggaattagcagaatgcaggatatgatctccggccctaatgcaggaggaaattaagggctttgttcactttgttgtctaaatcaatcataccaaattttggtaatgctaaattttgtcgtattttggtagtaccaaatgttttttgataatattggctttgcttggtttgatgattttattaaattttggtagaatttcaagagagtaagcttctagaactgttaaaatttggtaaggtagtaatggttaaagtgtgtttactttattgccctaccaaaatttgaaaggtttaaagtgacaacaaactaaacatgccataaaacatttttaaccagtgtaaaattttcacaacatggaacaagaacagaaatgtgatcgcacctcatgatgagcctctcataccccaagaacccctctgactcgagattctctgacgtgcaagtggccagtgtctcttcatccctcccggagaggaggaaaaccttgaaccccttggcttgcaatgtggcgaacaactcaagaaccgcaggtatccccgggcaagcccctttgctagcccacgtcttgaaggccgagggatcataggccctggaataaaaataccaacaagtcacgacatcgctggatatattaatctgtacttgaaagtactaattgccacatttccagcattaatatttttacttgaaagtactaagttttctgttttgataagctcatccaagccgattaaagaaaagattatcctattgatttagctactggccataaagtatcatttttaaaaaatagtggatattttattggataatggaattgcatttggcgcctgtatctattagggacgcacacaatgacacaacctatagaaaagaaaagaaacaaagaaaagaaaggaagacaacgtgaacatattatgcttagttttttttttctgaatgaaacatattatgcttagtatcatctaggctgatagcctgatcctatgttgagttatgtacggactaatttaacgagaagttgaagtacagagaactaaaaaatggatgagttcgaactcttccccatacccgaactgcttggcctcgtagtagagcaggttggagaggcatgtgtcgtcgatgtcgaggatccatgcgtcgaggccgtcgccgtcggcctcgacggtgtcgacgtaggcggcgacctggtccatgacgctgctcaggtccctgccgtactgcccccgcgtcatgtagcccctgacgtaggcgacgcacgccgcgggcaccgtgcgccaccccctggcgttgttcgcctccaccatgacccgccagctcaggcacccggcgtcgccgtccacggacgccgagtggcacggcctcgccgcgacgccgccgccgacgtcgaggacgacggcggcgaccaaatgcggcagcaggacgacgagagcgacgacggccgccgccgtagcccgtgagaacgccattggacgcagcttagctagcctcgatcgacctgtaggcatcaacaagcatgacattgaattatatacgtacacaaagatattcacctagctcatcatcgatcgcaccccatttcgagaccgaaagaaagaaaaagaaagggacacggacagaaaggaaaaaaaggatcatgatccgatcgatcgagacagagagagcagagcactacttcatgctactactactatacctcgatcaatcaactcgatgtgccaagcaattgctgaatttgcagcagctaagccggccggaccgggacaggatattgtacgatcgatgatgccccgagcaacaacttgcgtgtgtgtgcattttatagggaagtcctgcaggcccggcccccccatggcgtacgtgcagagtcaccaccacaaacgcaagagaaaaaagggcatgattacgccatggaatttggcaaggagcgaggaggacggcccggatatatgcacgcgacgcgacctgcttattatagctttaggattaggtactaccttacccctcctccggtgcgtgtgcaagttgcaccgccagcgctccaggtgtgcgccacgtggacccaactccgccgccggctacctcctccgtgacattgcccgacggcgacgtctcggccgtgtacgtgaatacgtgatggtgagttacgttggggccggctctggccgttctatcccttctcctttcttccactttgtagctgccgccaatcgacgagcgctgacgaattaagcttaaacatatgcaggctgctccgatgtaatccgcggctgagagagagatagattctcgagaatattgaccaccgagagggaagcctctagtaacggaacgcacaaacaatgtaggcttttcgccggtagctttactttccggcgatgtaatgggcatggtggatcacttgggtgcagaaatggagcgtgcattagaggcggagctagagctgccagcagctatgcttaaaaaccctcattaaccaatgaggggagtagaatacttgggaacgagagacctgtttggatcatttaatttctggactaaaattagttcatggcctaaaaactttagtccttactgtttagatcaagggactaaacggggagtaaagtcacgtggaccgagggagagagaagagtgaagctgtcactttagtcctataaatacctccaagagagactaatggattttagtcctatatgtactttttaagacccttttagtcgtctctgtttagattcttaaagattaaaaggaactaaaatagagagactaatggattagtcctatgaaccaaacagccaagagggcctgaatcaagtctgttgaagaatgaaatggagtatcctcgttattccccatccaatgagtaggtcaactcacgacaagatctcccaccgagcacgcgcattggtgcatcttcttcttttcgttttcttttaggttgtcatcgacaggggaataaaaagaagatgcattcaccactcgacactccctacatgtctttcaaaactctatcaagaacttcattttaattttacttggacttcccctccttttcttctctatactttctacattgtatcatcgatgtccggttaccgctcaaaacttctaattatggtcattattttgtacaattcaaaattagaactatcagctacctatttatttttagacagatttagagctttaaatcttgcagaatttttgacaaatgaatacaactcgttttgaaataaataaaaaaagatgaacatgtcaaaaaatcgtaatctagagaagaacttttgtaaaatttaatgttagtgcgttgttaatgaatgtaagtgttctataaccaagtataagtgccatgtaactaaatttaactgcaacttaggtctaaagaaacacgaatcttgatacaagatttatggaaaaaaaatcaaaagataggagctaaatatttatcgcaaatgagatagcaaaaccgtaattctaaattgttgtcatctttcactgttgtttatctacggccaagtcgatacgaagggctttgtttgttttgaagccagctagccccttatcaaaattttgacaactttaatagtatcacatagatgtttggattactacaaatttttgcttatattagtgttacaaaaacaattagtatggtaaaacttactaacattttggcactaccaaaatattaagagtaaaaattggctttaaaccaaacaagcgttggagatccatttattgggaagtcaaccaacttgcattgcgagtaagggagcagccacaaactcagaaagatttgtttgcctttgctttaactagcaccgaacaatcgaaagtatgcatttgtaatagaaatggctgtgtagtagccactcaccattagtggcagatggacaatagcctgcaacatatatctggaatcgcccgttcaaaatatatctatataacatgtctggaacgcacctaagaaactttagcatagtatagcccaccagtatcaacctttgtacagctaaattattgtatttcctaggcatgtagcacatatataatgggaatagcaaaaacccattaaccacattttctcggtgatgcacctaagaaaagatcatgcctgagctgtgcatgtacgctccatatcagattaattaattaaggcgcactgaatcatacataattcataaccagcagattttggttcgtcaaatttcttgggtgaaacatataaggggaggcctttaaagagcacgccatggaaacagaccacaaactttgaattctttatagctgtatgaacaattgaaggaacagccaatattcaaaactggctaaattgtagataaaaccatgaaaattttgtcaatcgtgtatacacaagatacttttcttcatgtcttaatactgtaatccaaaatttcaaaaagtagggaaagtgacctatactcaatggagaactcaatgctccactttcagagttaacacgtttagctaaatggggcactaagccactaactcaacatctactgaatttagtatgcactgctctcatcatgcatactaaaaatgtatggaaccgagtgacaaatctgaaatctgtcatgataagtaggctagaggctgggaactaacccaacaagtcattcaagtatttgatctgcaataaagcatcagaaatcagtcaaatccatatgaacctgattcacttattcagataccaatctaaaacatattttcattattattctctttaatcaggcggtattactgatactgttcacaatgtaagtacatgagaaaactattcaggtataggaggaaacaaaattgctcaaaaataagaacaaaaaaagaagaggaacaaaaacacgacctttctccatggctccatgctacgcagtagcaatcgctttgtagccagactcatcaatgtagttggctaaagctctgtcacccgtcttcactatcttgcccttttcctggaagtagcatatcagaagtattatcaataccaattcatgcccttcatgtagtactccatgtgtacctatttaattgatgcttgctgatccactcggtcagacatccaaattgcgacatcattgtttaaaagtgtcaaaatttggatatatgaaacctacatcactaggttttaaaaaaaaatttacaatattattttttatatatattatagtgatggaacatttaaaaagcagtggtcattggtcaaatccaagataccatcaaaaggcaaaattttcataagaaaacaacaggagggatagcatggataatgagcaatatcatacacgtttgctatcttagtatttatacatcttgagtggaacaattgtatataactcacatagctctttaccacctaatggccaactaaaatcacaatatattctgtgtaccaatgtaatgattagccagtgatgagtccaaaagagactctacttgaaaataatacaggattatgtaaattgaagtattaaattcatttgaacaaataaattactatcaattcaagtgcaattgctcaaaaaggaatttgtctatacgcttaccatgatgtgaacatagctgggcttaataagatccaagagacgttggtagtgtgtaatcatcattagagagctgtttggtgtcaagatcccattcactgctttagctacatattcgagtgcatcaacatctaatcccgaatcaatctcgtcaagaagagctaaatcagccccaaggacctataattgataatgagaaaacaaataagaggcacaaatttatcgaagtacataactagatagtcaaacaaattcttctgacaggtaaaaatgttcaaggaagcactgtctcataaaatattatcttctagcacttttttcaggaaacttttgcctatatttattggtcataaatatatcagtgaattgcattttggaccacagtttcacgccgccgcccacggtaagacctaacgaaacaagagcgttgcattaaaaaaaatcacatttaacagaacatggcatctggaagagaagttcagtgaatcttcgtggcataaaacactagtttctattttattgctgagtaataaatgtaagaatatttctccagatttatgttcaaacgaaaagtgtgtaatgttcatttgacaactaaactaagacgccacatagtttcatagtaatcttacagagagttgcagaatctcattgcgcttcctttcaccaccactaaacccttcattgacagcacggttaaggatctctgcattcatattcaaggcattaaccttttcctctataattggataaacctgtatgataaagagaagttatgtcagagttcctagcaactggaaataacccaacagtaagaaacagcaaaacaagaaacgattaggttagaaaacaccaccaagctcacttgtgttattaaaatagaaagttctgcatttatagaaaaacaaacaacgtagacaatggagtctgggacatgttaacttaaccccagtcattcctataagatattaataggataggtcatacatcgaaatagtgagaaatattaataggataggtcatacatcgaaatagtgagaaacacatgatgccttataattccctttgtaaattaagagtgcagttttaaaaatgccttacaccataagtataaattgcaaacctggagaggctctaatgctggtaaacccttcttctctctgcgagcatttaatgccatgagcagaaaatcgtaattgttcactccaggaatctcaacaggtgcttggaaactcataaaaaggcccgcaagagatctttcctctggctccatatcaatcaaattctcacccttaaagagcacggtaccaccagttacctcatactctggatgcccagccagaacctgagacgaaaggatgcaacagttcactgaagttttagatatcacagtaacaaacatggttagtttctcggtttaatcaggatggtgggaaggcacattgaacacttaggggttgatctccaaaagcacttgaacttcaagatcacaaactggattattctagttgcactttcttaatctggactaagaatacacacgaggcaaccagaaacctctttcatggatggcacaatttctcacagaagcaaatactagagaagccaggcggcaacaatacatataaacaattctatcgcaatcagaaaacacttgatgtattatctattattaagatagcttgaaaatgagtcaccatgttcgctttggtggctataaattaccacattaattggaggaaaaagaaagatctacaccgttagatcatggttggtccaaattaacgatgtagcgtgatacaaagtacaattccatcagaagctaaagaattgtttatcaaattcaatttcaccttaataatctattgtatacaaaatacaactgttacaggtgaaaacaaagttgagaggtgtatactaaatccaattcgacttccaaagtttagctcctcgcaaaattgtgcgagacaatctgctatgctatgctaataaaaacaaaaatatacaggaacagaagtgttacataggtaacaggcaatatttccgcacagtgtcgatcctagcaaagttcttgtcctaatatttagttttttggcagaataagaaatgaaagcatcgatcagaagcgccttaccttcatgagagtgctcttgccggagccattttgacccatgagcgcatgaatctatacaaaacaagcagacgaacacccaatctaagtaccctgcaacctcgcagaccccaattattaagaattttaagatagccacacaactagaccagaacgaacctcgccctcccgaatggtgaggttgacgccgctgaggatctcctgcccgttctccttcacgcaggcgacgagatcgcgcgcctcgagaagcggcctcccggcggactcgacagcagcggaggccgcggcgatcgagcggcgccgcggccggagggagacggagctcgggggcagatggcggcgggggagggggcgggacgaagaggaggaaaagagaggggaggaggaggatacggccgcggcggcggcggcggcggcgaccaagggcggcgccatgggagaaggaagggtgaggtgcgtgcgcctccagatgcttcttcctccctcgtcgcggctcggcttcggatgacgagcggcggcgtcgaatgctactttttatgggccgtttactctggagatctcgcgctcgcatataccaggccgaacttatgggcctaatgggcttagaaagttagtgcgttttttgggcggaaaaagtatactttgactccctcaactatggcccgagtataattcatgtcctccaaccataaaaacgggtatatcgactcctccaagtatcaaaaccggtgcaaacaatatccctcggtggttttggaggtggttttggttgacatggcgcttacgtgacgggcttgatcgagtctttgtcatacgtggcgcttacgtggcattagaataagaacaaaattaaaaaaaatatgtggaacccatatcattcacataaaaagtaggaccctctgacatgtgggacccatatgtcatcctccctccctttctcccttatctctctcaggagcggcggcggtggcagtggccgggaatcggctcctctacgtcagagggacgttcgactcccgatatccgtcgcttgcgcatccaacggctccggtccgcgagtgcctgatgtatagcctttccgtacggtgcacatgcgcagaatcgtagctgggagctcacgccaaagggaagcaccagccaccggagccgtcgctcgagccatagcctagcgtcggccgacgagaattaagctctgtccgcgggcgtgcagtgcgcggaagtggagcgctctggtctgcttctcgacgaggtagctagtcggcggccttgctgaggaagctaggatggagacgcctaggaagacgaaggtgcaggcgagcagcttggcagcgtcgttggcgggacgaagtcgccgtagccgacggtggtcatgtgtgtgtccttgtttttagcagcatcctagagtagattgcatcaggtttcaatttctgttggcatcgtattccttcggacgtgcttagttcatgtcgcggcgtatccgcgtcgtgcgctccgcttcgctcgtgtgggatggaacacattcgcggcaatggcagcgaggccacgatgcatggtgagtctttgtattctgcaaataaaaggatgagaaaacgaaaagctgcagtgagccagtgacacacatcaccaaaactccctctgtcgaacaccttgtgagtgcactgttcattttcttcctccagacaatctaggagtttgtgagccaaatcaccaattggggctgtcaaaggacggcgagaagatggggggagccaatcaatgtgtccctcgacgaaataatccatgggaagggtatgaacacgaagcacgccatgaaaatgtcgatcgacaaggacgatgaagaggccaagatgacgatggcggcggcggcggtggcggtcgg

SEQ ID NO: 67349 - DNA, 12211 bp, Oryza sativa
acctaagttcccgtgacttgctgagtacgaaagtactcacccttgctctatataaatatatatatatatagttcctccgccctgaagagaagataaagtgaagagaagattagggtttcgtcctggttcccagccgtcgcctgtggtgttgggtgttagttcgttggttccgctgctgctgctgttgttggtgtttcctcgtccgtgtcgtcggttgcattctcggattgttctgagctgcaacctaagttaaggtaaataagtcgactctatttattttaaggattgctatgattcatatttgtcaccgtgggtaccagcactatgtcctgggactggtaccgagatcgcggtttcgtaggaaacggttcacgccgttttccctacgacacgctcctgtcaggtgccgttgtacggcggtatcagattggggtgtgacaccagagtacatgttctggaatattacagaaacttatggaatatgtctatttccattgtattcaagtaaacctctctctattttcagtcatttccatttctattcttttgtgccacccctttttgatgaagatgaatttctcttctttttgccttctaattcagccccagaattatgcttctcctgtgatatatcttgttgcaaatcttttcttttgtttgaaacatctttctttttctgctctacaccatcctgcaacaaataatatctttctttattacttttttaaaaaaattcaattcatatggatttgtaatttttgttacctgttctcttgtatttttaacctttcttctcttcttccttggcaagtcaaactcaacgtgtttcagagggcacgttggaaatgtgtgatctgtcctctgacaatgactgcaatgatatagttctttttgctgtatttcttccctgattgtcttatatctttgagctggcctgcctttggattttgcaatatctggatccaacaatatttcttctgtattttcctcagattgttgattgcctttttcatgtgagttcaaattgtcttctgcatttggatctgaatcattgatctcctgctcagcatctttatttgaacacattaattccaattgtttagcaattttgtccatctcttccactgcaaactggaaagtttcattgcttttcgatccatttgatgctatttctgcacttttccttgacaaaatgttgaatctcaggattgagctctgtgctaaaggtatatttccattgccttttcccccaagacctttgtactctttttttgtccatctttcaataatatatttttctggtatcttcattgcattgaggtggagcattactttcaatacatggcagcatagaagtccatctttctcaaactttgagcaaatgcagttgaaatcctccttttccaagtccacaataacaaggtacttccttcttctgattacttgaatattttgattcaatgccaaaaaaaacttcataagttttgaacttctctacttcatttatttgaaatctagttgttcttttcaactcaacttgaaacttgatgaagattttgcgattatacattctcattgcttggtactcaatgtagtaatgggaccaaagtttgcttggtttctttgtccttgaaatgtgatcatcaaactgttccaagttttgaattgtatccattactctttcatactctatcatgaagtttgtaatgctgtactgtggaccaacattattcttaaaccttgagttagtcccttcactgagagctgtgctttttataaatggacagaaatcacccttgaaatacactggaataaatctttttctaattgaccacatgtgctttagaaaattgatatgctgaacttcaaagctgtcaatcatttcttgccataaatactcaaattcttcttctgtaactgagttatttatgatgtcttcatactcatcatacaacccttcttttgctttgaacaaatttccaaatagattgaaagctttctttacaatatgaaagaagcaatttatgtgctttgcattttgaaatacttgagcaattgctgatctcattgctccatcctgatcagtaatgattgtttttggttctttttgtgacatagctttcaaaaaagttctgaacagccatttaaatgtttctgaagtctcatcatgcaaaaatgcacaaccaaaaacaattgtgtttccatgtccagaaattccaacaaagggagcaaacgggaggttgtatctgttggtgaaatatgttgtgtcaaaactcacaacatcaccatatttctcataccactccctcgatctcccgtctgtccaaaacagatttttcactttcttgctctcatccaaatcaaactcataaaagaaatgtggatctttttcttttttccttctgaaaaattctaaagttttcatcatatcattgctgcttgtctccttgttaattgtggttctcacattgcttatatctttcttcgtataaggcaaagaagtcaatcctcctcttagaacagataaaatcacaatcatgtgccttgttggtatattacattccttcaaggtccttatgagcattttttcttctgtagtcatgtgtttgtgtgatttgagaaatctcacttcatctcttggacttagttgatgattgtggtctaattgtacccttgaaatattccaaatctcattcctctctgaaataaccagagcacacttgcaatctgttgcatcattttcatttgtatttctttccgaaaccactgtttcctctgcgcttactggtttggattgagaagttggtttgccttgtctattacatctgaacgttactgtcacgcccggaatttctatccaaaattccaaacgcttacatgtgtgtgaactctcgtccaggaatcagccgaggcacacaataacaaattgataatagagtacaattattactctaattaataagcgaataaaatgtcattacagaggtagatagttcctctcaatcaataaagatctaagcagcggaaaaaataagataaacggcgcagacgactccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggtttcattttgcaaaagcagcatttagcaaacatttgagaatttaataaaacagttaagtaataattaaacaatattaatccaacgctatacaacataccctgttgtataggcccaaccattctgaacaaccatcccagctgcacagttctatctccaaactaggaatataccattccaaaccaggagctaatcaaattattaccagttatagcatcttttattatgatgagaggtgtgagactaatcacgaaagacattgttagacccgcccataaccgcgggcacggctattcgaatagttttactctgatcagaggtgtaccaatgtacccacaagacacagccccacatcatgtcaccatgtgcctcaataccaccacggtacctcggaaaggagctgtgacaataccccttgcacaacacaatccactacagcgcacctttcctggatcataatcacccccttataaacaaggcatggactccccagcgacccccgtgggcttatctccgtcacttctcagtctggtgctccgcaatgaaccatgctatacaaaaggtaaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaaataatagtaaatcttaagttatcccaatagtgtgctaatgtttctaagcagggctaagcaattatatctaatacatctagttgaaccaatatatatatagcccaactagtcaagttataacaacccaaggtatcaaggaataaagtaatcaagaacaaaaagggctataacaaacaataggttaattccacccaatgacattcgaaaataaatgcaatagttgaatagaaacgatagctttaaacgggatcaacatgctcaaagggttgtttgggatctgtgtgacttgccttgctgaccttggaactcttcaaactcttctcctgcgaaaacggactctccggaaacgacggaatctaagcagaaaagagcaaaatcaccaaaacagcacaaaaacaagcatgaacagtacatgtggatatttttaacatgtagatctcaaatttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggtttcgcggtggaccgggcgcacggcgacggttcacgggaacggacggccgagatcgatcttatccaaaacggacggccgagatcgaccgatccacggccggaccacgagagacgacgacgatgacgtcagcggtgacgtcaccacctgcggcggctcgggagcacaagctcgccggcgaacgatggcgcggcggcgcgaacggagggcaccaggacgtagagggcgacgcggcgaactcaccagcgaccaaaacggcggcggaagatcaacggacggcgacggcgtcgaggaagaagcggcgtcgaccttcggcttgacgacggcgacgatgctccggcggtcttcagcgacggcgaaggggcggacgaggacggcgacgcgacggcgaccacgatggcgacctccccgagcgacggcgacgactggagcgacggcggagcacggctggagcggcggcgacaacggcggcgcgaggctacacggggctagggctctatcggcaacgagaggcgaaggcgagggtggcgacgggtagcggcgactccgggggtccttttaaaggggctaggaggcggcggcgaaggcccacgatgaccggcgacgctatggaaacttcggggttcggaggaaagagaccgatccgattcgacctcgaataaaacactttccaagccgatttagccgatgattccaaaagagaaaaggtagaggagatctcgggaaacatttcccctcaattgatttcaccgggaaaggaaaggatcggccgaatttggaaggaaacggcggcggcgcggcgctagggtttcgggcggcggcggcgcgacgaagacgacgactccgacaggcgggacccacctgtcagctacagcgagggcgcgcgcgcggctgcggactgggccggcttgggccgaggagagagagagagaggatttgggccgactttcggcccaaagccaaaagaagactttttaaaacctttttcaatttaaattattcatgaaatgcaattccatttattaaaaatacttccttagctcaaataaatcccagaaaaatctaggaattatagaattaagcaaagtatttaatgaaattttatctggccccattttatgttggaatttattaattaaaattagatcttctcttcaaagatttttaaaatcatttctaaaaaattccatttaaacaacaatttatatattttgaatttttaggatgtgacaaacctaccccccttaaacagaatctcgtcctcgagattcggaagaactggcgaacagatgcggatgagctgacttcaattcatcttctcgttcccaagttgattcttcttccgagtgattactccactggactttacaaaaacggataactcgattcctggttcttctctcatctatttccaagatacggattggtttctcaacataggtcagatcctcttggacttctatctgttcaagattagcttcttcggtaggtacccttaaacactttttcaattgcgacacatggaacacattatggacgcctgccaaattgaggtaattccaactgataagcaacctctcctcttctactgacaatcttataaggtcccacaaaacgcggtgccaattttcctttggtatgaaaacgatgaacccctcgaagaggcgtgacatgaaggtacacataatctcctgcgtcaaaacttagatctctccgacgattgtcggcataactcttatggcgagactgggccacacgcaatctttcttgaatgattttcaccttttcttctgcttccctcaagatatccgtcccgaaaacctgacgttctcccgtttgatcccacaaaagcggagtgcggcacttccgaccatacagtgcttcgtaaggagccatctgaagactagcttgataactgttgttgtacgaaaattccgcataaggtagattcttatcccaacttccaccgaagtctaaagcacaagctctcaacatatcttccaaaatctgattcaccctttcggtttgtccgtctgtctgcggatgataagcagtactaaagttcagcttagaacccatctcttcctgaagcttcttccaaaattttgaagtaaactgactgccttgatcagacactattttcttagggacgccatgcaaacacacaatccttgccatatacaattccgccaaccgacttccagaatatgttgtctttactgggatgaaatgagccactttggtaagtctgtcgactatcacccaaatagagtcatgacctgatgacgttctgggtaaaccagtgatgaaatccataccgatttcctcccatttccattcaggaatcttcaaaggctgcaacaaaccggcgggtttctgatgttctgccttgattcgctgacaaacatcacatactgctacgtattctgcaatttcacgcttcatacttgcccaccaaaatctttccttgagatcctggtatattttggtactaccagggtgaatggagtataaagtatcatgggcttctttcagaattgcatcttttaaatctttgttgtcggggacgcagattctctcacccaaccatacagttccttgctcatcttccaagaaaccgatagcttttcctcttctcatattcttcttaatttcttgaatatcaggatcattaatttgggcttctctaacttgatcaattagagtgggcttcgcttctaaggctgcaacgaaacctctactgacaattcccaaatttaatctttcaaattcctcgcataattccaatggtaactgtcatcctttctgctaagagcgtctgctacaacattagcctttcccgggtgataatgaattcccatgtcataatccttaattaattccaaccatctccgttgtctcatgttcaaatccggctgagtaaagatatactttaaactcttgtgatcggtatacacctctgtacgagtaccgaaaagataatgatgccaaattttcaacgcatgaactactgcagctaattcaagatcatgagtagggtagttcttctcatgcggacgtaactgacgagatgcataggcaaccaccttcccatcttgcatcagaacacaacctaaccccagtttggatgcatcgcaatacacttggaaacccttctttggatcaggtaaaatcaaaataggagctgatattaagcgattcttcaactcttgaaaactctgctcacattcttctgaccacttgtacttcacatctttctgaagcaatcgtgtcatgggcttagcaatcttggaaaaattttctataaacctccgataatatcccgcgaggcctaggaaactgcgaatctctgaaactgtctttggttgtttccagttggttacggattccacattactaggatcgacggcaactcctcctgctgagatgacgtgaccaaggaacttcacttcagacaaccaaaattcacacttactaaacttagcatacagttgatgttctcgtagcttttctagtgcaaggcgaagatgttctatatgctcttctttggttcgggagtagataagaatgtcatcaataaagaccaccacgaacttgtctaggtattccataaacaccttattcatcaagttcatgaagaaagcgggggcattggtaagtccaaaagacataacagtacattcaaacaatccatacctagtggtaaaagctgtcttaggtatatcttcctctttgattctcaactgatgataccctgatcgaagatctatcttggagaaaacggtggcacctttaagctgatcgaataaatcatcaattctgggcagcggatacttattcttgatagtcatatcatttagtgcacgatagtccacacacatcctctgggtatggtctttcttttccacaaaaattactggagctccccatggagatgaactcggtctgatgtatcctttctgaagcaaatcgtctacttgccttttgacttctgccaactcattggctgccattctataaggtctcttatggatcggagttgttcctggtaccaaatctattctgaactctatatctcttttaggaggcataccaggtaaatcgtctgggaacacatcaggatactcccggactataggaatctcttccaaagttatttggttcagtcttgaccttaaagactcagaagacaatgcatgaattgttacaactcgaccatcatcactggtgagagttactttcctgttagcacagtctatcacacccttatatctggctaaccagtccatccctaggatgacatcaaggtctttggattctaacaggataagattggccagaaataatgatctgagaatttctattctgacagaggggctacgttgcaaagagagtgcttgattacttggggtattaaccatcaaaggacgtctaagatcttctacttccatcacatgatttcccgcaaaactcatagataagaatgaatgtgtagcaccagaatcaaaaagcactgttgcagggactaagttaacaaggaacgtacccaaaatcacatctggagcaccttgagcttctgtagcagcaacatgattgacacgggcctttggcgctggtgcggtagagttgctctgggcagggacagccttcacgcgtcggggcttcggacacttgtcagcataatgtcctgggtctccacagttgaaacacactacgggcttgctgccttgctccctcttggcaggctgttgctgtgttggagctgcaacagggcgtggagcttgattgcggatgttgttgccagcattgttgttgaagaactgacgctgcggacgaacaacagacgaagaacctccctgtggcatggactggggtcctaaagtaagacgcggcctctgattattcccctgttgtgtcttgaattgagcaatccggcgtttcttctgttccatgcgattgtacttgtcctcctggcgaatagccttatctactaacttctggaaatcaggataatccccagtcatgagtggataagaaagctcatcattaagtccttccaagaacttctcctggcgctcttcatcagtgcgtacatcttccagagcataacgagccagacgattgaactcgtgcagatactcggtaacagagcgagatccctgggtgagcgacctgaattccttcttcttgagagacaccactcccgatggtatatgcgtcttccggaaagcagcggtgaactcaagccaagtgataggttcagcagtaatcctattaaggcgggagtgatcccaccattcagaggcagggccatgcagctggtgtgatgcaaatgagaccttctcctgatcagtgcactgaagcaaatccaacttcttttctatggcgtgcaaccaatcaccagcttcaacaggattagtggtactagagaaaataggcggcctcacacgaagaaattctgctaacttgttctggggaggtgcatggttatttccctggttctgctggttctggagttgctgcatcatcatgttcataagttgtgtctgttgagccaggacttaggcaagtgtgggattctctccattgttgttgttgttgttattgttgttgttggggccattcccattgctgcgagtgagcaccatctggcatgggcaggagcataagaagagaaaccggggaaaactacttaggaccgagaattaatttaacttttattgatcttaagtgagtttcattattacaaaactgaagactctcacaccactaaacttaccaactacctaacactcgaaagcaaacaaacgcacgcacttacatcccaccactgatgtaaatcacatgcgagacacacacaaccaaacttaaacaagcaaactaacacaacgatctaagacaacggtttgacaaggcattctaggtcttccgggcatcggagttgattgaaggctcgttcggctcgtcttcatcatcttgagttgctccccactcaatcttggaatgggtgcgctttgattcatctccttcatcatcacttacattgacgaccggaggatccgctagggctggggtaacttctttctccaccacacggacctttggcaccaattggtagcgagggacaaatagagctctcttccttgcggtaagacgaatcctggccttctgcggtggtgcttctcccttcaatgcggctagttccttctccaaacgatccactttgtcctcaagcttgcaaatcttaccacgattccggtcttcacgatcttgggctgctaacacagtctccgcacgggtttcatccatagcccacagcatctcaaccaaatgccttgtggtagcatcattctcaattccctcagtctcaaggtagctgccacggtcacttccctgtggttggcgaggatggtagcgatactcagtgtcggccaactgatcactgtagcgatcaaggagctctcctatggcgatccttgccacctcctgacatgtatggatgtagtttcttcctccggcttcgaacatcactgagggaatatcttcactattactgttcaaggtgactttgactcggcacttctcttcgtgacgatcatgaggaatttgggcatagaaaggggcagtcccaaatcctatggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagccaaacttgcaggataagttgaaacagttggaaacaaggtcacaaattttgtacttttgaacaaccggtttcaaaagaaataaaagaaagttataaaatcaacatgctaaatttatttcattgcagcaagattaaactaaacaatattgtaaaacttttgttggtaaaatgagccattagtacagtaatagatgtacagtactaataacgctagaataaattttgaacgagaaccactaaaaaaaatattaggaaatgcatgtgccattagtttggtttaattaaaagagaaggggaggagaacagttctacttttccaatatttttagagggcttctatgggtaaccatttggcataacctagggtcaaggagctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattatagaggtagatagttcctctcaatcaataaagatctaagcagcggaaaaaataagataaacggcgcagacgactccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggtttcattttgcaaaagcagcattt

SEQ ID NO: 67350 - DNA, 74839 bp, Oryza sativa
ccacaagtccctcccggctcttttttctcttcctcttcgctctcctcatccagtcgtcctcgcagggagcggcggcaggagcatgccggcggacggaacggcggcggggcgaaggggcgggcggagcggcagtaggccgcggcggcggaggttgccggaggaggaagaggcagaggaggaggtcgccggcgagcgcgacagctacactccgtcggccgctccgtccgcgatgcctagccggacgacggcgcccctcctcactcggtagccgcacgcgccgcctccctcctcgcccggccgcctccgccgacgtcctcgatggtcacatccgggtcgaagctgcccttcgttgcccggctgccgagcgccgcctccctcctcgcctggctgccgcgcgtcgcctctcctcgcccggccgctgcgcgccgcctctcctcgctgggccgccgagcgccgcctccctcctagccgggcagccgagcgccgtctccctcctcgcccggccgccgcgcgtcgcctctcctcgcccagccgccgcgcgccgcctctcctcgccgggccgccgcgcgccgcctctcctcgtcgggccgccgcgcgccgcctccctcctcgatgggccaccgagcaccgccgagctcctcgccaggccgccgtgcgtcgcctctctcgcccggccgccgcgcgccacctctcctcgccgggccgccgagcgccgcctcccttctagccgggccgccgagcgccgcctttgtcctcgcccggccgccgcgcgccgcctccctcctcgccgggccaccgagcaccgccttccttctcgcccggccgccgcgcgccgcctctcctcgccgggccgccgagcgccgcctccctcctcgccgggccgccgcgcgtcgcctctcctcgcccggccgccacgcgccgcctctctcctctcccggccgccgcgcgccgcctccctcctctcctggccgccgcgagctgccatccctcacccggacactgcccgccgcctcggggatgggagaagggagagagaggaggaagaagaggggctctagttgaaaagagggagatgctgagaatgacatgtggggcccacgtgggccccaccatttttttattaatttatgtgtgagactgacatgtgggtcccacgaagtttattattttttcggatcaaattgccacgtatgcgccacatcaatgccacatcagatgaagaccaagtcaaatttgccacgtaggcgccacgtcagccaaaaccaccctcaaaaccgtcgagggacctcatctgcactggttttgatagttgaggaacccgttgtatctggttttctggttgaaggacgaaaatcggattcgttgacaagttaagggacctcagatgaacttattcctttctacacatgtgcctgagctgaatgtgtcacgaagggcatgtttgaaggattttctagctgcggcagttttccatataattttcagtttccttaaacggttcaaattatcacctaaattatgagaatatatggtaaaattcagaaaatgaattataaaccataagttcaaaaactgagtttctcccgattctcataaactgactatcaaccagcagaattttagaattttaagctcccctaaatagaacagaagaaagagttgaaacattaccacatgattaataactattataaatttttagaaaatatttgtttgatttttgaaagaaagtttctaataaaatatcccatttagcaacttagaaaacgtagaaaaaggaaatagctaagctaatcagctaaaagaacagggctttacaactaatcccttcattgcttggtgaacaacaatctcttgaatgaaatttcgtaaaaactgaactaattcacaccccatcagttaaaaaatataacaacttctagcatttcaaatttgttcctagatttagcatttttttcacctatttcatcatcttcatctaaactatcatgccattttttttattttagcttcttcatttatttcctcatcctaattgatcacaatcatcatttagtttcacattaatttttagttcccgtgaaaaatttcagaagtgctttaggacggaattagctacctattgtacacaatttacatggaacggtcactgatcatcgctgcatatcgcctgtatgagtttctttatttcgtatcctctgttggtttcttctgggagcacttgtcaagggcgtcaggccctcgggtagccggccctcggctacgtagcacgtagcctcggtctgtcgtcttctccggcgaggttgccccctgccgcaggcttagttgagagagaggagattagattggtaattatttgcttaattcaatttttacccggaatacaagataagtaggccaccggccaacaaacttagaaactactaatttggaaataattaaactaggaaataactctcctaaaatcaaggctagctactatcctcggccctgccttcctgcgcgctgattgagtctgctacggacgctcgggccgcggctctcctgacgtcgtgggctcgacgctgacgcacataggtgcggccccacatgacatctctcccccccctcaagatccagctcgtcctcgagctgaaaatccaggtacacggcacggaactcctccaagtcttcccatgtagcagaagaggccggctcaccacgccagtgcacaagaagctggcggacaccgcgcgccaagcgagcgctctccacccgaatcggctcagggacaacagcaccatggtggatgtcggggagcggcgttggagcggaaagtcgatgcagaaacgtcacgacccgtcagccttcttaatgagaaggactggtgaagagaacgccgagtcgctacggcggacgatgccctgctcgatcatagcggcgcactgccgttccagttcatccttatgggccgccgggtaccggtacggacgaacagcgacagggggcgcgtccggcttgaggacgatggtgtgatctcgagcatgctgcaggggcagccccttgggctcggcgaagacgtcgccgaagtcggctaggagctcatcgagtagcgactcgctggccgctgttgtgactcggatgcgtggtgcaggagacgacggcacgcctgcccagcagatggtgcggccgtggtactggaaggacatcgtccgctccgtgaagtcccaaacaatcggccccagagacgccatccactgggtgccgagcaccatgtcgtaacctgcaagtggaatgacaaagagatcgacggtgaagagcgagccgtcgatggagagcacggcctgtcggatgacgccaggacatgcgaccttctcgccattggccacagtcgccgtcatgcgtgggcgtggctggaccggcagacccgtgcggcacgctgcctcctcggcaatgaagctgtgggtggagccgctgtcgaggagagcggtgagggtggtggcgccgacggtcacctgtacctgcatggtgtcggcgaccggtacgccggcgatcgcgtggagggagaacaccggggactccaagtcctgcggttcctcagccgcgtcggtgtcgtcgtcgtcatccatagcgcagtccaagaggaacaagtgcttgcagattttgttatggccacggctgtacttctcgtcacagttaatgttgagattatgggtatataatgatttaatttattccataaataaatcatgacattacagatgaaaactagcatgaacgcctcattagatctacacatgtaaactacgcagaataacatgaacagatcaaatatgcgcaacatattgaacacgtaccgaggtgacgaaaagaccggctgcttggtcgaaacatttcgcaggtgtctacgaaggcacgaaacacgcgagcgaagaggaaggcgagccgtcgcgaacgaacagggagcagtcgcgtgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcacgccgcctgccatgccatgccatgccatgccatgccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccacaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatatagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcttgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactatggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccattatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggtgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcttgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaattccttcaggtttgccagtactcacccagaagcatttcatagctgtcagccacagagtgaccctgatctgccatctcttaaaatgcacaccggtgaatttatccggcctcagtgcatcagcaaaaccagccatagtaaaatcacagtgcctataataaggtttttggattgttgagattatgggcatataatgattaaatttattccataaataaatcatgacattacagatgaaaactagcatgaacgcctcattagatctacacatgtaaactacgcagaataacatgaacagatcaaatatgcgcaacatattgaacacgtaccgaggtgacgaaaagaccggctgtttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcctgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctgctgcgtgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacttcgtgcacgcgcgccgcctgccctgccaggccaggccaggcgagcgagcgcgcgtttcccctcttctctccaccacacatgcttcaagtggctaggagggcatcctcccttttaaggaggtcctcctctcctagaataagcaaggtggtactaaactccacatgcatgccatcccatgaggtgggcttttgtgattttccaaagaattaatcttcgagtgggctaaggtccattcattaattccaacagttaaagcatagcccgaggcggcgacgctcgtcctgctccgcctgagagagccgcttcaccgggcgaccgtcgatgaggacagggggcgatgcggccctaggcgccggcggctggggcggggcctggcgcggacccagcgtcggcagtatcccgtggccaggggctttggccagggtggcagtgcactgctccatcagctcgaactgccgagccaaactcatggcggtgacgagggactgcggattctgcatctggaccttgagactgagcggaggaagcagaccgccggtgaagagctgaacccgttgtgccttcgtcaggcggccggcgcggggcaggagcgcttggaagtggtcctggtagtcctccacggtggtagtgcggcggcagtcggctaactcgaagaggggagccgaacggagtggcggcccgtaccgtaggacgaggagttcccggaagcgacgccacgacggtttaccctcatccgcctggacttgcatgtaccatagctgtgcaccatcttcaaggttgtaggacgccatccaaaccttctcttcgtccatgatccgttgttggtggaagtacgactcacaccaattgaggaaggtgagcggatcggacttcccatcatagcgcgggaaatccattttctgaaatcgcggcggccggacggtgcggggttcgccggagtctgtcgtggcgcccgaggatgaggtgcggccggaggagagggcggcaatggccttggcgttggcggcgatcgaggcctgcatctccttcatggcggtggtgagagcctccacggaggtcttgaggtcattggggtcacccatgccgggtgggcaggacgcgccggaggacgagtccgaggatggtggcgcggcggctggtggtggcgaggatgtggcgggtggtggggagacggcgcggcgcggcgaggatcgtctggaacgtgataccaggttgtcaagggcgtcaggccctcgggtagccggccctcggctacgtagctcgtagcctcggtccgtcgtcttctccggcgaggttgccccgtgccgcaggcttagttgagagagaggagattagattggtaattatttgcttaattcaattgttacccggaatacaagataagtaggccaccggccaacaaacttagaaactactaatttggaaataattaaactaggaaataactctcctaaaatcaaggctagctactatcctcggccctgccttcctgcgcgctgattgagtctgctgcggacgctcgggccgcggctctcctgacgtcgcgggctcgacgctgacgcacataggtgcggccccacatgacagcactggacaccgaccagtacatgtcggcacagttttaaatccacaaagtttcatatccctttctccttggcccgatcagcgaccccgtaggttgtttgcaagtgtcagcacatcacatcctcttgggtttcttcttcgatcatctgacatctcggaagcttctgaatttttcaaatcacgtaaagctcaagtgtccatgtcactgatgcaagcagatagattagctcgttctcttttgactgagatcatcattaatgaacaagttattttggagccaaagtgtttaatcaatactccagttgttaattagtagatactcctactttgctgtgaaggaactaggaagccatgatcccggatcagaaaaagggaacgcagtctttagcctgaaaaagtatgttacacgttgcaatcatcgaaaattaagcaaaatgatcatcttagaaacaatgatccaaagcttgagctgcatgcactttcactttctccaggtcacactggatgctaccaatgtccatctgagatgcagcaatgcagtgccttttgtctcaagatcagagaagcttgtaacatacacacatctttgagtgacatgtatcagacaggtgctaatttgatttcacttcaactgtgtcatccctaataatttcagactttgagtggaatggttagaatggttagaagtctgcagatcaagttctaccataaaaggaaggatcattaacagtaatttgtactgttgtagtatactgcagtgccgttctgaagatgatagcactgccatttcctctgggagacagaattcagcaatccatgcaggacaggggcctacggtgtctctactcttaaggatgtcactgtcagctgatcaagtatactcccatcagagtaatctgcagagatgtcctcttggacttcagagagagtattttgttgagaaaatcaggatatctttctctatctagcacctctagccggccaggtgtaggaaagcagctactctcatttttttcaaacatgggaagatggatgaggtgtcattgtggacttgtggtggttgagcaccgtgttgaggataaacttggtgcatttctctgaatttctgactgaaaacatattcaggtttcagggaggtggaaaaggactggatctcgtgaattctgcttgctctcattctctccgatcatttgtcaccatgttaacattgtgcagctacaggaaattcggacgtgactcttctcacttttcttgatttcttcacgtgtggtgatagtgaggattcagaaaacaaccggttgaaaagggcatttttgtcgggagagaattaacgcagtggtgtgagtgggtgccctttttccctgaaaatctttgacaagaatgaacattttatctgcaaaatccaaagaagaaaccaaatgctgaaatgcaacgcctgccctggaaagattcttgagagaaaacaatggagataaagattcacgcaaaatcgagcagcaaaattcagagaaatataccactgtataaactctgcaccattcggttagcaagaatccaaaacaatggagtgagtgatggaggaaaaagaaaagaccactcaaaccgctcgattcctcgagccctatacggcgatggagacggccaccttttcgagttccacgcgcccttaatgcacggccgccgccgtgccgccgtgccggagcaccggcggctgtggcggtggagactggagagagacgggaggaaggggacggcgaggacgacgaaagggtctagatatgtaatatgtaatagtataggggtcttagtgaaaataatctctgttaatctacactgttgaaatctaatccaatggcgtacgggtcgctaccattggttccgaaatagggctataaatgaaataatagattagtatgagggtttattcgggaaatacatcttgctcgcaaatcctttcctttttttttttgcgaaacaatccttttctcaatctgaaccgttaaaaaatgatccaacggtttgtttaaagccaagtgtctttatttgcggataatgttaaaaatagagtattaaaaggggtacttatgcaaagtactcatcgctgattctactcgatcacggccgtagactgccgatcgaatggttcccatgaattctagctcctgggccaagaattaacggcggccggcggccggtgcagatcgccgagctagaacgccggagtccaccggcggcggcgccgccaccgccgtgctgaacaaggactggtgcctccgtaccttcctacatggagtgcagtgaagaaagtgctaatgaagacgacggtcgacgaggcaagcagcaagtagcttccgcgccggcgatgatgatctcgatcggaaagggagaagacgtacggagtagatcaaatcggaagaaataaaacataaagcaaattatctatcggagaggatcatttggtccatatatagcattcgatgatcatgatcgaaggatagctagagctatactcctagaagcgaagctagctaaaggcacgagagtatagtacaagatcatgtgaaatattacttgaaaagaatgtgaaaaatattgaacttgattacacatatgtgcaccctctttcaccgtggttaacaccacctgatcaaaattcaaaattcacatagaaaccttatgtatattactactgctagtctctctactagatgcgagaggaagaagaagacgatggagattgcatgcgtcgtgcgctgcgtgcacctcgtcacaagaaccgcacgccacgccacgccaccgcgcgcgcgcgcgctcgctgtacatgtatggcgatgatcgatcgcccgatcagatgagctggaccgagagcgtcgacggcgcgcggtggtggtggtggcgctcgggcgcggctcgcggcgacggcgacgacgacgacgaggaggatccggaggcgcgccgccgctgcttccaggaggcggtgcgcagcatctggcacatgccctcggcgacgcgctcggcggggccgccgcgcttgagcatgcggcagaaggccatgtgcgcgcgcacggcctcctccacgtcgacgggcgcccgcggcgagctcttcccggcctcgtacttcaccgcctccgagcacagcccgcacagccacctccccccgaagtacgccctcacgccgcccacgtactcccccgtgcactcctcctccagcccgcagcactcgcagctcatcaccaccgccaccatctcctcctccatgcttgcaacaactagtatctgaacaagtttatctcccttctttgatcagagatgacaagtgttcttgcctctgaatttctgaattatattactaggtcgtagcggcagcagcagcagcagtaggtgctctctagctttgagctatttcttcttctttccttgtgttgcttagctgattgattttcttggtgtttgttggtcgtgtgcaatgcgttggtttcctttatattgttttgatatggcacctttcgctgtcgcggcgaccggcaatgaaatgtacagattgtttttttatggagaagaaaaaaaaaggagagattttgctttttggcacatggatagtacccatcagatgatcagatgcatgctactgctatctaggccatctactgctcaacatggtcatggactagtagtagtacactgcttggttattgtttttttttttttttgccctgatgacaagggaaaagaacagcggggagaaagagcatttttgacatagtttagagtgcagagtcttcagttgtgcaggtttgtttactgcttcacgatttcatactctgattgattgattctgaatctctctttagttccatgtatatgattgttttaggcacatggctgacaccatgtcaaagatttcgcgctaatttgatttccaagtcaaaacttccgcggagaatttactgaatctctgccctattttacagggaaagagcaagttctatgtacatatctgtactaggctgagcaccattgtactatttctttgctatttttgtcaaagagagcaagtggggtaatggaatctagaaaatccaccaagtcgtgtacatttaattaatagacatccatgtacaattaaattataaaaacaaattaaccaaccaatttctgactataatcctctatcaaaaacaaaaaaaaaatgaatctgatgataatgctcagctgaaaaccgaacagaatactccctctccatggcatggctgtcgtgatgatccatggaccctaccacgtactcgcggcttacaaagtctctactacggttcacgtcaacacggtataatcgtacagtgccataaacatgccatgtctgcatacgtatgctgattgctgaagctgtaaccatcagtcttatcactatacaccatgactagccaccggtgctaatacagtactaatggtggctaaaatgaacgaagcgactcgagcattatccaatcaatcaaccggctaaacgatctccaggcatctgcatcatccggtgacaagttctgacggagtgacagccggcgatgacaattctagcagctgcacgttcgtcagaggaatgtgctgtcagaaacatgttcagagatcaggaaattcagaatgtggcccaagctgatgaatcttatgtcagttcatgtgtagtatggctgtcagggtgctcgcggcactgcagcgacatctgatggcgagacgatgtttttacgggcttatctgatggattcgctgcatgtcagtatgacagtatgtagtagtatgcgacgacgaacgacgacgaagacggggtgagataggacgttcattcttcgaattctcggtccagaaggcacctgaagattgacatggccatgaacgccttgcccatgtctgcctcctgctcctccgtgtctccctgatgtcttctcccttatcatctcgtacagtcctgggaaagattttgcaatgcatggaccaatcacacggacaggacaggaatttgcatccgcacgatctgtctaagattaaaattcgaattaattggcatccgttagtgataatgataagatgatgatgctaactgcaagtgtttctgtaatctaagatgtggtttgaggagagtgatatctgaacataagaacatttccatcgatatctgaagacttttctcctacgcggttgataagatttcagtaaatatatgatagatttcggtaagacgccggatcacacggacaggacagaggctgcatccctggtatgatgtgtccagtattaaaattctgattaatcggaatccattttagagagaagataacgatactccctcggctcctatttactttgtcaactgtcacctctgaccagggttgtttcaacttcaaccattaacaatttttagatttatcatatttggttgaacaaaaaaaaagtctagttaggttatcatagttcgataatatggtgtatttttcaaagaattacaaaacattgttaaaacgaaaatggtcaaagttttcatttccatcgatccctgaagatatatattctttttcacgcggttaatgagattcgagcaaatcgctgttgggttgaagagattttcttttggttggcgacgattcaaggacaacgttgtcgggacagctgcattgtcttgtgtgatcagagcaagagaggatcgatcaatcgtcttccctgcagaaatgtgtggttgcgcggccaattttagttcaggcttcagggctcctgtcgcctgtcggcagggaatgaatctttggtgccgaatggtgcaaaaatctggtgaatggctgattgctggatgatcatagatagctgcaggagatgcaaatcccaaagaacataagagagagtttcgatcactggtggtcctggtgtttttgcagaaaataaaagaatgagaaaaatattgaaattttctgttgctatcttctctagacaatatagtaatatactgtttttttccttttcttgaaaaaagggtgtcacattggttgggttcagctgataagctgtgacaaaaaaaaaacgagcaacgataaatgatttgagagtagaaccattacatttgtagcctttaaaatccaaggctgaaaaggaaaactcaataatagtataaaatgatttaaaattaggcttaaaaatttaagtttcggttgtgaattataaatcaacaagcaaacgatgaaaaaaggaactctctctaaaaaaaaaagaacaactaattacaaatttgccactgggttaaatctatatattgtaggattgccaccagataattaaaaaatgcaattagaactgttgttcgattggcatccttacaaaattaaaaaaaccagtggcaaaattgtaaatacaaaaaaaaaacaacatatggcatctagatacagcagaggttttggatgttgaaacaatttattaattgagttttgagtggatctaagaaaacttctcgagtttaactaaaggcccaagtattcatgggccgggctgcaatctcaaagccgcctccaaatctccaaccgagacactgaccggtgggcccaacgagagagccactcataaaccctaatcctcgcgaactccccctcctccccgcctccctcccatctcgcgttctcgcgctcgattcgaatcccaccgcaaagcaaaagcccacgcgcgaagcaaaagctcgccgcaaatggaggacgccgcggtcgaggaggccgaggtgagcggcggcgcggcggagttcgcgccggctctcgtcgccgcccacccgctcggccgctccgtcgccgtcgccgtcgggcccgagctccgcgtgttcgatctcaagtaaggaacgcctctcttcgctcgtggctcgccttcctgcctattgtcggatctcaatttactcttatagttaagtagtttgattttgatggagattgggacgtgatgcgtttttttacctgagcctaaattggtctgtcgtattgtactgtagtctaagtgcatagcatatagaaggatgaagcttctgttgatatttattcgtgtaaaatttcactgctgataaaattttcagctcagatgcttagttttgtactgcccagtgaaaatgtctaaatggatgtatgccttattttttccttcatttcacttggtgaatattgaaatgtgcgaataaatgtgtatttttggatccagggccagcagtgcagtttcattgtcagacaattctggcggtggttctcattcggatgctataagagctatctcgtttagtgcaaacggtgctctgttcgcatccgctggtgatgacaagcttgttaaggtctggaagactgattcatggtgctgcattcggaccatgtaagtcaccctgtttgttttattgtgaaagcataatggattaaccaaattagtgtaccattttatttatcatgtattcagtgagtcaatctacaactattcttctgctacttatctacgtgtttatgagaatccacacataattgttggctgacacacttagcagcttggagtattgttagttatgttaaaaacttcatttttgtggttggtaatgtattaagtccttcatgcatgagtttgatttcttttgcaatgtctttacttttgcagaacttctgaaaagagggtcagtgcagttgctattagcaatgatggcacatatgtaacttttgcagataaatttggtgttatttggttagttaccatgggggaaagtggtggagagcaggagccaactgataataaacctgtgtcaatttttggtcactactgcagtattattactagcatggtatgacaaattttgatattttatattagccatagttatttgtatgtcctgctgaaaatatcaaagtaacacattatgcttcaaatttccgatccctgcacacttatattatgtattggaatgcagaaattctcaccggatggacgattcattgctacagctgaccgggactttaaaatccgagtatgaaaccattatactttgctgtactttctgcatttgtgtggatcataattctctttttttttcttctttggtgaaatttgttttgtagattacatcactcccgaaaaagcctttaagaggggctcatgagattcaaagtttttgcctaggacatacagagtatgctcagtatcctgtgccttcgtacttttttattttacacagtgtctacattctttctgtatctctaggaatttgcattattatctattaaacccagtgaaattttagagctaaatgttgcaacgtattagttaatgcattttatatttcctgtggataataatgcagctttgtatcgtgcattgccttcacatgcctttcagaaggtccgagctttcttttgtctggaggcggtgattctactgtgggtacaaaatcattttggaatgctaacgtgttcccagcaagcttttccaatgctcctcgtgatgtttttcattcatttatttaggttcgtctatgggactacataaacggctgcctccttgatacatgtcaagtccgagacaaggtaacatctggaaaatgtttatttgagttttctaaaaaaaaaagtcaataggttgtttattccagttataattgtttgtgttattttgtactagctaacttgctcttaaaacaattcacaggtgggagaactcttagagccaaatgaaactgaagacaacaatctatctgttgcagatatatgcccgactaatgatggtttgttggttgctgtagccattcagaggtaaacttgtgtggttacgcttctccaaaagtaatatgatttgcttggtaaaatggggttcttttttatctgtttgatgcagtttaaatggagtaatgcttttagcatgtgaccttattgcaaagaagttatcttttctaaaggtatgtctctttgaaaatgtatcttttcaaggcaactggtttgggattaatagcatgaccacttgaccaggattttgttttacaacaagatttagcgcatcattactatttagtactgttgatagccttatttcttgaaatgatctttacaaagattggtaccaatgcttgtgacttgctaggctttggcttgagagaaatgttcgtgcgagctctaggtttcttgttgccagttgtgatggggctagttaagatttatctggaaaagtattgttaaatcttggttattggtgactagcaagatatcttgttggctcagctgttcaatagtagtacctttttttttctttttttgtatattgctggaaaaactaataattcctcccctgcactaccaggtggttacaacggaaaagtgctatattcctactagcctgtcttccagcttctcagcagatcttctatggaccgtcatgggcgcatcgaatatgcctaatcaggctacttcccagttatgtacccgtttgaaaatcatcccacacttcaaaaaggatccgctagccggatgtgatcatgttcctacagtcttggaagacagtgaggtgccacatggtgagaagctccttctggcgctgcaaggaagtcttgacattgcaaagcaagaagaggtgttagcttcagttctagctgcactgaaagtatcaatgcacaagatgctggtaaagaagcactactcggaggaaaggagagagcagaggaaaaggggcagaaacgataagaagatcaagaagtagatcggcctacagcctcagcaaaaccagttctttgtttctcattgtaccattagaggcttggaaaacaaaaggcattttgacattcacaactgtaagattaaatctactagcaaacacttttctcattatccataggccacagcataacggcttctgaattctgatgcctgttgtttcagtcgaaatgcccgcagttcttgttgtctgctctacctgtagcagctgttatctgtgatttgaaatgttacttaccctatattaaccatgctgctatccaatgataattgcacgctataatatcatttttgcaatgcatcaaattgctgctgatttaactgcacgctgatcactttttttgtcgtgatcgcaactgatggctgagacgtaaagatcaatcactaaagagcatgaggattccggctgtgttgtctctttctctgaatcgtggtgtacagtatatgacatgatctacgatatgacgacggtaaggacaagctttctgtttctttgcgttgcaaaagctttccatgtatactgatttgaacgtgagtatgtgacgtgcccgatggtttttgcagagctggaaacgagcagctactacctcacatgtaaatgtttttctctggcaggaggaatatttgcagcatctgcgatcactggtttgtcgcctgcatctgatctgccagtggaatttcacagaaaaacaatgcaatttgagctggatttggatgaaattcttttcccaggttccaaaaacaggtacaggtgttgcttgctttctcttctttctgcattactgcttgttagttcattgatgaggaagggtaatgatagggagttagaatttattcccaatcctggtgaggatggctaaacaaagtctaggaatttattctgaccaaaaaaaccttatccattgagcagagatgcaaagatgaacacggttgatcaggaggataagagttctctgtaagaaagttaattcccatggtcaacaacatgatgtctgctttgctgccttttttttccctctcctccagatgcaacttctattaaaactgggaactcactgattcatttttcaaaggtttaaacaatattatcattgatctctcatagtctcatggtgctactagtagagaagctggagtacctctcataagtcagtgcccttgttttcttccttctaattggtttttctaaccatgaaactaatggcacaaacaaacctaagtcagcctcattgataacgattcccatgaaggtatgaagatcttgtatgtcttctagttccagcggcacaaaccacttcaagttcttgacctaatcacctatccaatataatttaatactaaatgttttcaatgaggacaagaagaaatactaaatactactaggtgatagcaagtggaatcctttgtcactagagtatctgaactggaagaaatccagggcgtcggatactgatcggacggtcttgcatgctgttcatcaaattactagtttgtgcggtctgcatcctcagttgttccatgaacatactaaaacaagtactcctatctaccaactgaacagtaacaagagcaattaagataataagaagccaaaatcgatatgatcttaacgttttgacagtccagcgactttgcaattaatggccgccactgcaacaatggctagcaagcagccttggcatgcagtgagaagcttttcttggtctctttacctgaaagctctggatgaagcttcattgcatgatgcaacctgaattttattttactgtgactaacagtgctaagctttgcttcttttcatccacattaagctgatgcttctcactgaaggcgaaagggagacaataagcatgcatcagcaaggcgtccatttcacctgacctaagtgaaagtatacctttctgtcactgcaactgtattttgctgctcacagaatgtcagaaaacggcatgctttgggacatggcccagtttattttaactaattaggatttgcccagttgctttcttcatcatcaccttgtccttttttttaaaaaaaaaatcaagcaaattagggcctgtccaatcactagcactgttgctgcatgtgcaaagagtatttgcaaattgcaaaactcaacagtctggagtctagagttgcatcaccaggagggtcaggtttggtgcccctccctttcaccctttgcccgttgtcaataaaagactgcatttgtgttgtcctccaaggaaaaatggagcaagtttagaacccctcatttacaagcgttgtgacttgtatccaaaagagagagaaaaaaagaacttcagggttaaccatttcttagaattatactacctccgtattttaatatatgacgctgttgactttataaccaacgtttgaccactcgtcttattcaaaatttttatgcaaatataaaaatatttatgtcatgtttaaagaatatttgatgataaatcaagtcacaaaaaaataaattataattgtataaattttttgaataagacgaaatgtcaaacatttatcaaaaaatcaacggcgttatacattaaaaatatggtgggagtactgtatacgagaaaaagagaatcatgtgtgagtgtgatgatgatgccattgttaacttattgatttactacttttctcattctttggaccaagtaccaaaggagaaacaagttctttacacctgccttgctctcacccttccatcgtgcaatggcgccatgatgagcccaccatgtcgcccacaagattatgcccggcggcgtctacttgttcagtcaaaaataatgacagaaaactactgtctactgtcactggcctaaggtcagagtaaccaattggttttactgaaattaaactgccgttaatcacagggctcatatggtagtcataagggcaattctagagtaaatgtctacttcttgaccactgtcatgagattgcaacacgtattgaagtagcaatcactttcttgcttctgggtaggaaaattgctgcaccggagaaatggatatagattgggataatacggtgatctcatgcgtgggtgatttgctagtacattactccctccatattttaatgtatgacaccgttgatttttcgaacaatgtttgaccattcgtcttattcaaattttttatgcaaatataaaaatacttatattatacttaaagaatatttgataataaatcaagtcacaataaaataaatgataattacataaattttttgaataagacgaatggtcaaacgttgattaaaaagtcaacggcgtcatacattaaaatacggagggagtaaatattactgctgcttaattaacatcttgtttagacatggagcccacctattactctctatcagcaaacatctactcctatctaagaaaatggtactcctagcactataaaagtaaggagggtactatcaggtagctcctgggattaaaatcgtgtgccaatccctttctgcaccaatcactcacttgtcacttgtcactatactaaattgatacaccccctctcttttaaaagtataaatcaaaccccccaaatctgtacacatagtatcaaattactaatctaatcttgaattatcaaatcgatgtctcaagtctgagctccaataattggcaagccaacttgccaaggggacaccccaacgggcgaggcgagaagggaatgacgattgacgcggttgccatttgccgcaagccgcgatggaactcgtaattttttttagcccaaacaaatctaattaagcctaagtatttattaaaaaaaatctaatttaaccgttacattaacattaaaattttattacttcattcgtttcaatatgtaacaatttagaatagaattagatcaatgctaagactacgaatatgaatatacctttagttctacatattgagacagagaaaatgtgtttggtcaataagcctaggtagccgctcgaggtcgacggatggtggctttggcacatggttttgatccgattatcggcttgtagagaacaatgttaacgtcaatgtaaaatttcttcgtgcagcaacaatatcgactcgtcgtttgcttgtcagaggaccagctgcgatggagtcaacaaggctacacagggaatagctataattagcgaccgatcttttgtagtaacagtttttttcggtgggttatcttgtagtgccacagagttagtgatgatgttgagcccaaatagcaaaaatcttttactagtaaccgataattgttctatagcggttttcggcggctgatcttgtagtgccatttctatcgtttagcatagttatattcttcgtatggtggattactgcggacacattttcctagcttctaaatggtgcaatatctgcaaaatggctttttcatcagcatttccttgaaaaaaactgttttaaatcaaccttttaaactttctaatgcgtaagtcatttgtttgtgctctcaaataattcttctttcatctatcatccatttttcatatagcactttaggacaggctcttcaaggagacgtgacgagagaagtgtgggggaagcattgcagttaagggcagcgagcgaagagaagcaaacaacaaaagagggtaggggcaggcgggcgcatcgcatacgcttcagtagatgacaaacatgccaagaaaaaagggtacagttagagacaggacataattgcgatcttttgtcatcgtgcagtaatctaattgtactcctaccagtactaattctactaaaaaaacgtttagatgacaaaaataatctggttctttctggcagtaatttctcggaaatactgtaaatacgtgttgttctgaaaaaaaacgatggagattcagctcattgtagtatgaatgtatgatctagttactgactgatttttactgaagcagccactgaatcatctcatctgatcagatgagcagcatgagataccttggtgaatgatttaccgtgtgtttgagagtaggaaacagaagattaagatgatatgtaaaacgagataaattgttaacgcacgattaattgagtaatttctcagagacactgtactactgtaaaagtgtgttgctctgaacaacaatgataattcagctcgttgcatgatctacctgacatttacagttctactactgctataccactgatgaatcatctcaaattatcatctgatcagcgattcagcagcatgagatgaatgatttcattgacgtagagcctcgcatctttccataggtcgacagcaaatctacctgctgtaccaacggaatctaccatttgtgtgcgcgtgcatgggctcaaacggggacagtaacacccagcgcaagaatgcagcacagcacacactacagcagcaagagaagcatggccaggacaggaggagaggaccattgccaatgaaaaagatgtgtaaaaacaaaagagaaaaagaaaaaaaactcaggataaggacctgcccctttggatgcaagcacacacaaaccaacactgacatcatgttcattcactgtgaggagaggagatggcttctttaagatcgccaccctcccaacctccccattgtgctactatatgcttattagtatcatcagttcatcaccaacctctctctcgtcttcttctccctcttcttcttcttcttcttcatcttctacctttgatagtttgattgaggtgttgttcctttgagtgcagcaagaagctgatgattttgatgatagcttaaggatcttgccaaactcttgtgttgggagtagttgcttgcagatcgagctgcaaaggtcccattttgcttctccatctgagcttggttaggttgcgtctgagtacacttctgaggcttctttggtcgttttggcctcgagctccgttcttaaactctgcctcgatcgatcgatctcatctcatctgcgctgttcttgttgctgttgctgttcaattttgagaagaaggtgccgatcgagttgagccgatcgggttcagtgaaattcacttgcgtttttgagagaattgtttgagttggtttcggttcttgagatgttcctgagatcgaaggtccaggagatgatcctgaggaggaggtccagatcgatgaacagcggcggcggcggcgtgcagcagagccacctctccggccagcacgcgagctcgacgacggtttcgtgcgacggcggcggcggcggcgccggcggcaagagcgccaccgcggcgtgtgcgttgttggggtctccgaggctgctgcactgtgcctcgctgccttccggcagccacgccaagaacggcggcggcggcggcggcggcggcggttcggagcccgagacgccgtactcgatgagcccgacgtccgtgatcgacgcggcggcggccttcgcgcccagcccggacgccggcggaagcaagcgccggccgtggtgcgactggggcgccggcacgcacggcctcgccgacgcgctcgactgcaccggcgacgacgacgacggccacagacagagcgtcctcgccgccgcgtcgcgggcggtcaagctgcaggcgcaaccgcagcagcagcatcccctgctcaggtcgtgctccctcgatcgccgcgtcgagttcggcgtcaagaacaagagctcgtggctgccgcttcgcgtcgccggcggcgaggcggcggcggcggcggcggagtcaccggcggagatgcagatggagccgtcatcggaggactacacctgcgtcatctcccgcgggccgaacccgaggacggtgcacatctacggcgaccgcgtcgtggagggcggcggcggcgccaccaccgccgtagcgctcgccggcgagagctcgccgcggccgatcaatttgccggcgccggcgcgtgaagcgagaggcttcttgagcttgtgatgcagtgatagatggtagcttgattaatgatgcttaggtaaagtttggtgtgaggacaattaaattaaatctgagtcttaatgctgtcattattattattagtatttttattgtattggttgtttgttcgatcttgatgatcagatggtcaagtagtagtagatgctttcttgatcggatcctcaaattttaaatagatgctttcttggtcagatgatcaatcgattcaaacagatgggtttgttcagtatacttcaatttgagctgaatctgtaatacaaattcagaaattctttgcttccacatcctgctgctaccagagcagagtctttacctgcaaatcacttgctgaactattaacccaatgaatttaatctgatctccaaataacaagcttagctgttccacacacacacaaaacaatcttcatataaaccagtttaattccctctaacaaatcagagagaattcagaccaactctgaatttctgacagagagttttcagagcattttcgctcactgaatccaaagatgaggcaagtggtgttctaggcttctgccatactactcctaagctgcagggttcaatcattgacggtttcttgtagcatcacactcacaaccgatggaggagaagaaagaatccaatgattgatgttttcttgtggtgagcccctgctgctgtgcctacgcatccaaaaatcgatcgatcgaatcgaccagtgtgtgtgtgcgcgtgctgggcccacatgaacgggtgccttgtcagtgtcaggggcccaggggttttggcaaacggttgcagctaagctaaccctctgtggataagccaaaagcagtgtgggtctcatgccttttctgcttcagtgaccagcttggccgggttgggttggccgtctgatcggtctggtccaattttgtctctgtgcctctagtgttttaggctttcagtttcttcgctgaagctttcttcttttctgtgatgctgactgaatttgatgcccagtttatttttgaggtttttgtggtttttgagtgtttttgttttgggtgttatgctgtattgctgtcatatgatgtgatgtttgttgaacaggtactgctccagtgtagagttaaaacctctctctttcaggttcaggatggtgagcagcaaggaagggaataaattcttgaggattttagatcagtagtagtacaattcttttaaaatggttagctaccaattgattgctttgttgggggtggtcataatgtacttttagcttaggagtactggggaaacaaaatcttgtcgatagggtgttgtgtacatctgcagttggatgcatgttggaatctgtaaatctgaagttgttagaagaagcagcagcagcagcaaatttttactagctcgtttgaacttcagatgcaagtgcaaaactgagcacttgaactttgaacaccttcaggaatcaggatgatcagccacaaggaaggaattccgaattcatgaggattttaggtttaagcccatcagttgaaaacttgaattgcacaataatcaccattttatcaacagtttgttttcaaagggtgttgtgtagagtgcaactcagcttatgtcagctgtaatttgcaaatctgaaatttgttaattaaaaaaaaatcagactttaacttgctcgtctgagcttcagatgcaattgcaagactcatacagacactgatcttccttctttgaacaggaagaacaagtcaagtctaatttagagctgataaactaaaatcttacaaaagagaaataaaaaaggaccgcactaaaatactccaagtccataatccaaatacctaattgcggtccagcttccattgcttcaaatatctgcaagggtacatagggttgctagctatacatcccccctcgcttgcaacttgccgaaggttaattgctcacactgttcatcattttatgatgaactaactttagcaacttggaaaggaaaaaaaagcgcatttcattaaaaattagcaccccctattaatctataggatctaatggaagtagagaactgtacatgacaatgtagggtcatactaaggcaactattatccaaatagaaatattcatacgcacctcgagatgtaaagccaatgttattgcccataaggtttggttgaagctgtgatgaatgattatccatttttcatccaaaaaatagccatatggatcagcaattgcacatactaaaacctagagaaaatttgctgctttaaaagcccagcccagctgagcattgaccaaccattaacagatgtcagagaaaagtaagccaatgaggtttactgtcaatttgcggattaagttattcacaatgcttataaactaagctatttacatgtaaactagcatctttgagaggaaagcgaggtagacatcaatacattggaacaaaactctcaaaaacctggattcaatgaccaaaggaaccaaagatctcaagtccagatatagatatgatgcttgtcagcggtagcaagaggtcctaacccacaccatgaacttgaaactaccgacgaagaatggccctgtaggatcgtcggtaccccatcctttttcaatcttgaccatatgtaaacagacccatcattagcaccagcagctatggagttttcatcagggcttatgcaaggcctgccccagctgctaaccactctgttacccatggccttgaattttccacaaacttccattgttctaggatcaaaaaggttgtgcacgttatcctttccacttgtaagaatgaaatttctattccgtgacacactgacagagcttacgtcaagatgagcgaatgtctgactagtgcattttgcacttcggatgtcccataaccgaaggtgtccatccctatgacccgagcaaagggtgacaccatcaatgaaagctagtgagttggcgttgctccctgacattatggtgcttttgcagaagcctgactgaagatcccaaatcttgatggtatgatcattggatgaactagcaagaacacagctcttcacccagcttgcatcaacggatgaaacattttttgtgtgaccagtcagagtgtgacgtgggcgccccccattaacttcccatacaaacaatttgttagagctacaggcagcaatcacaaacttgttgtcattagtcacagcaagatcattgacagaccccaaacagccttgtagagtggaggttaaagcaccggtatgtgcagaccaaatcttgacagtttgatcctggccaccactgattagcttgtctgtgttatgctggaaaattatagatccacagccaccatcatgagcacggatagtgattctgcatgtagatgggattggtgtttccatgatgtccatgtacccagcttcagaacgacgaatgatgccatcagcttcttgtagtgcattgtgttgtataccaccaacaccagctgacttcagctttagaaccatctcctcatacattgcatttgcctgaacaaaaaatttccccccatttaaactgataaatgcttggtacctactagtactgtgggaccagttatcaatgtaaagcatagtaaaatagatcttcggctactaaaacaatcatcgatatttagttagttcttctactcccacttatgctatagaagcaaaagagtttgaacatgatgtacatatagaattgattcgactgtcgtgactaactgttcggttaaatatcaagggggaagtatttgaaaactgtctaaaaagagccatttccgcagacagcgcacagtagtcaagcaaaattaaagagcaaaaatattctaacatagtaatttgccatccaaatatgatgggaagatggtaaattatagtgcacaaaatctcctgtgttatgtcatggaaagcatgatggtactttaagtatctcaattgtacatccactacaacaatggtagggatccatgcataacatgcaaatttttttcttggccattttagcctaccaggcccttaaaagggaaaatataatcttgatttgcaacaccataaaatagaaagctgcggttttagtaacaagaaaataaggtacctcattaagcctctctgcatccttcatcttctcaagcatccatcgatcaatcagattcctgttttcatcttctgccactttctgttttgttaatgcctgttcaagttcagctttaactgcctggtgctcctgaattataagatctaaagcgcttgttttttcttcaagcgactgcttgagctgcgtattttcttccctacaaaagtgtttgcacaaaatgtcagctgcgtattttcttccctacgaccacaaccaaacattgtattcaatccaatacctggtttgctcgagttcagtctgcatggtagtaatcagtgtttctttctctttaagcagcgcttttgatgctttcccctcttctatctcggtaacgagctgctcggacaaacgtgactgagccttgtagcattgctgcagctccaattcatgcttctcagccttctctttccactccaccgcctacaaggaaacgaaataaataaataaacaagcccaccaaaaaaaaaaaatctatgcacacaataatatctaaatttttgggtttcttgatctccagatgaagcatctatggtacttagcaaaagcatcattatcgaggcacggttttttatacaaaattttccattccattatgcaaagcaagaaaaaaatatatgcaaagatgggaaaaaaaaggagacatgagattggtatttttacttgggcggcgaagggccgggcgagcgcctcgatggccgggcggtgggcgccctcctcgacgagatgcctccgccgcagagaccgcagggctcgccggatcgcctccttgccggcctcggcctccaccatcgtcctgcacccaaattcactccccacttaagcagaacaagaacagaaaagaaatccatggaacggctcctgcttccaagaaaacctcacattgccgggtgcaatccgtcggcgaggaggtccggtggcttccggcggaggaagaggaggtcgcgtgcggcgggcgtgcccggcggcgaggtcgtcggattcggttgggggagcagcggcggcgagaggatcagaggaagacgaaaccggggaggaaagcaaaagcaaagcaagcgaagacggcttccgggccgcgagttggactcggacccgaccggatatggtcccggattgggcctcaacggcatgtgatcttgtggcccattaatggctcgcgtcggcctaattttgtggcccacgtaacataggcccagtaagaatcggatggaatattccggccttggtgtccacgcgagactttgcccttttattttctttcttttttttttcctttttcaatcacctccgcttcctccgccgcctcggcgcgaaggccatcgccggattccccgcttcctccgcctggattgctccgcacgcaatcggccctggtttcttcccggcggcgtggtcgtcgctgttccccacccgccgccggcgccgccgcagccggcgtctgagttgagggaggagggaggaacggcggcgcaatggcggtggctgcggcgctgctgcgccggagggcgctctattcggccctcgcgtcgccctcttggctccatggtttgtgctcgctttctctgatgtggcatgttggagtgtttcctttttcatgtttgttggaggtgtgccttgtgcggcatgtgtatggcgaaatgccaaaatgagcgtgcctcgaggcacgctcattttcgatcatggcaatggtagtatctgcgttgctaggtttctatagatatgctatgagtggtgtagtaggtctatgttgcataattgattagaaaaagaacagtcaaggattatataggtcagatgcaactctttttgggggaaaaggaaacgttttttcccctgtatttacaatttacttgttattctgatgaacggattatatctgttgagagatacttatattttgggaaacataaccttaatatattagtactgttgaacaccgcgaggaaaagttctgctttggatggacatttcgtctttgatagcgtaactaatttcagtggcaaagtccaatgttctgtaggacacatttgctcataacttgtggtttacatggtatatgcttctcatatagataccagttcctgctacatttgctccatttctggtacacattctttggtcaaccatcccaatttgagattacagaggggctaccacaactctgggaagtttgatttgaccgacttgacgtaagaatccatctttctagccttcttttacgtatatcgaagtcgattttcctacagattcctttgagtttatgaattttgtatcgtacattcaatagactccatgttttgacttccaatctagtgtgggatgcacaatattttagtttccttaaatttaccttcacacttgccatagtgaaatataattttcacatttattttacacaccacgatctagtgtagaacagttcatattctcctaaagaatctaaatattttacacaccacgatctagtgtagaacagttcatattctcctaaagaatctaaataaatgctgtgcttcttttgaataatagccatcctcatatatggtatccgaatgcccgagaaaagaagcgcaatgtatttttacatgtcggtcctacaaatagtgggaagacacataatgctctcaagagactagaagcaagttcttcaggtactactttgttctacttagtgataataaattaatatacaattatgatgatttctcagagctattgatgaattctgtaggagtatactgtggacctcttagattgttggcacgggaggtagctcaaagactaaacaaagctaatgtcccttgtaacttaattactggacaagaaagggaggaaattgaaggtgcaaagcatagctcagtgacagttgagatggccgacatgacaactgagtatcaatgtgccgttattgatgaaattcaggtacttcaaccttctttctgtagatatgctaattaaatgtatattcataatacaaacagtaattaagagaattgtcatcccatttttttggactacatcatcaagccagtcatattttttactgtaatattcctcatcattctcatgttatcttcttctgtttagtagatggttggctgtagatcgaggggtttttcattcactcgtgcacttctggggctttgttcagatgagcttcatgtttgtggtgacccagctgtggttcctctcattcagcgaattctcgaacctactggtgatgtggttacggtaatttcgttgaaactcacatagttaaattgaagtgtattaatatgactctgccagaatgatgttagttgcaaagttagatttgttgacattggtgaagacattaggttttgtggataacttagatgatgtaattacctagtttgggatgaaacagtaatactaaatcgcatgttcttgcaagtgtaagtttttttttactgttttcaaagctccatgcttaatatgtttcaactcattccattttaacttaagatacacaatgattttatggattatcattggtggatagcatcagcaatcctgtaacctctgttactcaacttatccttagccacaccaatttgaggtcccgtccaacaatttagattgcacccctggatagtaacactacttctggacctccatctgagaaagtaatgtgcaggcatgatgtcatatatatctgtcttttgttggtgattagctgatgttttgtatttgcagataatattccaagtgaactcgagaaactgtttcttctcaatagaatttgttgagctgtctaatgtttattttggtgttagtactgatacacgcatcatgtcgtcaaatattccgatttgctggctgtatgtctctatgcaggtccaatattatgagaggctatctccattggttcctctgaagactactctcgggtctttctctaacattaaggcaggggattgcgttgtaacgttctcacgacgatctatctatatgcttaaggttggcattcttcagataactgttgcagaatatactgaaataatatctatctgacctgtgtcctgcaattaaaagagtaaccaatagatatcccctgcaaattgttgccagaaaatgtaaataataagctgagaaagtctcattatttttttttggtgaaagagaaatgatccaaatgccatgtttgttaaacctatcatcgtaacttgatctttacctgtaaattttgaaacaacaaactctcaccagcataacaacacacccctctggcctctgcataccctcacgtgtatctggtactccactaactttatcatttcacttttttattctctccttcaaaggggggggggatcactctattgacttaagaaatgggacatatttctcgctatacacttaaactctttgaattttgattcacaacactacagtactatactagtatggttggcagtgaagggtactagatagcccccattacagaaatgatgaaaagacaagggaaaactatgtacgaacctgtaaagctacttaagtaatgcaactatgtacggaagatgtaggcatgtaacagggactagggagagctgtgttgtagtagtcaatatgataattacatcatgttgtgagagcagcgatagctttgtagcatgttttgacaggttggctagtccatcgataatttactttctgttttacataaatgcaagttgaaatctattaagtcatctaatcatgtttctttttgcttttcttctcatggtatttattgaatttaacactccaatcgaaagactggatataaagattgcaaatccatgatatgaaaaatatgaatcaattaagttagcttagccaggggcagatcaaatacacaaggatcagagtgcagtgaccatcatgtctgctgcacaaacccaaaaagattatgctcactgtgacattacaaatcattgttgatttatacccatggtgggaccctgataacttgctgccctagatctgcacttgaattaagcgactgcaaactaagatacataatgtaatgtatcaaagcatcctcatgttgtgattattacgaaaattaatcatctagcatatgaagtaatatatgaaagctcaactacatttcttatatttaaaatgtccgtgcagagaagaattgaaatggggggtaagcatctttgttctgtagtctatggctcattgccaccagaaactcgaacaaaacaggtacttccctcacttggttatctgctactacaccattgtagttgatgccttgttctcacgtctctaggtccttatctaattaaaatttacagctaaagcaccaaacgtttcatttttaatatattaacatgtatatgccatgttttgcttggcttatgctcaatatatttatattttaaaattccatcttgctgattttcttccattaataaagtttatttggtctctcatatctgagtcacatgattgtctggataatgttttgtacaatgattaaagtcagtaaaattagcggtgcagaaggattagaattttctgtttaatgtttgtgagatgaactttcagctagcaatttgttgattaataccccgtaacagtaaagcacaaccaaccacaaattttagcttgaatttcaagaaatcggtagttatggttgtaggaggcaaaacttctcttggcatgttgtgctttattcttgatgatgctgtgatgatttgaaaaagttgataaatctattccctgagcttgcaggcgacaatgttcaatgatcaagatagtaaccttaatgtgttagtggctagtgatgctattggaatgggtcttaatctgaacatttctagaatcattttctctacactggagaagtttgatggcatctgcaacagggaactaactgtggccgaaatcaaacagattgctggtattggatttgtttcttaatagttttgcctctggcagattaagttttccctccccccttgttgcacaggtacttgagcagtgaatttgagatattcttcatattgcaatactttgtcttcattttataggaagggctgggagatatggatctaaattcccagttggtgaagtgacctgtctaaattctgatcatcttccattactacactctgctctgaaatcaccttctcccattatagaggtgctcaccctgtccgatgtctatctctaataggatgagagctgcacgaatcttggtatagataacatgctaatactgcactgtactctctgcagcgcgctggacttttccccacattcgatgtattatctctgtactcacgattgcatggaactgatttttttcaacctatattggtaagctagctaaagcccatccttcttagtactgtatatggcaaattcctaacacaacagagaataacattatatatttatgatttagtgaattgccattgtactacataaacaatacaagggtgttgctcttttggcttttctaatttggatgatacagcaagctattcatgcttttataacactttaactgcaaagtattacttagttcttcaggtggttgatgaagtcatttataacttggcaactttttcagtggcatggattggattgcttctaaaataaaatttagtcatagtattaagatatcctatttgtatttgtttggacttcagcttgactttgcttctcaatagttataaagtggaatttgctcttttttctacttttctctgcctacctctttctcaattacttgtaaatgctgttttcaaccattaaatgtatgccaatgcttcctctggtcaggacatgcatcttacttatcttttcactcttatcacaggagcgtttcttggacaaggctaaactatctccagactatttcattgctgattgtgaagatatgctggtaagattctttccctcaatgagcaccaatttctatatttggtcaaattatctagaagtaagtcagttttccatctctcaactctgtccagagttcaaatttcacgctcaactccaaaaccatctgctttgcactgtcctatcaaaactgatgcaagtcatacttaatgcaagcccctcatccctccctccttccccctatttctcagtgctgtggccaggccaagcttggtagcaccttggtacagcctagatccaatgctgaactagttcaagaggaagctatgaggaataaaaaacctagccagttagcctgcatgcaatacaggaataaggttaatgagtctcatggcaatatagcaactgaaatcgagagatgaaaccaacattttaaacaaaaaacaaaagcaatgatgttatcagattgatttggacatcagtaaaggaggatatttgcttaagattaatttccggttgagctttgactgttgtaactgttggaatctctgattttcctcctacatactccctctatcccataatataaggcgtgcacatatttcaagattcaactttataaacatttgaccaacaattattataatataaattaaatttttatttgctaaaattaatatcattagattgacatttaaatgtactttaagatggttataattttgttgcaataaaccttataatatatgagatattataagttaaagattagttttgaagactatgccaagtttgaccatgccttatattatgggatggagggagtagtatagtaggaagaggcaagaaaaactttctggccatgctgtttcgatgagcttatcaggctaatgtgaagcacacaaccatggatgcatcagccgttgtgatctctttgacatgttcatctttcctcatctcaaatggtatgggaaacagatctggtggtgttttccaatggtgtgtttggtggcttcagcccagcttgatgagaggatctttttgccatgtcatgaaacagttgtgttgtttgccctgcactgttagtgcatgtccaaatagttgccacaccatgatacttttgtagcccagcagtattattctgctaactgactcatgttggtgttgctaaaaggttcaaattaggaaataagatacatacagtttcatatcaaaattatttataaggttaaagaaatcctttgacctagaggagctatggagaaaggaacgagggagtgagaataagagagaggaggagaaagacaagtcttgtcctgcttggcactgctttttctaaaaagccaaaattatgaaatgtgatttttgagaataatttaggtaggtttttttcagttgtcttcttagctatcatgaaaataaggctgggcaatggaagtggtgaagaaaaatcccctaacaataattctaaaatcaaatcctaaacttacaatgagacagctttgctaagaggaataagttggcagcggcagcatgcctcttcatgactcagcattcacatcggcatagtacacatgaatataccacttgagcagttcacccgtttaaggcatgggcattgtttctatgcatagttttttagctagaggtataatttactcagtattaggtttgttttaatgctctataaggacttctatggaatgtcaaaatctgatctcctgggtagaacagcattgacagcctactatcaaaacacaacattttagcaaaatgttaaatttataatgatagtgaactttatcaagcatattttttcctattgagttggaggttcaaacattttgcttaaagtaacctttattcctcatatttttaacagaaagttgctgctattgttgatgagctaccacttggactatatgataaatacctcttctgtctcaggtgatctgtactactatgaacctataatcctatatcgatccatcaatctgtcctttttgaatgctatgctttttggatatctttctccacaactgttgtccaaaatataagctcagttatacacatttgacactttataatttgtatcgcagtcctgtggacattcgtgatgatatatctactaaaggattaattcaggcaaacatttttgtactactatcattcagttatgtgttttgtggaatcaggaaacaatttcactgattttttttgagatgcagtttgcagaaaattatgcaaagaaaggtattgttcgactcaaagagatatttacacctgggacactccaagtgcctaaatcgcacaatcaactgaaggagcttgaatcgattcacaaggttatttacattttctctctccagtataaagcagtactagtacattatcttgtgaaggatttctgctatgcatattatttcattctgtaaaggttgctatccatctgtcccacagtcactttctatttctgtgtaccattgtccccaaacatttgtacaacagcattgatcatgccagtcttccatttgttacaccactgtccctaaacagtctgtagatttatctctgcaaacagtttgtacggttagatcgatcactatgtcaaacggttataaatgcaggtgctagagttgtatgtgtggttgagcttcagattggaggattcctatccagaccgtgaattggcagcttcccaaaagtcaatctgtagcatgtgagttgcatgcagggcttacttttttttttttaatttgttttactgataaattctttggaggtcttattgctggcaatatcaggttgattgaagaatatctggaaaggtccggctggcagcaaaatggacgaaaggactttttgcagaagccaaaaagactacaccaagaatatgatgcatcacaattgtatgaactttttcttttattccaaaatgcacggtattattttcatttaataaagggaatgactatgctagaaacatttaaacttaagtctcaatctaactccactcatgatatatacctgatgtgtctgaactgaatatgcatgtactatagttgctctgctaatttttttccctgcacttttagcattttgcatcagaaaatatacctatgcctatgcaattgattctctattaaatggttatgatgacttgcgttgaatggtactcccacacttgtgggagggcagagaaataagctagattccttataaacttttaaagaagttacaggttgtatatagcattgcaaaggaacatatgaagttctaattatcgaattgcaatatattttcatgccaacctgctggcagagatcattttgctaatttcgtttttcttctcttcatttctttttgatgaaaaattgctagtgggattgctacatttagttttcagtgcctttgtttacttaactctcttaatgaacaggcgcaaatattttcaagaaattgatgtgagatcaaaataagatgcttatgctagaaagtcgcctcacaatatctgcttccggacaacggatttgctcctgtttgcatacgttatggtcgaggagaggcgacaagccgacaatacattttatggatgacaggagtcaaaagaatatcctttgccgacaatacattttatggatgacaggagtcaaaagaatcatcctttgccaaaaccatttaattggcctaagcagtaaatgtggcagcacctgtcctccatccaaacaattttgtagctattctttcattacactttattttaattatttctaacacagatggagctgtacatcacgatgaaacgtctaaatgttcgttaaagttattaacatagacaggacgaagccacctgtaaactttgcggttgtaactctttgtgttatgaaaggtgtaaatatgtcaaaatgacagttgtcaagtgatgtttcttgggcagctaaacacctgatttgtgcatgccaaatcgctttcctgtgatgtgccagcaacatgcctatatgtgccagagcgcaagcaaaacttcatcatgaatcaaccagttgccttctatctcattgtatcagacgtaaaagatgatatcagttgttggtgatgaatgcccttaatgcttcattgaaactgctattatcaatgtactcagtagtttctactcccttataagttgctttgactttttttggtagtcaaacttttaagtttgatcaagtttatgaaaaatttagcaacatttaaaacactaaattagtttcattgaatctaacattgagtatattttggtaatatgtttgttttgtgttgaaaatactactatatttgtaaaaatttagtcaagtttaaagaagtttgactagaaaaaaaaagtcaaaacgttttataatatgatacggagggagtatgcaacatagcagtaactgtaacaattgaaaagtaggatagttactgaatcacagtcgcatttgcataaacattccaatgagcagtacatattaagtttgcataaacattccaatgagcagtatattaagattcatgaccacaggtgttgtacaacacagcacaatgttgtccaccatcagtgacctctcattgaaaggactccatatgcttcagatttgttacctgcgtcctgagaacttgaatctttttgtacactgactgcagattcctcttctcaagcttctccatcacaagatcaaatgtctcctgctttggagcaaaaccctttgacaccatttcctccaagaacaggcaagactgggcaaccttcccatttctgcacagccagcttaccaacaaggtgtaagtgctgaaatcagggctaatgtcctttctaaacatatggcacactaggaacagaagtatctttacccactgtcttttacagcacagcttcagcaatggcgtgtatgtctttatgtctggattgcatgactgctcctccatcttaaccagaagcttcagggcattctctgcctgagagtggtcacaagcagcagaaatcaaggtgttgaaggtagtgacgttaggggcgattccagttgtgcgcatttcttcaaccacagagtatgcatcttccaacctcccagctctgccaagtatgtagatcagggagttgtagaaggaagcatctggagcaacaccatcttccttcaacttgtcaaaggtatccaaagcttctcgcgttctcccagccttccccagtgcatgcatcaaaatggtatatgtaacaacatttgggggacaccgcctcttgcgcatctcgtccaagagagcgtaaacagtctgaaaatctttctccatgcagtatgcttctaccaggctggtataagtcaccactgaaggactgaatccatgctgcttcatctcctccattgtgtctagagcttccttcagcatccttgccttacaccaaccatgcacgagagtattgaagctgttctcgtctggaggtattgttcccctcagctcttggaagacgcctcttgcgcgcttcacgctcctctccttgcacagtgtgtccaggagcacattcatggcctttgtatccttcacaactccaaaccgatccatcttatggaaggcgtcgatggcctcggtccatcgacttgccccagcaagccttctcatcacctttgtcatcgtcatgagcgacatcaagcctccaacctcaaccatctgattgatcaaaccccacatcagatcaaactgcttgaacttccccagtatatctaccatcaagtcatatgaatcggcacaatggcagtaccctccctgagtgccaacccacatgaagaacccgaatgccgccacccaatcattgctgaacctcgtcaggatcttgtcaacaaggcagccagtgacccttacagagcagcagtccatggctatcataatggcctcaggagacgcgaaacgagcactaaggatcctgctgacctcatcgatgtcggcctcgaactcagcatcctcatgggaggcagttgcaggaaagccagggcggatcgacagcgacctggaggtgctgctctggcttcttcgctcatccgagacgttgggttcagtcgggagcacaaaaatgtcgtcctcctcgtcatccaagccggcgcatgagccatcgtccttggggttcctgaaccagtcggggaggtcgaacccggtggtagagaagcgtgtcgcggagagcctgccgccgctatgagacacgaacttgagagacggagggaaaaaaattcggccgcaccggcgcataacctctctctggcttggaggagaccaggtgggcaaatcgtcgaacacctctcgtgcgcggccaaacaacacctctctgaatcctctctctctctctctctctctctgccgccccggcggccggcgcgacctcaagtgcgggcaaagactacagctcgggaggtgatgagatcgagcttactcgatgcgtgtgaatggcagcggcgcgcgcagaaggtggaggtggagattggggagaaacgaagcgggagaggaggggggcgcgaaccgcgaataggcggcgtcttcgcccaaacgcgcccatgtccggatcgtgcggccccgtgggaagcgcataagacgacggcgaaggggcgcgcggtcgccggccgagtagatggatgcacggggacgcgatatgtcgccggacctcaccggcgccgatccgggaaggcgaaggtgggacctcgccggcgcgaagaggcgagggaggaaggagaacttggaggcggcggcgacacggcggtgggatctccgacctcgcctcgccggagctcagctcaccggaggcggacggagcgggagaaagagggaaccaggagaggagacgggatagcgcgagccgcgaggtaatgggctgggctggtatgggctgggtcttaaagccgcaaaaccacatggcccaggtaaaataggcccgaacataaccaaatatgggccaacacgtaagctgcaacgccggtcggacccaactagaatgagcagcccatcaatatctgcaagcccaacatagctcgttttaaagtagaaaatttgagataaaggtggagtattccccttcccttcgcgtaaaaaaaaaaaatctcccgtctcgtctcctccgctccttgcgccatctcgcggccgaacaggggtggggcgccgatctccatctggcgataagctcagtggaggggaggggatcctgatgagcatctacatactctttttttttttttgaaacgtaaagagggactttattaatgaccgaaatgtgggttacattcttggttcaatagctcaagaatttctgctggggcacagagtctccattccagacagtttcctgagctaagagccatctgagctagagtatgggctactttgtttgagtccctctttatatgggccacttccactgcttgcaatccttgcatcgctgctttcgcctccataattactccttcccacactgatcttgatgaatgcttcgttttcagtcttgctaccacctctgcattgtctgtttccaagataacaggcatatgtatccattgcaacgcacaccggataccttcaaggcttgccaatgcctctgcctgttctgcagagctacacggatgcagtgttttgcatgccgctagcaggatgagacctctgcaatctcgtattactattcctgcactcgcttccccagtttccatcctgaacccggcatcaacattaattttcgccgctccatcaggtggcgctatccatccgctgctctgcttttctgccatgtgcttctccttctgaccttcactgtacattggcttctttccttttatgtcatcaggcatttgtcggtttgggagcagtacctcctcataactagtgagaaaactcactgagcctgctatcgagcatctcccatcaccatggatcaggtcatttcgcagataccaagctcgccatagcatgtacataatgtgagttctttgctcttcgtttacaccatctaacagaatcaacaaccaatccggtcctgtccataaaaatttgtcttccccaggcaagtgccaaactgctcgcagggcttctcttaacgctctagctttagtgcattcaacagttgcatggtaactattttctcccttcgttccacagactgggcaggtcccattcatttcaattttccttcttcttttattctcccaagttggcaatttgtcttgggccagcttccagataaagatttttactttggcctgcacctttgcattccatactctgctccaaatcttcctttcacctgatgtagcagtgctagaagaggattgaactacacctttccctgataggttccaagccaacttgtaagcactcttcacagtaaatagacctgacttctcatggtgccatgccgggaagtcatccatttgatggtttggaagtctgattttcagaacctcattcgcatcctcctctttgagaacatgtcggactagtgtctcgttccaacatctgttctcttcattaatgagctcattgacatagataagtctatttcttcccttcttttccaggacattgatatgctccccatgtggaacccatttgtgtcgccatatctttatgttatggccattgccgaccctccatatggtaccttgtttgagcaggtccagaccatgttggattcctttccaaactgacgatgacactgttgggaaggcagtgtccacaagatttccattggggtaatatttcgccttgaacactctcgcacacaagctgtccggggaggtgagcagcctccaagcttgtctagctagcagtgcttgattgaagcacttcatatccctaaaaccaagaccccatgagatttgggatataagatcttttcccatgctatccagtggaccttcctttccccattatcatgtccccaccagaagttgcgaaccatcctggtataatcatcgcagaatttatctgtcatcttgaagacccccataatataagtaggcaacgcttgtgccacacttttgatcagtacttcttttgcccctgacgacatatatttttcattccaatccgacatccttttagataacttatcatttatcggttggaactgttctgctttcatccttccatctggtgttggcaaccccagatatttctcctcaaaggttgaactatgcacctgcaaggcactctttatctcatcttgacgttcttgtggacagaattcactaaacagcagagagcacttgctaggattgataagttgcccagtgctattttcataagattgagagctttttttattcttctagcttgctcgacctccgctttgaagaatagaagactgtcatccgcgaacaacagatgcgaaattcctggtgttgcccggcaaatcctgataggctggatgaggccatctgttttgtatctttccaagatatttgatagaccatctgcaatcaagaggaataggtatggactcaatggatccccttgccggagtcccctcgttggagcaaaaggatcaagcaattctccattaaaacgcacactgtaacgaactgaggttacacataccatgatccatctcctccatttgtcacaaaagcccagtctctccatcacaccattcaggaattcccaatcaactcggtcatatgcctttgaaaggtctaactttagggcacaaaagttttggttctcccgtttacaattcttaatagaatgaaagcattcaaaagctattagagcattatcagtaatgagtcgccctggaataaaagcactctgagcttccgatattatctcttgtaacataggtctcattctgttaactaggcatttggccaccaccttataaaccacattgcataagctgatcggtctgaaatccttcatatcctccgccaagttcttctttggaatcataactatcactgtatcatttacaccttcttgcattacttcatcctcgaaaaaattcctcacagctgctatcacttcgccctttagcagaccccagtttctttggaggaatctggccggaaatccatccggtcctggggcttttagcggacctatttggaacaaagcatcacttatttcttcatttgtaaagggcttaatcagatccgcgttcatttgctcacttatcttctcatggaacatattgagcaagtttaccgggttcaagttatcatccttggtgtatagctgctgaaaaaaacttcgatttatttcccttcatcttcttcttgtttaatggtggcgatccatcattctttttcagctttttgatcttgtttttcttagctctccaggaagcttttaggtgaaagtaccgtgtatttagatcaccttctttcagccacgtgatccgtgagcgctgtttccaccatatttcctccctgtgtaacatctcttctaactccttcttcacactatggacctcgttatcagtgtccagcagtcctatgtttctcaattctcctagcttctcccgtaaatccttgattttcttccgtacattccctatcttgtctttgctccagctgacaagcttggtcatagtgaccttcatcttatcattaatatcacccaaggtagatgcatcagcacccatcgtccacgcttcctggattacctcaggtagtgatgactctctctcccatacttcttcatatctcataatcttcattggtcttgccaatgttgtttcctctctttcgagaagcaaaggtgcatgatctgaacttggagtagttaaatgtgtaatgacagcctgcggaaagcgcgagctccaggcaggagaagctactcctcgatcaagcctcactttaacattgcggccctccctttgcatattacaaaatgtccatggggcaccctggaaacctatatcatgaagatcgcattccgataagacctctctaaagtctctcatctgtgattcagatcttttcctgtgagatttatgctcagtctgccacattgcttcattaaaatcacctatcatcaaccacgggtctcctgaatttgatctgattctccttaacaagctccacattagatgccggtcctgggctcttggctccccatagacaaatgttgctcgccatgtgcagcaatccagctccgtgatcagaacatctatgtgtcgagaattgtaagatttgagaaccacattcatactttcattccagaataatgcgagcccacctcctttccctactccatttactgtgaaacatcttcgcaacccaatacggttttgcaccatatattggtcttgtctagtttccgcaaggaaaactattttcggacgatgtatctgtaccaaacagactaggtcatgaactgtccgaggtcgtctaagtccccggcagttccaacttaggatacacattaggcccggcggtgctcctccgaggagcccgccgatgttgccaagtcgctattattttccccttcattcttgtcccctcctttctattcatctctctctcccaccgggaatacttgcgttaaccctagcttctcttctatagttggaataaactattctcttattttcagagctttaaccttaatacaagtactccctccgtttaaaaaaaatccaattctaagtataaattaagtatttatacacagatgtttccaggtacatacccaaaattgagtatttttccccatgtcccaagttgatcctaccctgatttgaaacacacaatgttagaaaaaatatatatatatatatatatatgaatagaatgtcacgtcttattgaatctatcatacatgcagttaatcccgatgaattggttaaaaatattagtttggtagcattattaaaaaaacatagatgaattggtaaaaatattagtttggtagcatcatagaaaaaaaaacataggaattccgagaaaaaaaataaaagatgaggtctatcaactttctaaaattcctttaaatttttttatgaaatgaactatcccataagaaactcaaaaggattttgggaaagctattcctttgtttaaaaaaacatgtagaactgttttccagaagatttctttaatcccccaaatttccccatttctcctctgttttaaaggaaactcaatttttgcctttttcttgtatcttatgaacaatgcatatgcttcttatcatattagttcaagttcatggccagattattgccttttttttttaccatgaaacggttaatagttattttagctttacttagttcttccctttttaccgtgcaacgggcagatggagctaagttgattctaaataacatggtgggccgcgtagattacgcggctagcatattttattattaaaacatattaaaataacaacatagttttaaattttgtactaattttatcaaattaccaatgtataatattcgtattaaattttaattatttctaaattgtattcctatatggattctaaactcatttttcaatattttttattttttaattctgaatttttattgtttataaattatattcctatatttctaatttttaaattaaaaattttagttatttctaaattatactcctatatgtacattagactcctatttcaatattccattttttattctaaattttcgttattagtaaattgtatttccatatggactctaggctattcttccaatattcctttttttattctaattttttattattttaaattgtatttctatgtggattctaaactcatattttaatattctttattttatttaatttcgaatttcagttacttctaagttgtatttctatatagactatatactcttctttcaattttttttaaatttagaattttagttatttataaattgtatttctatatggactctatactctacttttaattttactagaaaaatgcccatgtgttgtaacgggtgaaggctattttaatcttattattgttgtacggtataggagccgcaattagggaccaatcgtctcaagttagcatgcaagttgtttaaatagatttcttatatgactcatgtattttcaaaaacgaacaaaattaaaatcgattcaaacacacatatgtatttccatttgtatgtccaaaagcgattaaacttaaaaactgattcaaacacggatgccgtaccaaaagtaccggcaaaaacatcttcaatttttataatagtagagattaattttattccaaattttatttaattctaaatttttatatggactctatactcttcttctaatatttattatttcttttattccgaatttatattatttcttaattgtattcttatatggtctcttatactcttcttctaatattatttattttttaattccaaatttcggttatttttatatggactctatactcttctttttaatttcgaattttagttatttataaattacatttctatatggactctaccctctacttttattttttcatatttttaatttctaatttaattttcattagttctaaattgtatactggtatggactctagtctcccctccaatatttcatattttttaattccaaattccagcttgtatttctatacggactctaatactctatactcttcttttaatattcttttttaacttcgaattttatttatttttaaattgtatttctatatggactctaacctctacttttaattttcttatttttaatttcgaattttattagttctaaattgtatgctggtgcggaccctggtgtcctcttctaatattctatattttttaattctaaatttctgctaattttatattatatttatatatagattatgtttttacattactttaataagttaatagatttttgtttgatttgaatcaggtcggtctagcaagctacaaggtgatgcctcgagttggggatcggacagcgctatcggcagttagagtcggtgccgagctgatatatctttgttgcatcaccgcgggaaaatatcttcacctcgtgagaccacgggggattcgtagagtggcgcgtctagtactgttattcgtaggatcactttgtcacgacattagcttttatcatttagtacttgatacaattaattggcctaatgcacggcctgaccggagggattacgataggttacctctgctttatttgatttttgactaaattaaacaactagtgaagaagaatcttaaagcttatatcttgttatctgattacaactagtgaaaagtaatgcatccatccaacgtcactgaggaaaaaaaaaggtaatggtctgtccaatgttgttccgtcgatcgatggcatgtgttattaccaagggactttttacttaaaaggtttcgttgcgcacagataaaaaaaaaatactaccttcggttttaaattgccgctgattttttaagatacgtttgatcatttgtcttataaaaaatatgtaattattatttattttattgtgattatatttgtacaaaaatttagaacaattcaaatggtaaaaattaataacattaaaaagaaggggaggtagtactttttatgtttacgcttcatatgattcacttgatcgatcagagcgcttgaaaatcctggagcaaaaaacaaacacagcctgaaaagaaactcattacgaaatcgttggattactgtcttatttgcacttcacttgttgaaaatcccaaatcattgagcattaaacaattcattttggtcagatggcatgcttaaaatagttagcaagcgtataataatgcacatgttgacatggcgtcacgtgcacgtcaactaaaagtgatcttggctgttataatgcacgtgttgacatggtgagcagtgagaattttttaaaattttttagacttttttattttttaattttattaatagaccaaactaaaaggtatttttcaaatttgaacattttggtcacgacagctcacctgacatggctaaataactatgtcatgtcaggtgtaactggtgtagtagtgttgtttggccacgccagcctcgacgggacagttggttaagtgattcaactagggacaataaggtatattcaaatcaacagaagggctcaggatgtagagagtggcatggttccaaaattagctgatttataatggcatgtttgcaattcaacaaatagtagtagcatttatcaaaagtggtaaagttttttttttttgggaaaagtggtaaagttataatagcatggatccaattaaccctatctgatattggggatatcatacagattcgatgtaaagttgagggatggtatctgaacttattttttttccgagctaccaaggcgattagggcgcggacagtcggacagatgagacatggcctgggagcctgggaggatcccaagcaagtaaacggaccgcgtagaagagcttggggctgggaggaaaagaaggccgcgcagggcagggcaaggaaagagcaggtacagcgggctaagggtagtcccaaccctccacttaggatggtgtctatggtattaactacattgccacgtaggacttttagcttatgtggcactatattaattaagagagagagtgaagagaggaagaaactgggtctcatacaagacagcttcaacacgagaacctatgcactagacactatcaagttttacattgggagagatagtgttttcataatagatgaagattaaatacgattggtagaagagagatgatatatttattaatggtacactttaagaaaccatgggttgtagagtgtagtttctattgtgatgtcttattgatatggcaccatagacactgcttatggacactatgggttgggactgccctaagagaagacagcctgttcagcacagtatctttttgtattttcgagtgggaattttgggaaaagatcgatctgaacggatttggatttggattaaacaaaatgaataggaatcaaagttaaaatctcattgagtgtttgaatttgaatttttgtagggaagggaaaggatttgaatatctaaactggactcttttttccccttggaacatactcctaaacctatatatacgtatgtacgcacactcattcatatcaatacacatcctaaacctataagctctcccaagaaactgaaccagtataaattagcaaactcatcataggcaattattattattattattattattattattattattattattattattattattattattattattattattattattattattattggagtacggagaagggatttaaatttaaatctttttggtaatcctctaaacagcagttgagcaacgacgaatccttgatcacagtgtaaattcgttgcgcgcgtcaacttcattgagtacgtgcgtgaccgaagtgaaattaatacgtgcgtgccgtgattcagacgtgattaatttatcggaagtaaccaagttggaccgaacatgttttacgttaaaattgtttgttcgagagttcagtaggaatacaagtcgtcacctctcttctttgaggcgttgcgtgtgtttgcatgcagccagagagtcgtcaattgttcacgacatgactacatgtgcactgagtttgttcgtgcgtggtttgcttgccagtggcggagccaggattttaaagttgggtattcccgtctaagcgttgagccgttggccgcttctacccctcgcggctgccggccacccaaccggcctgactgcctgagcttggcggagtggcgggcgccacccgctacccgccgcggcaatagcctccccctccgtggtagcgcggtccagttctcgccgccagttgccgcctcgccgcgccgccgcctagggtttggaaatggggagcggcgcgagggagccgagccagggagggatgggtcatggagggagagcgagagggggccgtctggaagagtggtggctaagtggatcaactgatgtctgatgggtcatataggccggttgggctgtgtttggatcgaagaattgaggatttaggtgcactaatatatgtacatgtgtatagggctatgtttggatcgaataattgaggatttaggtgcactaatatgtgtacatatgtatatattagaaatatacttgtttttcgataaaaaagttgggtattcccgggaatacccgagaatcatggtagctccgcccatgttgcttggacggaggatggcatgtcatttgttatcgtggcctcgatcgtactatcgttagccaacattcgcatttccttttcagatgaataggagtacagaaagcagagacttaaaattcacttctattatccaacgtctccaagtcgcaacttgggtgcgaccgtgcgagtgcgattgcaccggaaaagaatttggtggagaccgcgcgcgcagccaaatcacatgtcctctgctgctccaccacggatttatcgacatgtggataacgtatcaatcggacgggccgacggggtgctccgatgggctccagggctccaggctcagccgagcgagagcgatcgggaataagttcactttgactcctttaaaagtaactcgaatctaatccatgaccctaaaccacaaaaccggatatctcgacccatgaactattgaaatcggtgcaatttgactccctaggcgattttagagagcggttttgctgacgtgacacctacgtggcggtattgaccgggtcttctttacacgtggcattgacgtgacattagaattaaaaaatatacgtggggcccattagtcattcacacaaaaagaaatgtgggccactaacatgtggggcccacgagtcagtcccctgtctccttccttcttcctcctccctctctcccttctctctctttctctccccttcttcttccccttcgggcggtggcgcgtggcagcaagcaagcccgtagcggcggtggcaaaggaagcggtgaaggacggcgggagcaggccgacggcggcaagggagttgggcggcgagtgggggaggaggtaggcggcgcggctcaccgcgaagagcagggcgatgtggtcgcgacggcggggatcccggcgagccgcacagacaaggggtagcggtggcgcagcggtgcgagggcggaggcggagcacacggccggcttgcacgccatggcggtggtggcggccgtcgatccgcccgccgcgccatccttcttcgcctccgccgctccggctccccgcacgaacacggcgccgcccttcttgagctcgaggaaggcgaaggagcccttcccctgctcccactcggtcttgacccacgcgcccataatgacgtgctcgctggatgcaggtgcggatggtggcgggctccagatcgtcggagagggaggccgtggccatgcagccgcaacggcatattcacccatgggggagggaagggatggataagatgcgtttgcgggcgatggcgggctctaggtcgtcggagagagagaccgcgaccatggcggctaccgcggcatcttcggctatgggataagcgagggtttgggaggagccggacgtgtcgggcggtcggcggtgctgttcattctggcggtgcggggatgaggcgtgacagctccgccgctctctcgccgcggcgctcagcatggcctggttgtggtggtgttggtggcgctcgttgttgccgctgctcgtcgcgccgcccttcttcgcctccgccgctccggctcccagcacgaaaactgcgtcaggcagctcccgtcgatgctgctgccgcattggtggcggtggtggcggcatggggacgaaacgagtcaccagctccggcggcggcgcctacaggacagcaccggcgcggcggaactcgccgtcgacgacgcattcgggcggcctcttgtcggtgcgtaggtcggcgccgggtagcggggcgaggacgtcctcgagggcagcagcgccgtgggtgggtgggtcgtagacgaaggctagcaacgcgtcagtgaatgacaaatgggtcccttctataatttttaattctaatgctacgtaagcgccccgtcaaacgccacgtgtgatgaagacccggtcaataccgccacgtaggcgccacgtcagcaaaccgctctccaaaaccgtctagggagtcaaattacactggtttgaatagttcgggggttcgagatatccggttttgtggtttaggattatagattagatttaggtcacttttaagagagtcaaagtgaacttattccgagcgatcgatctgtgcgcgtgcggctgttggctctagaggctcgatcttggcccgcgcggctcgatcccgtcaccgccgcgaccgacggaggatggacgcctccgaatccacattcattggcctcctgcggctcgcgggcaccgtccgcgtcgtcgtggcgacgcgctggcgagggaagctcgagctcttgtttcttgtagatgagacgggtgtgcacgcggcgaccgaagtagtagctgctagcctgtgcgtgctgcgtgtcgttgtgcccgtcccgtgtgctgtacctgtactcgtctgaaaatcaaatttcaaaatcacgatcctccagagcccgccagccgcacgggagccgagcggagcgcggcgccccgtccgatcgatacgttatatatccatgcgtcaataatctagcgcgggtctgcagaggacagggtttgcaccgagtctacactctacaccaaattattttcccgattgcacggttgcaaaaagaaaaagcaaagcgtccgcgctcaaaaaccttaacgaagcccctgctcgctgcggaagctgcgcctgcatgccgacaccggctggatcccctgctctcgcttcacctcgtccctgaacgataacccctcgacgcgcaccggtcacgcccactgcagcgcgcgcggggatcgttgctctggctccggtcgccatgggtaccaccaagtgtacatagagtgccactcgccgtggtactctgcgcatgaatgcatggtgcgtgtaaacggagatgggggcggaacacatatatagcagagcacacggtaactggttcgtggcgagagagtgcggaaggagactgccgtggacacggcacgtcgactgaatgacttcatggaaacgacagttttagcctttgacatcaaaatgccatttcatccagcgagctgtgggcaacaccgggatttgtaatggcgggcgaattcgacgcagagatcgcgttgcgacatgactgtgcagtgcttgggcgcggctggtcagtgcaacccgcacaaaatgcaaagacgcgaccgatctcactcagctcgatcgctgaggtcgaacaattcagcagtttaatccaaaaaaaaaatcaccgagaacaccaccaatccggaacggcggatgacataagcagaaacaaaaaacacagagcgtttcaaacgaaaaacatagcagggacaacttccagtagcaaaaatcgcacttcctgcaccgcgacatcacatcacaatgaatcagcatgttttacaactatgctaatagatgatccggacgagtgtcccaagggcctgtgaactttgagcgagataccgatcatggttgctgttgctgaggcggaggagctgcgccagcaaggaaaccggcaaccgggggctgtacgagagctggaggcgggaggttatcgccggcggcgggcgggggtgcgtgcgcgtccagggcggcgtctgctgcctgtatccggtggctcagctgctgcatgaatatgcgctggttaacaatcaaagtctgaacaaattccaaacaaatggaatccatctgaactacctacgaattgaaagggaaattcaaacagcaaatcacggcgaacaaatcccggcgaatagacacggcgaacaaatctcgaaaacacataaccgattcgtggcgaacagacaccaattcgatccaaactcagcaaccacaaaatcaggattcaggaggtgttggagagggagacgggattgcgtaccgatcacagcagcagcctccgggatgtcgtcgaggagctggaggagcccaggtggtggcgcctgcgtcgggggggcacgggtcgacaccacgtactgcggcggctgcgcctgacgaggacgagacactgggcgacgccgcctgtagtggtagtaagcagccgcacaggcacaggcgatgccgagtacagtcgtcgctacggccacaatcaaactccagggaaaggcgccggccaccgcgcctcccgtgccgccggcaaccggatccgccgccgagtccttcctctccccgaattcgtcgtcctccctcttccagagtaagatcataagcctcctcacaagcctgtagaggaaactaacgatatcctgaacttgctctctagtcattttcgacgccggcttcttcaagcgatcgatgactcccatggccatgcgccagaatgcatgaatacgtggaacgtccataaggcagacgccgcgttcgtcgtccggcggcggcgaagagagggttgcggccaccacggcgatggccgcgtcggggggggggggggggggagcaatcgctgggcgttgcggaggccgaggatcgcgtagtcgatggcgttgccgaaggcgaggaagaccctgccaccgtcgtaggcgccgaagtagcgcgcggcgccacctcgcgcgcggtccaggagcggcctgatctccggctgcggagcgacggcgacgcgccaggagtggcagacctgggccatgtggcgccaatcgacgggggatgggaggagctcgtggatgaggcgcaatgtctcgtggctgagcgtctccattgctgaggtggagaggggggcgaggcgagcggaggagagatggaatgccacgaggaggcgctgcgctggggatattcctctgcttctcgaagcgggaggagaagatggtggtttggtttggaaggaggagaggtggagcaaccgatctgccttgggccttatttattggcacgtaggttcctcgcgaggaatgttaatgggctcgaatttgaaacttatccggcaagatacttggggaattcttataggggattcagttcatttcaggtcccttaacttgactgcgagttcgacttacgtccttcaaccatataacgggtccctagcttcccgcgaggataagaggaatgggctaccgtgagcctccctctccagctgccacccttctcccttctccccactggtcggctacacaactctcctgccacccgccatcgtcaagcccctactcgccgcacacctctcccaccgacctctcctgccgaccgccgcgagcctctctcaccggaatagtcactcgtcgccagtcgcctctcccgctagaacgagcgctcgttgccagctatcaaagtggacacgtggagagagatgaaaagagaagggagagagtgaacttaattgatttatcacgttgactaagcggcgctgacccgattcaaactaccatgtcggataaaaccacccactatactgtgtaaggacctatgttgtacctgttttgacattttaaagatatgttgtatctggttttttagtaggatggaactcgaattcgttgtcaagttaagagagctcacaatgaacttattccatcttatgggcgattagcatcggccttataaggagcccatgaggccatcaacgcgatgaagagcccaagttagagatcgaatgacacgaggaggcactgcacaaactgagagattagaattggataagcctaactaactaattaaccagcttgtcctgcaagacaagcacaagacacgagtacacgactagtagctcctccttttctccctctacataagccggcaaattgagatgggagcgcagcgcaccatttccaattcgcctcgcccgcactgcacgtcgccagttcgccacccgctccaccgccgccgccgccgccgccgccatggactaatatgcacacgcgttgccggcggtgaacgagcatggccaccctcgctgttccggagatcaatttcaagcaaggcgatgccaactcgtttgatcctctatgtacgatcggtgaccgcgaggaccctgtgggtacgtttctctcctcgtccttgccgccgccgccgccggcgaccacgtgggtgatcctggcatgcgtcccgagcgtgtcctcttccgacgacgacttcaacttctaggccggcgaccacctcgcccgccttcgagtggcgcgatccgccgggcggcgggcgcctccctcctttagatctctgtctcccccgcgcctcaggacttctgcctcgaccgcgacgatcaccccttgtcgtctccgtcgactccgcgtctccgccggccgactcctgctccgcagcgcccacgatttcggccccggcggcgtcgcgctcggcttcgaccctgcaccgagctgcgccaacgatggcggctacatcctctgcgacgcttggctccgcacggccttcctctacccgccctgctccgacgactaccggctcctctgcgccgggaacgtcggcatgatccccaggactgcagcggatggcaaacaccggatccgtttggtggccgagctccagcctgacatgcgcttcgtgccgctccctgagggatgcaagctaccgcgtactccagcgatgcgaaccccccaagccaagtaccggtgcgtgaacgtgagcgacggtgagctgacgttcgtgcagatccacgacgacgccgccggcgcgccatcgatgatcatgatcagcatgtggacgctgcagttctgacgcgggggagaagttgatttggtcgatccgccacgcccacggggtgcgcatcaaccagatctgggaccacatgacacatatataccggaagaccatgaatccatgatgccgcggcgcgttctggtgctcgcgctcggtcaccccaaggaatccggcgtggttggtgttcttccagatcacctcgcggaactcgtggatgttcgccgtcgacgcgtggccaccagaagcgtgctcgcgtgcaagaagtagtacacgatgccgcagctgccgacggtgtaccactcctctcgctacgacgctacgtccgcgccacatggagaagatgatgagagtatgaggcagatgtgcgtatgcggcgctgttctttgctccatggcatggctgcatgccagtcacgtcgcattcgccatgcgcgcgctatcctggagcacccctccaccgacagcttggcgtgcccccctcccctcccccggcgacgaggtccgggccgctcggcgccgtttgcacgcccgcggaccgctaatgtcatggcacggcttggcgccgccctcgggtgtgccccccggctggcgaagcaggagccgctcgatggtcgtcaccgcacgcgccaccagctcgctggaccgcctttgccgtcgttccgcttgctcatcgccggagaggaaggggatcgggagagaaggatctgggagctagggttttgcccctctcggcgcttcatccgacacgaggacgatcggggccgtctatcagatcggacggcttagattcaccccgcgtcaggccgccgctaattactcagcccaatgggccacagaagtgcatcgggtcgttgccgcatatgtgggccgcgctcggctgctcggcttgcgggccgtcgaactgactcggctcgcacgaagactggacggcttcaaaagacctgggccgaaagttaagaaataaagttgataaaaaatatattagcctgtaaatgaaattttttctaaaccagacatcggcttcaatggaaggtgattgtttataggctaaaacaacaaaatcttgaaataaaactccaacattgtggtattagagcttaaatttagcctactcaattccttattcacatcatccctgtgattagaagccatcagtgccaatctttgttcgacgtgaacaatttcgagtcaaataagtttaatctaatctgtttagcttcttatctttaatgcttagtgaagattagctcatgttcatgttcaattaaacttaataagatagaattagggttcttgcgtgcccgcttcgttggaccgtcgacgccatgtcttcgcatgacgccaccctcggacacgcctcccagccggtgaagccatagccgcgtgcgtgctccacctcgacggaccgctgtcagcaccgtcgccaccatccactctctcgtgctgccggagtttggatcagagagagtaggggagaaaggggattagggttagggttttcgcacccctcccccctccggccagcgatttcatcggcgcaggaccaatcgaacaactcagatcgaccccgcgtcgggccgccatcattgttgggccatgcagtctttgggtcgcgcttagttcgcctcgggcgggccatcgccggtagatgggccgtgcaccgctcgccgtgcgctcgcgctaaatgggtcgagctgatattttgggcatgtagtttttcccattgcaacgcacgggcactattgctaattttttttcgcagcaccaacgtcattagtgccgtggtctaacatgatgacgtcaatgacgttggcactgtcccatccgagaaagctaagtactaatcaacgagattggtgccaggcattacaatattttgctataaatttgatcaaatttaaaaaagttgactaagagaaaaatcaaatgacttatctatactattataaaatttgaatatgtttttatcggtactttggtacgtcattcatgtatgagtcggtttttaagttcgttcgattttagaaatacatatccgtatttgagtcgggtttaaagttcattcgcttttggaaatacatgaaggagttgtataagatatctctttaaaaaactcgcatgctaacttgatatgatcggactcctgattgcagctgatgattttctagaaaaatatatatccaagtgaattccaacaatgaatttcaccttaactaaaccgtataataataataagattaaaataaccttcacccgtcgtaacgcatgtgcattttttctagtaatataaaacaaggaagtataagctcaagagttatatatgaaatccaaataaaatcgtacatataatgataccttcagactcgtataccacgtaattaactgcgcggccatatattatcaaatttctcatctatctaggtcaagccgtcaactcccgtgtcgtctcccttccttccgagttcgcccaccccctacgccgccgatcgatctatctcgcgagcaggccgggacgtatgccgtcgtcccgctgcgccacatccatcctggtaagcatcctatacgttatgcacatatatcccccctaattcatctctcgacacccacttaaccctagtgtataccaagtcccaagttagactggacccaaggtcgatagatccgcctgctgatatatataattaatcaatctaagaaagacatatggatggtgatgaggagttaatctatttgctgttctacttgaatcagatcggtctagttagctggacacataaatataactagttgatatataccctatgctttgctatggaaaatgtatggatgaatgtatgttatatattataaaaatggtcgatgtatatatttaaaaaatgtgaagataatgatttgacattgtttgcatattgagttttaaaaatataacaaaattgtaaatgatatttaaaatactctagataataattgctagtgggagatgatgatgatgtgacaaatttgtatattgagttttatgagttagtggatatcaactttatagtaaaatatgactgatgtcttaaataggggataggtacgcatactctactggagatagagtcgcaaccaacctggtatatctttcttgtataattggaatgctatcttcaccgggtgataccatgggagatttttacttgtgtagtggcgaccggagcgtacttcgtaggatagctttgtcatcacatcttttttcacctagtacttgataaaatcaatttgcctaacgcacaacctgaccagagggatcacgataggatccccctagcttttttaattttcgattaaactaaatgactagtgaaagaatctagaagcttgtctttttttcttactagctagtaaaaatgcatgtccgttgcaataggtgaagataatttttatgattgataaaaaatcttcccatttaaatgctaaactaaaacaagacaaacaaaacaatggtaaaacaagtcagatatcatatggcattgaatccgattgtgctcgcttcatgcattatcacacaaaaaatcccttatgtgcacctttccatagcctaacaaatcgatcgggtggctattccataaattgatgcataggtatttgctatagattgctaaagagatattatcatcggccaaagattaaaattttgcaattagtggaagttttatttactgtagatggggtgtttgcaaagtaactgttaacaccaaaatttggtccagtgtgtttttcgcatcaacagtaacatcatgcatatcttaaacaacgataattttaaaaagaaaatatatatgaggagagaaattagagaaaaataggaggaaaaaaaaaggagaaaaggagatcggaagaggagggagtggatcagtatgattggaagaaaaagaaagcaaaaaaagtggagaaaaaaaagataccgatcggggaaggggtgtaggacgggccggcgagatggtgtgggtcagctgggttagactgggctaggaggggatgtataatagttattcacattgaattagatacgggtgacatatcaaacggttgacaaaaatattgtcgagggaagttccccgatagcgggaggtcgcgggacccccctttcgtgagttcggccgggggaagaagcttgcctcttatgtgcaccttatgtgcacctttccatggcccggtgaaccatcgtgaggtggcctcgcgccggctgggcgagcagctcgcgaaacgcgaggaggccattgccgggcgcgaggctcggcatctggagagtgctcgcgccgagtgcgcggtgatagcggcgagggcttctaagctggaggcacgggagatggacttggcggcgggcgggcagcccggcagcgtggagttggtgagccagtttgccacggctcagagcaccctcgccaacctagagcgcttggtgcaagatgagcccccccccctcgggcttgttctagcgaaaaggtaaacctgcgctcggtccgtggtagctaaatggtgaagggcaagatcgtcgtcccaagggagccggtcagcgggactggccagaccgaggctacgatgaccgggggtcggggacggccgtgtgtaggcccttccgagcccccggggttcggtgcaacccggggcgcggcccgtgtttgggctccctttcggcgagcccccggggttcggtgcaacccggggcgcggcccgtgtttgggctccctttcggcggtttccaggttgccccacggtacttagggttcggagtgagcgcgaactgtcctttgacccaggacaagccagaggaaagagtgaggataacgggtttcatattaagtagaaaaattcattgcctgtaaagggaaaaggatacacagtggtagcccccgaccaagcccgcacaagccgagaggttgtgcgggggttggcccgagctcctggaaagcaaaaagtctcgatgctatggatagaagcgacggaggtgttcgatattctaggggttaggaaactctgtgccgtcttccgtggtcagtcggacagagcctggccggggaacgccgatcactttgtatggcccttcccacattggcgagagcttgctcagccccagacgcgattgcacgcggcgtaggacgaggtcgccaacttgcagtgatcgggcccggacgtggcgttgatggtagcgccgcaggctttgttggtagcgcgcggcacgcagggccgcacgccttctccactcttcaagatagtcgaggtcgtcgcggcgaagttcgtcctggttggcctcattgtacagcgcgacgcgaggcgatcccagggaaagctccgagggtaggaccgcttctgcgccatacaccaggaaaaagggggtttcccccgtggcgcagcttggagtggtccgatttgcccatagcacggcgagcaattcctcaagccatgaatccccgtgtttcttcaggacgttgttccgccatattccgccatgttgttcgtagctcggaagtcgagccgaacgacgtatttgaggacgtccccgcttgccgaagtcagcgtgactccggcgcctgcaccttgaaggttgagggagccgtcgaaatgcataacccagtgcccgctacgaatgtcggtgtttgggtcctctccatctccggggagggaggggctgttggtcagaataggttcgtccactggggtccattccgcgatgaagtcggccaggacctgacttttgatcgcgtgccgtggttcgaagtgcagatcgaactcagctagctcaatggcttatttcacaacccgtccagtgccctctcggttgtgcaaaatttggccgagagggtaggatgtcaccacggaaacccgatgcgcttggaaatagtggcgcaatttccttgaggccatcaaaaccgcataaagcattttctaggcctgcaggtatcgggtcttcgcatcccgaagcgcctcgctgacaaagtagacgggccgctgcacctttcggctgggccgactcgtgttgtcaggggcggatgatctgggacgcccttgctcgggggcccgggggggcggggtctcgagtcatgtcgggatcgtaggcctcgggaccactcgccaaagcatcccctcctcccacgggggcctcggggtcctcccgggggctgggggcctcgggcactgggcctacggggaaggaagggccatcacgagttaaaggggcctccagttcgctttcttcgcgctcgactattagggcggcactcaccacatggggggtcgcggccaagtagaatagcaacggttcttccggccccggggctaccaagatgggagggggaagtgaggtaagctttcagctggttgagagcttgctcagcttcctccgtccacacgaacggcccagagcgcttgaggagcttaaataggggtagcgccctctctcccagcctcgatctcgatatgaatcgacttagggcggccatgcatccagtgacgcactgtacgtccctaagcttgctggggggggcgcatcctctctatcgcgcgtattttctcaggatttgcttctatgcctcgggaggagactagaaacccgagaagtttgcccgctggcacaccgaacacacacttatcagggttcagtttcacacgtgtggacctaagactatcaaaagtctcggccaaatcctgcagcaacgtgtcctggtggcgagtctttaccaccaggtcatcgacgtacgcctctacattacgccctatctgattactcaaagtaatgcgagtcatgtgctgaaaagtaaggcctgcattctttaagccaaaaggcatagttgtataacagaaggtgcccacaggagtaataaaagctattttttcctcatcttccctagccatgcgaacctggtgatacccagagtaggcatctagaaaacacaaaaggtcgcaccccgcagtggagtcgactatctgatctatgcatggtagagggaagggatctttagggcatgccttattgaggtctgtgtagtcgatgcacatccggagcttgccgttggccttcgggacgaccaccgggtttgccagccattccgggtggataacctcgcggatgaaatcagcctccaggagccgtaccacctcctctcggatgaaggcctgccgctccagggcttgacgccgcactttttgccggacgggtcgcgcgtccggtcgcacggcgaggcggtgctcgatcacctccctgggaaccccgggcatgtccgacggcttccatgcgaagacgtcggaatgtgcccgcaggaagaagacgagcgtgctttcctatttggtgtccagggtcccgccaattttggcggtcttggacggatcatcgccaagggggatctccttgacgggcaccttgtcggccgaggtgaggcgcttcttggaggcgcaggacgcggaggcctccggggcctgtggctccgtggccaccgcgaggttgtcggcgcgctgctccgcgcaggcaagggcgactttgacatcgccaaagacggtgatgggaccactagggcccggcatcttcatctggagataggcgtagtgggtggcggccatgaacttcaccaacgcaggtctgcccaggaccgcgtagtagggcagattgagatccgccacatcgaagacgatccgctcggtgcggaagttggtggagtcgccgaaggttaccgggagctcgacgtggccgaggggccacgtgtgtcccggagtcacgcctatgattggcagcgacggctggagcttcatcgccggggccttgagcgcgtcgaaggcggctggggagatgatgctcagactggcccccccgtcaaccaggacgcgcttcatcctgacattgtgaatggtcggggagaccacaagggccaatttcccgccacgagcgagcactgttggatggtcgctctggtcaaaggtgagcttcacttccaaccagcgcgccttccgagccgcttcgtgggttggaacggcggccagaagctctcgcctcatggccttgaagcctcggcgggaggtgtgagcacatgcccccctccccccgtcaagcgtggcgacggtttcctaaggtatctggaactccagatcctcgctgtcatcgccatcatcggcgggggccttcttcttggcctcccctcgccggtcaccggctgaggtcgcgggggctttgccctctcgtcgaccctgccgcttctcctcatcggcctttcggaaccgctcggccaagttcttgaccgagcggcagtcagcgagactgtgccgataagtgttgtgcaccgagcaccacttgtctgccgaccggccctcgccggatggagcagtggagctcggcttgtcgccggtggcctttcccttgcgtggggcccgtgtaggcccatcagccgcaagcacatggccctcgtcatcggagcgggccggtttccttttacctctcctatctcgccgcttagagcgggggcagactcgtgggtagccgcagccgccgcaccggtgccgggagagttccaggcccacgcctcctccttccgagccaccttgtccgccagctcgaaaagctcggcggtggtcttaggctccttggaggctatcttctctaacatgcggttatgccgcacgccattccgaaacgcataaacaaccgcgtgggccggaatgcatggaatggtgttgcggacctagcagaagcgctatatgtatgaacggagggactcgtcgtacagcgtgcaggtccgcctcttctcccgggcggggatatgtgccctggaagttcgtgacgaactgctggcacaggtcctcccaggagtggatggagtcggggggctgggtcatcaaccagccgcgcgccggacccttcagggccatggggaaataattcgccatgacccggtcgtcacctcccgccgccactatgaccgtggtgtagatctgaaggaactcggagggattgatgctgcaatcatacttctccgtgaggttggggcgaaacttcgggggccaccggacgttccggagactcgccatgaaggccctacaacccgtccctccaggggtgagcgtgggaggagggcctcctcgtgaggaacgtggcactccagatgaggaggcaccttcccccatgcgaagagctcggcgctcgtcccggcgtcgctcgatattgattcgagcgtcctgctccccatagagaccgtcgtgacgcctccggcttcccgaggcccccatcgatgttggagccgtggaccgcctcgaggccatggctgaccgacgggccctcctccttgccgatgaggagagggtaatgggggtacgcgacgtaccggtgacggcgggtcggccgcccgcggccaactgccgctgagctgtggtgaccaagttggccacgtcgtccaaccagcgctggataggggtctccggctccgagttgacggggggatgccgcagaagggcacccgccgcctgaagcgcacctcggggcgagccaccatcaccgtaagtgaggcggcgccgtgccccgacgcgtggtggcctccctccgcccgggagcggggagaggcccgaaccacccgaataggtggggtcccccctccgcgagggttcgcagcggggtggagtggaagagttgcggcgacgatgacgtgggccgcggctctcgctggcatcctcactcccagacggagtgggggtgaacgccaccacctcctcctccaggacctcgaccatgatcgtcgagggcctaaggaaacttggggcggaaggaaacggcttctcttcaaagcgcgcaacttccccctacctggtgcaccagctgtcgagggaagttccccgatagcgggaggtcgcaggaccctccctttcgtgagttcggccgggggaagaagctcgccttttagaaatcgcgtacctgcccctaaggcgtctggctagcttgcgcacaatcggattatacaggttcgggccgctatcgagcgcaacaccctactcctgtgtttgggattatgtatgagttttataagggttcctttactccggagagcactctcgtcttctcctagagtttaggttttctgaccgtcgtcccccttttttatatttttatataaagataaagattggatggtaaacatctattattgtttctctatattttttttttgttgttcatggctttcatctcgttattattcttctctctccgtttcgggttataagacattttgactttagtcaaagtcaaactactttaagtttgactaattttgtagaaaaaagtagtaatatttttaacccaaaactaatatattatgaaaaattattcaattatagatttaatgaaactatgctggtgttgtaaatgttactacttttttctatagagttagttaaacttagagtagtttgactttgaccaaagtcaaaacatcttataatctgaaacaaatgaagtattattgtaaacgcttagcattgtttatttcctttttttttgttgttgttcgcttacttactatggtagcgtctgtatatatgaaatctattctatgagaatagtaatgcaaacatccaacatcaatgtggaaaaaatgcatctgtgcaatgttctatggatgtcatgtgtgttcttaccaagaggaccttttagctatatcaaatattgaagcacactgctaaattattcttttaccatgtattggtgcaaatggccttacacttcataatcatttacttcaacgatcagagcacatacaacttgaaaattgtagaaagtaaatggcattgttggtacacaaacttatcaaaccgctgtaattttgtacataaacttgcaaatggtagttttggtacacgaatttgtctgatgcgtgttgtttaagactccagcatgcccagattattactattgtttttaccatgctgatggagcatgattaattctaattttgtgttcgatttgaatcagattagtctaattgtctggacttatataattgatttgatgcctcgagtttgggaacggacggcgctctcgggagagagagtcaccgccgagctgtcatatctttcttgcgtcgtcgggggatgctatcttcaccgagtaagatcaggggggcttcttacttgtgtagtggcgtgtggactgtcgtaggatcattttgtcatcatattaacttttatcacttagtacttgatactatcaattcgcctgatgcacgacctgaccgaagggattacgacaggttacctctacccttttcgatttttgattaaatgaatgatttgtgaaagaatcttaaagcttattctttttgttgtcgtttaaggcttctgtcttgttattcgattataaacatctaaaatatttgtttctccagtttattttggttgttcgcctacttgcttgtctgtatatatggaatttgttgtctgtaatgcatccatgatccatccaatgccagtgagaaaatatattgtgtatgtccaattactactggaaaaagcatttttcccgacgtaggggtcccattttcgcaggcggacatgactcttaaagccaaatgatcgcctacaaaaatataaatcggggtgaaattgtcagtccgcctgcgaaaatagacttaaatataaatagacttgggtaggggttgattttttctaagtctccacacctcaccctcccttcctcacccacggccggcctctcccctccccatacctcacggcctctcccctcccctcacctctcctctccccggccgtcggagggggagcgacggcggctacggcgcggggtggcgcgacggcgcggcgtacggctggcggcagcctccctcccctcccctcacctctcctcctctccctggccactggagggggagcaacggcggctattgggcggcgcggcgcggcgtccggctggcagcgcgctcccctcccagatctggcggaggagggatgggggaggc

SEQ ID NO: 67351 - DNA, 8496 bp, Oryza sativa
ttatggaacaaactatctgatgcactttttctataatatctgatggcactttttcttttctatttctttctatttcaattagatatgatttgttttggtttttacatatgtactacttttgaagtatttgataccctgttttttgctcgaaaaatctgaaatcatcttgaaattgagattaaactgcattagatcatgatttcatatgaattttacattgtttctttgtagttacatgtattttcaattgaaattgtagtgttcactctatatatttgtaatacaagttcactgtaactagtttcattatattctattttgagacattgaacaaatcaataatgatctattatctgaaatcttcattttgttatctgatgatgagagaaacattgaactgagatagtcttgagtttaaaacatatcttgaatgtgttcctgaatttgtgcatgattgtgtgagctaaactattttgtttactgaactaatctttttacaatgagttaatactagaattactgtgattcttgtatgtaattttattacttttttacagtaacatgttaagatgtgagttcatatgaattggctcttttgtttgtgctgtatgagatattgaacttttatgtaatattgagttggatgagacaagtggttgacattgagatttgaatttgtcattagtttaatatggtgattatgctgataaaattgaatgtatgacaattcaggatatgctatatggcctagttgttatatttctgtataactgtatgactgtgatatcttcagagtgaaattcagtaaggttggaagactaatcaatctgtcatgtttttttataaagttagtttggtattcatcaatagtacacagtaatactatcatccagaatgcagttttgtagtactgaatgcagtgtagttttacttttaacattacatagttcagatctacagagcaaacatatgaaattttcagttctgagttgttgtatttatccagcaaagtggattgttaaccttgtttcatttgacatattcagcaatttcatgtattcttttgaattatatatttgacctaaactctctctttgatctttttcaggaattgtatataggggataagaattggagccttgaactaaccttgaactggagccttcttgtttctcttgattttgccttcctcttgttttttctttgtgttctccagattctgtgtttcctttgtatggatctcaactttctgttcagaagttgtctttgatttcttctttcctatagaactactctttgattctgacattgtactctctccttccatctgcgatttggatcctctttttctctcttctttctcttctcctagctccatgtttgattcgtgctagatctgtttgtgaactagtagtgctgttgaaaagtaggggattgaaaagtgtggtcccatacatggttgattcacgtgacatgtttttcatctacttggcttccaagtttggtccctactacttttttggataggctgttggattatgatttgggctttatttccttgtgttttgcttctaattttgtatcttgggcctgctttttactaatgggcttttatggatctggatatagacttgggccttcaaataattcgcatgggcgaaaaaatcatgggctttgtttatttgtgtttgattcaaattttgtattttgggccttctttttactaatgggcttttatggatctggatatggatttgggcttttatggatctggatctggatttaggctttaaaaaaatggcgttcaaataatcaaataatatatctgtttttaagtgtaatatctatttgtatcactttttctgagttgttggatgtgcatcctatggtagataaaatctgtatgattggagcttcagaaatcattcgattcctatatagacagccccttctttttttttggttctgggatttttttcctctactccaggctcttctagatggcattgtccattttgtttaaaaacccttcttaaaacttgcattttatatttaggtccgctggacctttttctcaccgttcgtatgtcatcggacggctatgggacattttgaatgcgtggcatgttctcctgctgagaatttggatggagcgcaagcgtgatgccacgtggctcagtgagaggcctgggattagacctgaaatcgtatatagagattgagggacctcagatgaacttattcctatataaaacccaaagtagggtccacgtgtgcccaaaaaaaaaatctatgggcctcaaaacggcacagtgcgaaaacccgtgtgctgtcatggagccatttaaccagtaatggcacggcacagtagtattaaaggcgcccacccctcgtgtccagagataaggctaaagctcaccgtccatcgtcgtcctccgacctcaagccccctctccgagctgacacgaccagcttcagcacttcagttcggctccgtccccgagttcggcagccgaggcgagtggggcaatggtggctcccgcgacgctgtccctccgccccttcgcgaccctcgcgccgtcccgcgccgcgctgccccgcgtcggcgccgggttcgcgctcccgcccgccgtctcgtgccagccgaggcggcggcgcctgtcgctccgcgccgtggccgtcgactccgaccagcagggctcccccgagcctcccgatcaggtaaaccaaaccgcccctcgcctcccgccctaattttgataattttcccgtcccggtttgagacggagaattgtggtggattgggcgcgcgcaggaggcgaagccgaagaagtaccacttcctggtggcgaacgccaagttcatgctggacgaggaggagcacttccaggagcagctgaaggagaagctgcggctctacggggagcgggagaaggagcaggacttctggctggtggtggagcccaagttcctcgacaggttccccaacatcaccaagcgcctcaagcgccccgccgtcgcgctcgtctccaccgacggcaactggatcacgtaagtgcagtgccccctccctccatcgatcgtttcaattgcagccgcaaccgatgctaataataagctaattactagtacaacacaaaacatgtctagtacagaaattaaaacgcctatcataaagagtcgcagtgtcagtacggtattacctgtgtgtagtgtgttatggacttatgatcagcagagaacaaagtacaaactgcaaaagcaccgaaccaacatgatgacaacatcaacagtttttcatttctcttaccactcatcaaatgtggatttaaatagagctttacggtattgctgatcctacgccgacatacatttgcttcagtacatgttctgagctggtgacaaaataaggacgatgccaaaatgcctagtttggttaatatgcaagcattcttcttttttttttgttgaaaaaacttcaaattcagggataagaaatgccaaactattgcaaataagcagtagttttcttatatagcactaattacagccaaagatgctagtagtgccttgtccatcggacttgcactcgcgattgtaaaatgcttcccacgaaatatgcatcctgcgactgtaaacacattctgcagctataaatatatcccacaaaacagtaaattgtgtctcttgcaaatgcaagcggagggatatagacatatagtagaatatttttcttataagagcaactagtcagatttgagcccgtaatgttctgtacaattgtaacgtccattttccaagtttgatgtgtttcaccgggcacatttctaacatttggtcaagatcctgtttcaaatgcaaaagtacaaaagttttttgtagtccttgtgaagtattgtgaggcataggtatattgtagtgttgatatgactggaaaaactcagaactactccctctgtttatttgtgtatgatgctggttagtttattaatgtcaaacatttcagaatggatgaatacaccttatgtaaacgaagacactgagtgtaccttttgagttttgctcaagtcaacagtcctttggaattttacgtgatcctccatcttatttgctatgatgcttggatctgtctttctttgtcatggctcatgataatgatctacaagtgtcatcttaattttttgagaaaattccttacgtgcctctgttttttcgctcaatcccttctataaattttgccacatcccttacatggtcttgagttttcattttgataccctacatacccattccgttatttggccatgaactgaccgttatatttttttccctgaaatgactatactgcccttctctcataattatgtgctagcttattgagaaaaaacacaattctcgatgtggaaaattcttatatatgataaaatcaaaagtgatggaattatttgaccctaaatatgaaagattcaaatttttagcaaacttcaaaatactgataaaattcatacaaaatttcatcaagaacttgaaaccaaaactatttttgtttggcttacatttgaattgaaaatgatttaaaaatgataaatttcagttttaaaatttgtggtcaaagaattataccccatttgttttttttaaaaaaaataatgaacctttttcccattgagaattgtattttttttctcaataagctagcacacaagtacgaggggtaatattgtcgttttggaaaaagaaatctagcggtcaactaatggaataggtatatatgggattaaaatgaaactcgggagcatgtaggaaaataggaaaaattcagaggcatagaaatgattgagcgaaaactagtcagggcacagaggaattttctctgatttttttccacgcaccatactaactgggtaggatttcgagttgtggacattggtaatgagtcgttcgcatcctgaacacactgatttgatgagaaagctagtgaaaaagtaatagagggaaagggacaatcttattggactacgaaactggacaacatgataatacacagaattttggctctgagcatgtgactcagtgactatgcatcacattattttctggatgtcatgatgtacgacatggtgtgaatcgccatgaccagaccagttgtgcttctaaccatccaaaattccagataggaagaggaccaaacaatcactgaaatagccagcatctacacttttaatgatcttgtaattgccgataccatgattaactactttcaatttaagtagcatggcaatcctcaaggttactcattttattcttttgttatcagttttatgaagttgaggctagacagggtcttagcagaacaatttgaagcagaaacgcttgaggaggcattggcttctaacccggtcgacttgaaatttgacaagcctgagaaatggacagctccataccccaagtatgagtatggatggtgggagccctttctacctccaaagtctagcaatggaacagcatagagatgatcggcaatccatatgagcaatgtaagatttcttccatgcaagtgcccaaatgtaatctaaatttttaacaatgcctatgtaatacttggggtgctgtgagtacagttagctacaatagttgcagagttgctgtactttctggtaataccagataagcagtggttttgttttggaagattgtggacggctgtggttggggtataattttcttcatgatgcacattgctgtctatgttgtaaattttatcacgggaaaaatgcagtcttccaggtcctatataatttctgaaccaccaccatgtgcatcaatagtgtgcacatgatttccattctgcagaaacagccaccaagcaaacaacttggtgttgtcaatgattacagaaaagactcgagggccttgaaggtctctctctattagtcatatataatcataacatttcgtaatccaacataatcataattttcattatcccaagacatcagtaccactaactatatactattaaagcttagggtgtgtttgattctttgggtgtaaagtttttgaagtataccgacgcatatttgaggtattaaacgtagactaataacaaaacaaattacagattccgcatgtaaactgcaaaacgaatttattaagcctaattaatccgttattagctaatgtttattatagcatcacattgtcaaatcatatcgtgacaacgtctcgtaatttacatgcaaactgtacaattaattttttttccacatttaatgtcccatgtatgtgtccaaacgtttgatgtgatgttttttgccaatttttttttatctaaacaaggccatattgacatgtgttcatttagaagcagtaataggatgctgttatctcacactttgtccataactaaagaccgtactccataaccccccccccccccaccccccaaacacacaaaaaaaaccaatgatacctgttcaaaacatgttatagatacaaagggaaaaaaaacattccaccagtaaccaagcacacgcttattacaattttaattaacaaaaagaccattgttctgatataggtcacattgttcttcttacatacagaaagcttattggattaggaggaacacaatgacacagatgcgcacaagacctatctggctacatgcctagattagtgaagggtaaaaccaagagttaaacaaacagtactgaaattacagtcatcattacctgcattatgaccaacatacaacaaacactgaatcagtattgactgaaacaatccaagggtaatgttatagctcctagatcaatcttcagatgcttcagaatctgcaaatcaatggagtacattacttgaaggcatataaaaacttggtttaaagccaaacatgtataataagaaagcaatgcgtaatcatataaagtgtagagcatgcaaacatgctgatgcaagttcctattaacatgtggtaggtattcataagcagacgttaggttggcctagcaatcttcatgtgcttaaacgtacactactgtactaatgaaagaacaagaagataatggtccatgtgagaactctatgcctccttggatttaaaagagttatctattagatttcaaacaattaagcttttggaatgaagggaactcaaaatagaaaggaggaaaacaaggagaaatgccttctcaaattctgatggaaaaacacgagtactttaaaagagaggtttggatgtaatagggggaggggggggatgttgattttcaagaaaggggatgaaaacatgaagttgacctcatggattttttttttccaaaattactatggattagtctgttagataataactttaaagtaatctgtaatgtctaatcctttgttccaaaggcctccatagatattatattcctgtagtaggatcatagaacaaacttcccatgttctctataaccctgtttagtgctaatgattttccccttggttagaatattgaacggttttctacgaaatttctatgttttaaacctgtccacaatattttcaatagaaaatcatgtcaagcccatttcttctttctctgccatttcttcaagcaaacgcttattcaaatgacggctgaatacgtcaacgcacaaagggaaatgataggcctaggcatgtgcacgaaagcaccacgaaattgaagaaagaaaaacttgtggtgaagctggtcaactttcctcttagatatatgtggataggaataattaacaaaaccaatgtttaagtaccggagtaaataccaatgaaatcttcgcatgccattttttttctataatgtcgcatttcatggtggtcacagaaaattctcaatgctacaattaagcagatcaagtcaagaacaggaggattccacaggacgatcaagaaaaatttgccgagcagagacacgttgcaatgcgtggatacatacatgacacacggggagaggacgaaggacggcggcctcgctcgccgccgtcaagcgccccacacggtgatcccctgcatcatgcacttgaactcgccgaagtcgacgcggccgtcgcagtcgcggtcgacgttgcagatcatctcctgcaccgtggcgaggttccgggcctcggggaggccgagcttcttgagcacggcctgcagctcggcggcggagatgaagccgtcgccgtcctcgtcgaacacccggaacgcctccttcatgtcgccctcgtcgtcgtcctccccttgcttcccgggctcctcctcctcgacggggccgaagagcgcgtcgccgagcgcgcggtggagtgcctcgaagtcgccgaagcggagccccgcggcgcccgcggggatgtagcccccgaccgtggccttcagccccgcgcggtcggcgccgaggccgagcgcgtcgagcgcggacgccatctcgtcgagcgtgatctcggcgtcgccgttgcggtcgaacaggtcgaacaccctgcgcagccgcagcgc

SEQ ID NO: 67352 - DNA, 16215 bp, Oryza sativa
gttgttgagttcgtttgcacagtgtaaagaaccatttagttacagagatctaaccgtgtcctttttaaggaggatatttaccatttttctttaaaaagcatggatcatagccagtgaccacatgacctccaaccaaactcataaaattccatatatagacggcagaaaatatcaccaaagcataaataaataaatgcatctattgcaatagcttgctaataatacgagcacgggcactcaatgctatctaaattctacattttaagctaattgcactggactataacactgtattaatacagagcaacgctgttagcacagatttaaacacagtttacaatatccaatctgtatggcttgcatcagatgctcaaattaatattgttccaatttctccaatagaaaaccgagaaaatgagacttcatcgtgataagcaagatgtatatcttctggaacaagttggaaccgcgcagtatatccgcatgaacgaaaaacaggatcgccacgagctacatttaatcgccacctaaacgaaccaactcctacagctaccacccggatagcacactcgccagagcgtcaaaatcctaatccatggaagctcacagcctcacgccccccaccagacagaacccaacatgaagcccgttcacttgtccgtgcgcccgtgcgtgcgtaccttcgggttcttcctctcgccaccgtcatcgtcgccgccgccgcccttccccttccccttcttcttcctcgccttcgcgccggacttgtgctgccggtgcgccttgtgcggctgctctcccccgccgtccgcgggggccatggagcgctagggttagcggcggagggcgtttgcgcgcggcgccgctgcggcgaagagagcggcggtggagaaagctagtggggaggaggaagcctggagggggaagaggccgagggttttggggagagggagagagaggcgccgcgtgtgatgggccgagcggggtaagcgctactatgggctgggccaagaaggcccaggcccattttcacgtcacgagattcggacatgccacgtgtagcgcgcaggggtcgcaccggccaccgcgccgggaaggggaaggcgtgccgcgtgcgcggcgcgtggccgcctgcgacaaagccaccggcagttacgcctccgcgctcctccttcccaagagacgcagatctccaccccgcgctcgcctcgctttcccccaaaaagtcttctcgtgagagctttcccccccctcctccacccaacaaatccccagcctcccagattcgtggcggaggctgcggcctgcggctgttctagggttagctctcgctccgccggcatttctcggtattttttctaactagtcttgtttagggcagcgcccctccgtaaatttttatagcggttgagttttctgggtagatgctttgttgatatagaatggacatggttccggttgtctgtagcgcgtggattcccagctagaatttctggccttatgttggcgtcagttcaataaaatggaatgtttactttaatgtgcttatcgtagagatatcagatatgttttagttgcaaatgattttttttatttatgattttgggagctaaaactggtgcacaaactttttttttgtcagtaatagattggctatccgtctctagaacatgacatttacctgatgaaacagctaatctgttaaatgtggttgtaagttgatatcttttgttgtattagtaggtagataaagtattgtaagggcttgggtttgcaaccggagatggatgctaaaaagaagaggaacaagaagaagaaggggaaccaagggaagaacactggtgatgtaacgtccagcactgcagaggctgccattcggtcccacaatcatgagacagcccctaatgaccatcataatggcactgatgctgatgatgcaatgtccactgttggagaggaagctcctcagtaccagaatcatgagccagatcgacaggcaaatcatgatagcacaaacactgatgatgtcatgtcctctgttggagaggggattccatttcagaaccttgaccctgccatgacacatgaaaatcacaaagtcagtagtacagcccatgctgatcagaggagtgttgagatgtcagattccaccgtggagcttgacatgcacagactatatgaagcaaagcttgtaagtatctgtaaattattagattataaatttaccgtattcttatgcaaagttcgtagcttacaaagcttagtggaagcagcttttcctaccacttgaattgacagtgtattttttgcattagattctttaccgtgcaacaatacattagtaggtttgacattaatgctaaaagttggcaatgtgaattttcttttgggaatgcaaaaaaaagggtgctctgatatcacttgggcatgcttccatgttgttggattagtttcacgtgcagccataatcacccatacagtgagcaaagaccatataggtgtcattttttctcccccttgcccatatttttctcatcattcccacctcttgtattcttagtctcctccctgcatttgtccggttgcattgcaaccacttcactgttcttcctatcacccattcttagccacctaccatgtgccaatagttgagctcgtcactgccttacctgctgtcatgtttctcaattatgtcatcttttaacctcagatattgccaatgcaggataaattacatgatacgataaagaagttggaagatgagaagagtttgtggcatcaaaaaatggtttgtatctggctatcggcacttgtggttgacatacatagcactcatttgtatttatagtatataccattgctgttggccaattggtctgaaacatatttttggtaccttagtacaataaaataacatgtatagaatttaaatatctccataccaacctactttcactttttttcctaactacgaggcatgtcttgacaccacaaatttttatttgataataattcatggtccaacactcagtcttcatgtgctgataaacagaaacgagaagatatgtgtgaaacaatgttagattaacttctccgagttctaacagttttatcctgtgatttgtgctttgccgaatgaagcatttttgtttcatctattcatttcctcaatcaggcatctccatttgttgataatgacatttgctgttttgcatgttaaagacttaagttacaaattataatacatgtttggtacattattttgtgtccatatgtttatatctttggatcaaatggtttgttgcaaaatgtgaacaaatgctattttggccatcatagaaatgtcatgtaagaaatattttctcattctttttcctgcagagctccatggagattgaggttgaaaagttgcataacaaagtggattatcatgcacagaatgaggtatgtttatgccctggaatcctggatgcaaccacatgcaattcattcaaccaatatagctagaaaaactaccttactcttcatacccaagattttctgccatgtcacaaagtgaatggacaggtgatatgaattaaaaatctagctaaaatgttgtcttgtgatccaatctctaggtccgtttggaggaaaagctcaataatttacagaatgggtatgatgtgctgattaagaaggaggtatatatttatttattctaatgatttctttgctcgtgtgggtagacataccagtcctgcctatatgcaggagttctgaattttgcagattaattttagttccaatttgtgtttttatgcctctatgaacaacaaattatgtcgtcttcactatgatacttcacagctaagtctcaccaagtatgtctggcatttcattcatggccacagttgtgtcctgtcacacttccaaacttgccacaagggtgggtaactaataattgtgaaaaaaagatgtggcttccacacttcttttgccaaagtgtggtcagaaacaaacatttctgatagtaagcacctctttcatttcacttgatactatagaacccaaagtgtctgtatttttctttttgttgttacattaacttccccctgatatttgaagtgtcttagcccctcatgtgggaactggaagtacgtcaggcttaaatcttgttataactgttaaacaccgctgtgctccttttgttgttatctattcgtggcttcatcctgtaaattttgttctctgacttcattcaggtagctttggataacaaagtcaggtccatagaggtcatcaatgatgccttaactcatcaggaggtaatgcatgaatcacttgttctgttacaatttttatttagtatttgcagcaaatgcatccaaagcccttcctatctgtttttggctgacatgttgctccttttcttcagacgtctcttaaagagagattaagtggactggaggagacaaataaagtactgcttgtacaggtatgaactacaaatccaactatttgtgtttttttttctttgtagttaatgtttgatatcccgttaagattcaagcaagcaaatgattagttaaatactaagattgataggttgttgtgtattatgtaatctgcaacatgtggccaaatatttgtcctctccagaaaggtgttcaatcatatgtaaagttaaaagtcatgatttattcgtgacgattttgaatatgtcggatttaaagctttggtgctttggttttcatttgcagcattagacatagttctgcttatatcatctgatattactatttaataacaaagtctggcaggtgaaggtgctggaggaagcttcaaacaatactgttgaggaaagccagaggttggtaaaaggttttgatgaactggcatcaagattaggagtctttgaagcaaagtctgctcttactgaagcctccgtgactaaaaaggtaaatgttatgcagaacattcctttttgtcacctgtgtccaatttggtagacgctatacactccagtggatctgcctggggagaaataccacttgatatcagtagtctcttctctcttgtgcataaaacacttgtccttccagattctagtgcataagatagagacatgataattgaggtctttgaaaataatgtgatggattaaacggatttgaccagcacagttctcaatgagcagactgttggttttggtaagaagtacgagtctccgcatgcagtgtgacagaatatcaaatgtctggaaaccgccagaattcatatatacttgtatacagcgtaattgttttctgcttgcagggtaatgaactgattgttgatagaagtgtaaacagttctgcagcaattacttctgtggataactatagtccaatcaacagcagtcctagcaacgcctatgttagtaatcatctagaagaagctccaatgcaacttccagaaacaacaatcaatgatgtttcttccgagggcctcattgacatgaatgcacatcaaaggtcaaagcaagattttgatgaaccaagaacaagcgaagaaattctgccagttgcattagatgatatacagattcatgaggaagacccacaaccaccggtagccgatgatgaggcagaggaggttccattttctgatgctccaatcgtcggtgctccattccggttgatttcattcgttgctaggtatgtcagtggtgctgatttggtgaaccagaagtaattctccattaatgccatcaagcagcttgagatctgtatttcttggaaagaggagtcttcctgttttgattctgctcacacagttatctcgctaagattgtgaggatgtatacgatggatgcactgaattcaacagagatatggaacctctgttcagttcttggtagtgtgctcgtgtcactaccagtttttcttcctcccctgtcaatttttcaggggcagcagaagctcttgttccccagttatagtgttatacacacaagaggccttcctgaccatgtggggtgtactgaccatatttattctacagaaactgaaaatttttggtattccaacagatgtttaatgcactgaacaatgaccatgcatcttgaagaaagttgaccatttggatttgatgtattgcattgattggatggttgctatacaatgttgttttgtcaaattggaaccttttggtgtccccgatttaatgtttgcccctggtattgctgatctctgcggtgccgcattgttgctccatttgtttgtcctagtgttggacctatggatgtcaactgttacttggctttctcgtttgcaatttttcatagcgaagacagacaaccgcaaaaccatgaacagaaaggaactaaactgccaatcacgttgtctcctctaccttgatttttctttccccatagaaaaagactccctagtgacaatttctaatgaacgcaagttaccaacaccggagcacagcatgtaaatacaggtcaagaagccagcaaatcaacttgcgcatcatgcaatgcttctacatagtgccagtgctgaaagcttctggctacattgaagaggccatcacgaccagccttaattctaaatgaattgctgcaacctgcaaacatacaaaccagtaaaccacacagcagctcgtcaggcattacgccgaaggaggattggattccctggcattttcgttggaggaatcgcggctctctgaagcagactgccggagctcctcgatcatcctgatcacctccgccatcgtcgggcgccgttcaggggatcgcgacgtgcacgccattgcgagctgaagcatctgcaccagctcgtcttctatgttcaggtacttcatcagctcaacgtcgaacacctcagcggtccactcctcccggaccacggaatgcacccaccttggtagatccacgacatcgtcctgtccttgcgactgaaggggtgcttttccagtcagcatctccatgaggagaacaccgaagctgtaaacatcggacttgtgagtgaatttcctggattcgaaggtctctggagcacggtaaccgacaacaacccgggatgtgctgatggggaagctcatcaaggcactcagcccgtagtctgagacgtaggggttgtggtcttggtcgaggagtacattggttgccttgatattgccatgggcgagcttggagccgccttctgcatgaatgtgtgctataccacgcgctgttccaagtataatcttcatcctggtattccagtctaacggggtcttctcggcaatacccttaatacctgttaatcagaagtttgtgagaaaaatgagaaataacttttggttgcgtgcttgcattgcattttgtgcttgtaaattagctttgatacatcatggattgttagatttctacctggaaaaattgatcaatatcagaaatcaaatgtaaagcatttagtagtgaaagacataagcataccgtgcaacatggctgaaaagctgccggtggcaacatactcatagacgacaagtttctcatcctttgagtagtagtaagcgcgaagaggcacaaggtttgcatgtttgcctaccctcccaatttgctccatttgctgctcaaattctttcttccctgccacgacgtcctttagcctcttaacgaccactatggtgccatcctcaagtatagctttgtaggcagtcccatagctccccttaccaaggacttcggcagaagctctcagtaaatcctccaagtcaaagttataactacatccatccaagaaaaccaatttgttcttctcggccatttggacaccgctactgacttgctctttgcgcttctcaatccttgcattatcagtgcctttaccattgttatccaatccatcatctttcttctccttcctcttagaaaagcacacgacaaatatcgcagcagctagcagaaatacagcaaagcccccaactgcagctgcaattatagagccagtacctactttcttcccacgatgtggcaatgctgatggtggtggtaatgaagattctggtgaggatgttggtgaaggaagagaacattcagctagaggtggcccgcacaatccagggttccccaagaatgaactgtttgagaatatttgaaggaagggaggaattgagccattcaactcattgttgctcagatttaactgtcttaagctcggaagtttgagatcagggataggtccagagagagaattttttgacaagttcagggtagataattgagtaagattttgcaaacttgcagggatttgtcctgcaaaggaattgtaggataggtcaatggtattaagggttggagagaaaaaagaaggcaaatctcctgacagttcattatcctgaagaaatatggactgcaaagaaggaagtgaggtgatatcagatgggatacttccaatcaaacgattagatctcaggcttaacacttggagggagacaagcctgccaagggtatttggaggaattgcaccaatcaggccagcagctggtaccctaagggcagatatgcgtgatcggtccggcgagcaagttacaccatgccatgagcacaaagaaatgtttacatcccaattgagtttgttcccacggtagactgcagaggcaaaagcaaggagcgcttgcttctcagaggcgatgtctgccacggccaatgaggtgaaaagaagtaacgacagtagaaccaaagaaccttcaaaaattttatagcccataagaggtgtctctgaatcaactggactaaatgaacaatatcagcatctgtttatatcagtaactaccagtcctgctgcaatgaaaatggaaaacgtcagtgctaaaatcatgaaaagtaacagtagaactgtaaacataactctaattgtgtcttttaactcataaaccctcaagagaatatagcatacgagcaatcacgacagatgtgtgtgtgctgagtccagaaggaagcacattccatgatcttcaaatgcagctatgcacttatgcagacaagcatgcctgtgtagtggaagcataaagctggcagtttgccccactagaggctcatgccaagaaaaagaccaaagcactttcaaaagaaaaaatgacccatcaaagcctaatgatttaagaaaactcttgtccaaattagtgcagtctgctttctttcataaaagaagctaaagaatgctagtaaaggtgttatcctgccaaataggtcagtgcgaatcattacaaaacatgtagggaaccctgcatgtttttcctctaggagggcctggcagccaatctctttactgagccttgtaactcaccaaagaggtgattctgagattctctatcagcacaaagcagtgtgtaaatcatgggaataaaactaccaatatctaatcaccacaagggacaagaattctacttccaaagaatggcgctagtttaatttcaactaaaatatgcgattaaaagtcaccgaaacaaagcaactaaaggagggttaatctgaaatgatagggtcgacgtgtaaaagacaaaaggcatcaataaagcagagaaagatgaggcaagaaggaaaaatagaaaaaaaaaacataaatatttcaatactagccacatagatgagcatatcacatcgtgcacgctgcactactttcttgaatggaacactaaagtatggcagtatgcttaccgagaactaaattcagtctagcacatcaacactagttgctaaggggtgttcagtttggtgcccacgattaccacacacaactttagcactgctatggtttcttaagtagtgtcagacactgcacgtttaggtcagccgtcagcgtaagtttcttcataggacagcatgcttaagctcgaaattcaagcagtcagagactaactgcggccttacacttttccattctctaaaaaatgataattgcagccttacacagctacacacagttttgagttaatcattgattgaaatcaatcccatcctcattagggataaaaatgtagcagccttaccactgcacaaggctctcaggacctccatagtgcaacaagtaaggcaatggccactataaagaaaggctgcctgatcagagaataccactagacaaaggtgaaaggaaaagcgaagcaaagaaaaggcaaacctgaaccactctaaacaaactgaaatgtgaactaggggaagctagggcgcactggcaaggacggagatgcttgcggggagatgagccggagtgattgcacatgccggtctttgcagcattgtttactgactacaagatcttggttggtgcccaattgtttaattcccacttaaagcgaccacattatttaattccggcgaacaatcgattactggcaagcccttccaaaaccaatgttaggtcatgattttgcaagagctcgcggttcacatctttctatccacctaaaagctcatcaaaaccagtgtcaccgtgcgtatggcgctattctacccaaatggagtataaaaccatggcactggcagtagactggtggtaccaatctaccaatactagatccactattttcagcagaaacgagaaatgtagaagctaacaaaaagatcaaacctaacatatacaagcctaatgctcttcctgtccttagggtttaagcaaaaaagaaaagtattttttcccctgagggattctactctcttccggtcttcactgcttccaaacagtagcgcgctgggagttcagttagaaataggacctactagactgaaagatcaacacaaaggcattacagcggcaatctaagagcatcacacgaagttgtgcagaaagatttgtgagctgttaccataatcgagttcagtaactgaagcctgaaggtctaaaatgcgcgaggcaacgccaagaatgccaaaattttcaggatcttcaagtaaccgggcggaaacgaactacacgcagatataatcagggcgcggctactaactaatccgaacaaagcggaacgcaagaacctcgcggagagaaaacaaacacaaacagagcaaaaaaaaacaaacaaacacatttttgacaggcgaaaagcctcaaaactcaaaaacacaaagtggcgcgagggtgggcgctgtacccgtacctgatccggtggtcggcgctgcgacgaactgatgattgattcagacggtagcaatgctgcggcggaggagtggaggcggagtggagtggaggatgggcagcagggagaggggaagcgtttaaaacgaggaaacggagggggggggagaaagagagagcccgcagtaaagccgttttgttgcgttcgcgtggcgtgggttcgggtgcagggtgcagcgcgctagagaggaggagagagaagcggcacgctcttctcgctgccgccgcggcgcccacttttattgcctgcggccactgatacgtgggtcccaccctactgcggggcccgctcgcctggtcaaaagcccggagtaaaagcgcaacaaacaaacagctgtgctgtaccagtattccacggtttccaccagtaaagcatggtgctcgatcggtgtggtagatattttggcttgtcacggtttaatttgttattggttcactgttacgttatatactctctctcttacactgatcacccgtcttatttaaaaaattttagaattattttttttacttactttattatccaaagtattttaagcgtaacttttcgttttttatatttgcacaattttttttaataagacgagtggtcgcatgcaaaaactcaaaatcccttatactatgggacagagggagtactagcatactgtagtatatcctcacgtcacagatttattttttttatcaattttgtcatactttatgacttacaatttgtccacaatacatttggggttatcataacttacctaatcttagttgtgttaaagtgtggtcgataatcaaacacatacataatctttagaggaggttaatcgctaggaaaaaatgattgaaaaatacataaaatgagatgagtcattattgtatgattaattaagtagtaattattttagacttaaaaaataaattaatgtaatgatttaaaacaacattactatagaatttttaaaaaaatagttactattttttttaaaatagttacaagacaaatattttttccctttctgtaactaacgctcccttagtatttacttatgatttgttataaaacttttaccaagattagttactattactgtatatctttgttcgtagtatgaatgtttgattcgtcggcaaagaaatgacggcaacaggtattcattcatatgtcgctgtggcctgtggcgagcactttcttttcgccgggcctgaataatgagtacactctcaagagatgttaatgctctatttcttactcgctaagattaccaatcatctgaaagcttcagtgaacaaggcaaagaaaggggagtgtgaatcagttcacaattttggaggcggcaggaagggatcaaaatcagatagtgccaccatggtccatcgaactttatatgctggggaggagctgtttggttgaatccgcagctcacatcacatcacaaaaaaatttccatgcttttttctcctctcctttgcttccctggtggcagatgccaccgttcttttgtcctcagtggcatctcaagctggagaccacaccagctgtcaagaactgggggattactgtagtttctgcatcttggaatcgcagttatataatgctgttaatcctgctatgttcaagtgtgtactatgtcctaccttgattctgtgattttggttcttcttggagattggaagttggatctgtccaaaaacttgcagggaggactgtccataggcagcgagacaaaacgctgcccaagaacaagaacttagcctaaaaataaaatgaaagaaaaagagaggaggaggaggaggaggagcaagaacagtattctatcgattatgcagaaaacgcagcaccggtgaagcagcagatactgattcagacaacagtattcatgcagtttggtgcttctgaatcatgccaagttgccaactgccaatatatgtacagtctttccagagggctagctagacactgctattttcgagtttcttcttgcatttgtctcatgtggggacagcaagaccacatcgtcatatataatcacttctatattaactgaattcatgaatgagggaagaagaataagcggaaacatgaattagcatgtgacatttctagttgagcccagggtttatgattccgacgaaatccaatcggatttcgcgaccatctgagatgaatggttgaactgggatgaatgaaagcttcgtatattccctaatcagcgtgtatgcatattgatgtataaaagttaatttatttgggacagagtgagtaaaatatttcgaggagggggcttgggaaataattttctttctcaatgtccaaatcgagttttcattgagcttttcttaatagtttaatttattatattattattctctatcatctgtatttgttaacaagccaaaacgaaaataactgtcatgggcctaacaccctcttgcactagtttgcaccacaaaagaataaaaaaacacttgtttttcacgtgcacacttttcaaactattaaaaggtatattctcttgtaaaaactttttacaggaaaattgttttcgaaaaatcgtattaatctatttttcaagtttaaaataattaatacttaactaattaataatatcttaatagctcatcttattttacgtatattttcaatcattttctttctcctccttccgaacactccgagtatgcaatttagatggatagagtcttttatgatagaattagattaggttagggaattcttcatctatacagtgagcgactctatatagttcagggtaagcattacactaagagtatcgatgtatccgtagcatgcatgtctctccaaaccggcacacccttgaggtacatggctattccattttgttccaaaatattcttgcttgcgacaataacttgcaaaattagaaaattgtaaagagagaatagaccaacatgagcaatttaggactgagccaccgtgccaactatacgagcttctattcacccttgcgcacgcacaccacattcacgcatttacgagtatgatctctctaacacacggttcgtatatataaataccattaacatattcttgatctcactaattatatatgaaaatgcatctacatgcacataatatttgtggaaatttagatttgaagtgaagttatggactcacgactccacctgatacccatgataatttccccctgcaattattttttttcttggttagcgatgatgattctaccaggggtatcattttctttaggcggtgtttgaattgtggttgtggaatgagaaggcactgatttggacggacctattcttatcgaacgactagtaatattctcgtgcattgcaatgggtccattccaccgggccataccagtgggaataagctgggtgtggatgtaatacacatgattttttttagcaaccaccttttttttttctgtttttctgttttttttccggcatgagtactacgtgtgtgtagccagattggtagttaggattggttttgtcatgcccttgatgaggtatacactaaatacaggggagggaggacgaacgactccacttttagtattataaataaatatagtaggatgtctcatcaactgtctatctggaggtctatctggagctggctaatgggcgattgatcgctcgatccccatccaccatgtacactcctctctccctccttcctccttccattcctctcttcctactacactataaatttaaaaaaaataaaaaaaacaaagtttgaaaaaatatataatttaaattcaaatttaaatttgaaacgggtatgtaaacttttgacttataaactttgggtctataaactaatatttgaatttaaattcaaaattgaatcgggtatataaacttttgacttataaactttgggtctatacactttaggtgtataaactttagatgtgtagaaatactatatatataaaaaatatttgaattcaaattcaaatttgaatcgggtatgtaaacttttgacttataaactttgggtctataaactttaggtgtataaactttatatgtatagaaatactatatataaaaaatatttgaattcaaattcaaatttgaatcgggtatataaacttttgacttataaactttgggtctataaattttaggtgtataaactttagatgtatagaaatactatatataaaaaatttgaatcggatatataaacttttgatttataaactttgggtctctaaactttaaatgtgtaaagttgaggtgtacaaactttaggtgcataaatttactaaaatagaaaagtaatgcggtgtcaaaaaggaaaccagatggagggagggggaatccgaatctgatcgctaggggcgatcgatcgccccttagcaatctcgctgtctatctagagtttggttgacagggcggctccattcatgcgaaaattctcaaacttttgaaagcccacctagcacttatttttctgaaatgccaaaactacggaatgtcatattgacgaataaatttaggtagtttatttagtcttcttaataatcatgaaaacacaaggttgaccaataaaagtgccaaagagaaactccctaacccaaaaggtaatttataatcaaattctataattcaagcgggattttcattattgggcctttaaggtccaagacctacgaacccgcaaaaaagagcccagaaaggaaaaaaaatatactttgactcccttaactatcgcccgagtttgattcttgtccttcaaccataaaaccgagtatatcgactccttcaaatatcaaaaccggtgcaaacaatgtccctcggtggttttagaggtggttttggctgacgcggcgggcttgaccgagtctttgtcctacgtggcgcttacgtggcactagaataaaaataaaaataaaaaaatatgtgagacccatatgttattcacacaaaaagtgtgcccactgacatgtgggacccacatgtgatcctctctctccttcccttcttcctaccccctctctcttccttatctctctcagaactcaagagcggtggcagatggggatgaggc

SEQ ID NO: 67353 - DNA, 29830 bp, Oryza sativa
agttatgaggaaggacaagattttggagaagaaccatgctgagtacatgaaagcagagagagatatactgactaaagttgatcatccttttgttgtacagctgaggtactcctttcaggtatgcatttatcatctctgtgtgttctttgttgtcaagctatcatgcatgttatatttttcagtcttgtcccaaattttaaacccagtatttacttggcagacaaaataccgactttaccttgtgttggacttcataaatgggggccatcttttcttccagctctaccaacagggtttgtttaggtaatttcattacattattttatgtttattcctatcgctttgcatgaacatttaattaagcaaccttttgtctgtcagggaggagcttgcacgcatctacactgctgaaatcgtgtctgctgtagcccatctccatgccaatggaattatgcacagagatctgaagcctgagaacatcttgttggatgctgatggacatgtaaggatcctttaatacatatttttcttcaccttctctgactttatctactgattggtatttgggaatttacggaatttttcattgtcttatttaggccatgctgactgattttggcctggcaaaggaatttgatgaaaacactagatcaaactcaatgtgtggtactgttgagtacatggctccagaaattgttcagggccgtggtcatgataaggctgctgactggtggagtgtgggaatccttttgtttgaaatgcttacaggaaaggttagttatttaagcacgatgtttctgcatagaagatgtgtttgcattacagatggtttgcttctatatatccttttgttcccatgctcactcttattatattctgcagcctccgtttgttggcggaaacagggacaaagttcagcagaagattgttaaggagaaaattaagcttccggcatatttatctagcgaagttcattctctgctaaaaggcgtaagttgtttgccaagttgctatgattcaccgcacccatatttttttgcagccttgtgctagtttctagagtcaacctgtttgatcttgggattgaatttttagtccatcttatgtttcagttactgcacaaagaagctggcaggaggctgggctgtggaccaggcgggagcaatgaaataaagaatcacaagtggttcaagtcagtaaactggaagaagctagactcccgacagattcagccaagcttccgcccaaatgttgctggcaaaacctgcatcgccaactttgacgagtgctggaccagcatgcccgtgctcgactctccagtggccagccctgtcgctgcagatagcaacttcgtgggattcagctatgtgaggccagcgcccttccttcagaggccgagtcctctaggctgaagacctccagttgagaccgaaatacatcttgccactgggtatgaagctgacaaaatttactgtttcgatgattattatgtaaaactacctatttatgttgttcggtttgtctgggaaaaccccagtatcttttcttcgttgaagatactagtaaaagatgaacgtggtacttgttgaaaccagacaaatttgtctattgccagatggaacagttgccctggcttctatgatcaacccctgccccctgggccctgggcccctggcacatttaggttttctcggccgttcacgtacatgtttccaaatccaaatcctgctgcatgttgcaacacaaatcctgttgagatgcaaatttaaagcataccgtttatgcatgttgaaatgtaaattcgaacagagagttgctaaatttccacgacatctaaaaagtatagtatcactagtaataagaaatggaccgccccaagtaataagctcacatggacagcagcatatggcccttggcggcataggccgagtcggagtctgagcgtttcatgtcagtatgtcacgccaacttcgactccgattcatccttgcctcgcgggcccagtctccatcacgctcagcaacggccacgcaatccgcctctaccctccatcacctctttgttccttcttacaacctccggcgatcgcagcagcagcagcagcaacacccctcctccgttcaacttgagggagaggctatggcggtgttcctccgttcaacttgagggagaggctatggcggtgttctacaggtacagaagcgaggtggataccttctccgtgcccgtgcagaagcctttcgtctccgtcgcgaagctcaagcgcctcatcacggccaccgtgcgccacggccatggacattcgcgcggcgggggccccaagaagagtgtcacgctgtacagcgacaacaccggcgaggagtacgcggacgaggccgagctgatccgggtccagatcaactagagttgactacaactctaccaggtggacagtgtcgaatctagaacaaaaatagaggggtgctatgtataaaacttacataaaattaagacagccaaatatacatccatgacgtattttgctaatcaaatcgtaaaattaacaaataaatagaaagagggtatcatataaaataaagtaactctagctcatcgtttattatttggaaaagtacttgttaaccttgcttctccgctttaatgtgcagttatatccactaaaatcaggcaaacaaattgaatttgatatgaatgatgtgccaatacactgaaaggtttccaaacctaatttaccaataaagaggctcacgtttacatactacaacagatggattaatgtccagtctagctggaatacgtcgtagaggccctgacaacaaagatgtaatgaggcactaaacaacaacgtttttatttctgaacctgaccgtgaaatgcacaaccatggagctggggctcaagccccaagaagcgtttcttaaccttgcttctccgctttaatgtgcagttatatccactaaaatctggcaaacaaattgaatttgataggattgatgtgccaatacactgaaaggtttccaaatctaatttaccaataaagaggcttttacatactacaacagatggattaatgtccagtctagctggaatacgtcgtagaggccctgacaacaaagatgtaatgaggcagtagacaacaacgcttttattcctgaacctgaccgcgaaatgcacaaccgtggagctggggctcgagccccaagaagccccaacggtggatacgccaatgcaggtggagttgtgatgatccattccattctgtatacttcattgggattaagccaatttaatttgtactacttaaaaaccagtaactaaccatgcaataaataaacttgcatcaacaatgtcacaaaataacccgccacttgttgcttcaaaacattgacattattggtctagtaatttaaattatctatctatgatttgtattcataggtcaatacaaagaggcgcaacaagctactttatgataggatgagagatattgtctttgtcaaattgaactcccaattaataaacaagagagacaacaaagatagggatcctttagagaaggaagtcaatgatgctgtgtctaatgatgagaatgagttcattaatggtattgtacctttttctaatgagcttgctgaagatgatccacaagatggagcatcacagggagaatcatcataaggtcaaggaaaaaggaagaggcttgtgcgccttagaaagaagaaaatcaagagcgtgcactctttgatgaatgatgttacaatgcagcttggaccttcatcatctgactcagaagatggtgatggcaatggcgctggagacgtttcagtgggatccttcgattctgataagtctcatggtgtctctgaatctgattagtggaatgcaatattctaatctacaaacttgttgttcttattttgttaattaatggtcatgttcttgacttcttatgatgaactatttattatttatgtcaagaactcaagtggcatgtttactatgaactatgaaccgttaaatttataagtatgaactcaagtgccatgtatctgtatgatttaatatgaactatgaaagtatgagttaggaactatgaactccatgtatgaagtatgaattggtgataagctttgaattggtgatgaacttaacgtgcaatgaaataagtgatatgtcaatttttagctcaaattctattaaatttttattgttttctcatattttagaaaaaagctaaatgttttagctgtagctatagccggttatagctgctcttagctattggagagcacaaccgctaagagccttagccagagatttagaatattgctagcgactagtgcggtggcagggaggaaaaaggaaaactgattagggttttgtggactttgcacaaatctcaaattaatcaatggtctgaaatttataagatactaggaggggttttctgtaaactgaggagtagacagtaaaaaaaaaaaaccatatagcattgccaccggccacccattgccttttgttcccctttcgtgattgcccggtcgcggcctcgccgctaaccctaaccgatcgaattccttccgaaaaaatccagccatggcgccggcggcgcaagagccttgggccattctggccgcaatccctaacgtggtggggtacaaggaggcgaagcgcatcttcccgccgggcaccgacatctccgtcgcccgcaaggaggtcccgcgagcctccgtcctgaccgtgccgcgccacatctccctcccggcctgcctcggactctacccctatgtcgtcgccgccgaccgctctggccttctcctcctcggcacgcatcctgtcacctccgcctccgccatggtctcctaccacatctgtgatgcgcacaccggtgaggtagtctccctccgcgactgcaaaccaatgcgccccatgaccttctacggcgccgccaacgtcggtctcatcatcaaggacgacggctgtatggtcgctgagctccagccgggatgcaagggcacaagcaccggtggtgccactctgctcagctacaaggtgggggagtgctgcaagtggcgcgagagggagcttacctgctcgcccccactcccgctggactggtacccggagggcgtcgtctcccacggcgggatgctctggtgggtggacctctcctacggcctcctcgcgtgcgatcccttcgccgaggagccgaacctgatccacgtcccgctcccacaagttcccgacgagcttcctgttgatgaccaggttaaccgcggtgcccaccgctgcgtgaaggtgagcggaggaaggctgatgtacgtgcagatacacggcaatcctgttgtgccggtggtcagcacatggttgctcgacgaatcgacctgctcgcccggggagtgggagtggaacccccagctcagcgcgcccttggccgagctctggattgaccagagctatgtggacaccatgctgccgttgaccattcctgcccttgcgctcccccaccccacagatcctaacagggtatatttcttcctcaaatcttgcatcttcgcagccgacctacggttgaggaagctggtgtcattcaatagttttgagatgctcgacccaccgtgtgaactttggatgaagcgctcctcccacttggtccacgcatggcagtatgatccttcaagcagtcgtatgtatcttttgtctctgcccttctctttatcttgatgtgttcagatgatagctcatatttcgatgttcctgccaattgtcattagcatggataaatcaatctgatccaccgcttatatcaaaactctactcagaccactcagaccctgtataaaatatccagtacccttgaactaaaacaagaccataaatcctatcctggtttctttataattttagcttgaagatccacaacttccggaacaccgatatgagctagatagtgtgataattgtgtgtttatacttgtttaattctgaaccaatgctcgctgctatataccttattcctgtacatattcctgtatagtttgtactgctccatttgatggaatactgctagtataactttagtgattgcaagagtgacgtaggtccggaatagttcttccatattctctagaaatgttccgttgcctcttacaaattaaatgatacagggaactgccaaaccgagtgatgggatgttttgcccttgaatggaatgggtgtaaccaccttgtgacactgggaatgtatagatgttacatcttttacagttgtgcttatgaggcacacggaccacttggttttcatggggaattattgatatttttaggtgtattgtttctctgcagaatatttagccagtttatagtgcttataaatcttagttgaagtgtcattctgttgctctcctcagcttacatataaccactgtaatttctttttttaggttctgactttgtattggcatgcttgaggcaagacaaggcaattgcttctaagagcaggtgaccctatacttcactttaacttccaattagattttcttgcatatccttaactttaacttccaagaagtagattttctttcaatggcctaatacaatctttcttttgattcagcttctctggtataattcctgtcactcgtagaactggtatgtactatataatctatgcaattcttcaattgcaattattggatggggtgtttcttttgtccaggttgtagaaaagtgagcaaatttcaaataacgccagacatagtgttttgtcaaacgtactctgtaaaatttgattgaatacgtccttatggtgtgagtatgttaactgtggtgccatgtttttttcccttcggtccagagtttttgtactgaagagctgatattatctgttgtattttcagctaaaagtttgaagagagtttgggattctgtaaccaggcagcagcaaaagcaggagcagcagctgcagaagcaagctatgtaaggtgcagaatctctgaagaaagcagaatcagccagcctcattaagtatgaaggaagggtagagtatattattttgtgcatgatttgccagcctcattaaccaggatttatgaaaacgatctgatacagcatgagcttacttgtgagttcttgttctgtgccttttcttaggcctatttataagggagacgcttcatgtacagcttgagtacaaacgtgaatcttgactgttggatgcatttatgaggattttaaccattccgatcttgagttgtcccaaataagactttcaatagacagtcttcaatgttaaatagaaacatgttaattagttctacaaccataccatgcatgcatgtgtacgtgacagtcttcaatgcttggacagtactatggctgaatatttgtaactgatgtaacggttaggatgtatcaaaataagatagcttgaaaaaagtccatacttttgttctagaggccaaagaattaccatgttaattgaaaaactaatttcaagtccatacttttgttctagaggccaaagaattaccatgttaattgaaaaaatatattatgaagatggctaaaaaagtgctatcttttatttcggaggcctaaaattaccgtgttaatgaaaaaaaaaactacaccattagataaacatatattttaactgttaaaattaatttataagtataacaaacagcaaattaaatagacaaatactactcaaagtttggaaattactgtataactaaacaataatcatgttcagactctcaggtcccaaccggacttgggctaaacacattctttctagaggcaccacgtttaccgtggggactagaaatacccacattaatcgaaaaaaagaaaaggagagtccaacttgaaatacaatttaataataactgaaattaagaattaaaaataatcactatttaaagaagagtccatctaagaacccaatacgaggttaattaatattcggattaaaaaataaaataaaatccgaaattagcaaaagaagaagagaagagctcgagtagaaatacaatttaaaaataactaaaattccaaattaaaattaagtaatattgaaagaagagcccatataaaaacctaatacgagattaattaaaatgcggaataaaaaatcgaaataaaaaaaagaagagttcaagtaggaatataatgtaaaattaactgaaattcggaattaaatataagtaatactaaaataagagtacatataataacccaaaacgagattaattaaaattcagaatgaaaaataaaataacatatgaaattggataaattgaaaagagagttcaagtaggaatacgatttttaaacaactgaaattgaaaataaaaataaaaatattaaaagaacacattatgatattagttaaaatttgaaatagaaaataaaaaaaatcttaaattagaacaagagaaataagatttcaactagggatacaacttataaataactaaaattggtgataaaaaataaagactattgaacgaatagaccataaacacatgatgagattaattaattaatagtcatataaaggtgtaaagtggtggcggttgacgaggcatctaaaactattaataaaacaccaaatagaattctaataacaattaaattaaagggaaggagaacgaacatgtcatgaaataaccggtcaaggaggttggcaagacttctagaaagtaaaaaaaataaacccaattgataatcatatttaatttttaaaatctcaatgatagtaaaaaggagaggcagcgggcgggtcgtacaggagtaaaatagcatagccgctaatggttggtggtacttttagaaagtataaaatgaattccaacgatagttatgttcgacttttagaatctaaataacaataaagagtaggcggcggataggtcatagaggagtatagtggcagcgtttgacatgatttctaaaaattataaaaaatgaaatccaatgagacaacaaattctaaaaactataaggttcgggcttctaaaagtaaaaaaaaaaactccaatgataattatatttgatttttaaaatctcaatgacaataaagaagggagacaatggatgagccgtaaaggagtacagtgacaaagccgctgacgttttgcggaacttctagaaagtaaaaaatgaacccaaatgattattatgtttgattttgaaaataccaatgaaataaatagaataggtagtgacgggcaacatttgacgggatttctagaaattataaaaacgaaccccaatgggacattgaactctaaaaactatggatccaatttttaaaggttccaaggaaataaagaaagatatgacagaagtaagggatatcaattgatgtgacttttaaaaattataaaattagaaacacgaggatgataaggtttggtctttcaaagtcttaagacaacgaggtaactatttaataaattttaagtaaaatattatatttaaaaaatataattttgtattgatgctagccgcgcaattgcgcgggccacccagctagttatattattaaaacagctttgaaaggagatatcacgttcgctgtggaggctaacaattcaaaaatagctgaaattcggaattaaaaataagcaatattaaaagaagagtccatataaaaacccaatacgagattaatcaaaatttggaataaaaataaaataaaattcgaaattagaaaataaaaggagagtccaagtaggaatataatttaaaaataactgaaattcggaattgaaaataaggaatattgagagaagagtccatataaaaatccaatacgagattagttaatattcggaataaaaaaataaaaataaaatctgaaattagcaaaaagaaaaagaagagttcaagtaggaatacaatttaaaattaactgaaattcagaattaaaaataagtaatatttaaagaagaatcatataagagcccgatacgagattaaataaatttcagaataaaaaaataaaataatatccaaaattagaaaaaaaataaaagagagttaagtaggaatacaattttgaaacaactgaaattgaaaaataaaaatattaaaagaacactatacggtattaattaaaatttgaaaaaaaataaattatgaaactagaaaaagaaaaaaaagattcaattaggaatacaatttataaataactaaaattggtgatagaaaataaagactatttaaagaaaagaccatctaaaacacatgacgagataaattaagtaacatgcatgtaaaggagtagagtggtggcggttgatactacatataaaaactatctataaaacacaaaatacaatcctaatgacgattaaaaggagtgacgacaggcaaacaggtaaggcggttgtcgggacttctagaaagtaaaaatataaaccccattgataattatattcgatttttaaaatctcaatgacaataaaagggagaagcagcgggtggggtgtatatgagtatagttgtagagccgccaacggttggcaggacttctagaaaataaaaaatgaattccaaaagatagttatgttcgatttttagaatcccaatgacaataaagagtaggcggcggatgagccgtagaggagtatagtggcctcgtttgacgggacttctaaaaattataaagaatgaaacccaacaaaacaataaactccaaaaactacatggtccaatttttaaaggttcggaaattctaaaatgtaaaaaaaaaccccaataataatcatgttcgattttaaaatctcatgacaataaagaagagaggcagcgggcgagtcaaagaggagtacaatggcaaagccactgacggtttggcgggacttatggaaagtaaaaaatgaacccgaatgataattatgttcgatttttaaaatcccaatgacaataaaaagaaaagacaatggatgggtcgtataggagtataatggcagcgtttgatgggacttctagaaattataaaaagaaacccaacaagacaataaactctaaaaactataagatctaatttttaaaggttccaaggtgaatgaatagaaatagtagtagatcgagcaagcaaataaacaaggagatgacagaagtaagaggtatcaactggtgtaactcttaaaaactatataattatgtaactcttaaaaactatataattagaaacacggggatgataagatttggtctttcaaagtcgtaagacaatgagaaagttatgtaataaattttaagtaaatcatttagaaaagaccatctaaaacacatgacgagataaattaagtaacatgcatgtaaaggagtagagtggtggcggttgatactacatataaaaactatctataaaacacaaaatacaatcctaatgacgattaaaaggagtgacgacaggcaaacaggtaaggcggttgtcgggacttctagaaagtaaaaatataaaccccattgataattatattcgatttttaaaatctcaatgacaataaaagggagaagcagcgggtggggtgtatatgagtatagttgtagagccgccaacggttggcaggacttctagaaaataaaaaatgaattccaaaagatagtttggcgggacttctaaaaattataaagaatgaaacccaacaaaacaataaactccaaaaactacatggtccaatttttaaaggttcggaaattctaaaatgtaaaaaaaacccccaataataatcatgttcgattttaaaatctcatgacaataaagaagagaggcagcgggcgagtcaaagaggagtacaatggcaaagccgctgacggtttggcgggacttatggaaagtaaaaaatgaacccgaatgataattatgttcgatttttaaaatcccaatgacaataaaaagaaaagacaatggatgggccgtataggagtataatggcagcgtttgacgggacttctagaaattataaaaagaaacccaacaagacaataaactctaaaaactataagatctaattttaaaaggttccaaggtgaatgaatagaaatagtagtagatcgagcaagcaaataaacaaggagatgacagaagtaagatgtatcaactggtgtaactcttaaaaactatataattagaaacacggggatgataagatttggtctttcaaagtcgtaagacaatgaaaaagttatgtaataaattttaagtaaatcatttagaaaaatatatgattttgtttaggtgctagccgcgcaatttggcgggccacccagctagtttttattttaataataagatctaggagtataatgtttatactccactaactcaactggtaataaagaccacgtcgcatagaaatcacaatatactacctccattttttatatatgacgttttcaactttttcacataacgtttaatcatttttattacgtaaatgtatcagttttttctaggcatgcaacctaataaaagtctttacttataagtgcttatgattttttttttgtgaattttgtgttttgaattttgtctcgagaccttcatgttcttcctcattcgctgacacgtgggacccatggggactactgtcaccgccacagcttctgctttttcgcgcgcaccgcgatagcgacagccactttggcttggctttgcgcgaggaagcagcgcagcgatcccgtcaccgtgacctcatcctcccccgatcacaacacaaacccaactacaccaagagcttggggattgggggagtcagggggaaaaccctactccgtctcgccaccccacacccaaggccggcgactccttcggtatgccaaactccaccggtagtttctcctttctttctctgtgcacctgtgatgtcgtcgtcttgtccgtgcaggctccatagcgggtaagaaagggtgcaccaagatcgccggcggagatcgtcgccttggtcttgacgaggccagtgagccctttctcccttcctgttcttgagttggcgcagatccgatccatgccctgactctctctcctctttcgcaggctgccgtgaccccaggcgaccggaacgtgaggagccggaccagggacaccgagagagaagcccgccgtggagacgactgccaagttcttcgcctgctccatatgtcgacatcccctccctcggtgagtatccagccaacctgcccaacgtagggtattagtgtccggcttcgtgcgttgctccaaggggctttgtgtgcgcacgcgttcacggcgtggtgatctgttcacgccgccgtcacggtcgataactcgatatctccttcgttcgccgtagagccctcgtgcctgtctccccacgccgcttgttgtcgccgtgacttgctgtgccgcgtcgtaatcgcttgtttagcacttagcagagcatcaggttctggtgccactccaccgcgagtttggggaccggtttcccttttctgatgacttcgccgggcgagattacgacgtttgggtagagtacgtacgtggcgctgccgggcgagattacaggcgagtcgccgccatcctgcggagggggattggctgctcaacgtactacacgattgattgatccatccccatttcgctcaacctactaccgattgattgatccacccccatttcacttcattgcaggacatgtcggagatggtcactgtgcaatttctggatctgagaattcatcgcatgcccgccaacgacgtcctacaacttcgtcgccgtcttcctcctctggagttgaactgcgtccaatccgtggaccaattcaaaagattccaggcgtttgtaagaaaaaatgaggagaaggagaaaagggatgaagaagaggccgagctcaacacttccctaccgatctttcttctaccgttgattcttgctaactgattaactttgctatgtgcgtgtgtttataatgtgacgaattgacactgttcttgtatccagttggcaattgtcacgagtcaaacagatctagcgcgcatatgcgctacaagaggtgaagaactggatgagcttggtatagtggaggagtacgacgacgacgacgacgacgacgacgacgacgacggcgacgagcactatgtgtatggaggcttggatatgttcgagccagccaccaccgatgaagaggacgccaacgcgcaggtggatgctgatgatctttactacctgggggtcagtgacgacgagaatgaggaagtgggaagcgacggcgggactgatgacgacggcggtgatgatgctggaggcgacggcggacgggctggacccctcaggtgggacaacctatgggacgacgacccaccacagtgagtcagtgacggcgtgatgccctgatacaccgatcgaaatcctatcttatttattgcggagtagcagaattgacgaacaaacctagagcttatttatttccttacgactgacttgtgcaaacattcagcatgtcttgtgcaagtcatgttttaaattgcatctggatgacaatgagctatggttaatgcagctataatttcctccaactgtcactgctctttgcctgatgattttctagagacaagaggcagaagatctcgcaaattctgatagtgcataattaattgtttctagatatgatctgtatatataagtgcacttacagtatgtgagactgattgggtactctagaccatttttactggaatcacaagctcatgcatgcattcagcgcatcgaagcccatagcattctacatctacagcagtaaaagggactttatttttgtccctgactactgatgaacagatggttctacacttctactaagtttcatactctccgaaacaatggtattatacatgtattgcaagaatggctctgagctttcactgcagcggaagactgtctactttactgaactgtcagctcttggcttccttctccagcccatgcttaagagcaggtataatatacatttcgagaaaataaaataggagagaggagttagtacggagtagttgactatactattaaacttgcactaaatacattgagcatctagcacatcctcttccttgggaacatcagcaagcaaattcaaattgttggccttcttggtgttcgaggaaaccgtcggtcctctcgcgaagatcgtcgaattgacccgaaagaagccgtgtcacagggtggtgggtcttcgtcggactccggtgcgactgcgacgtcgagctatcgtcacggactctcacggtggtcaacagttcaacaccgcacagctcaagtgggacgcccctcttacggtcaccgcggcgtgcacgcggggagggagccgcccggagccagaaattaaccgtgtagattcaattactagtttactactgctccatccgtctcctaatatgaggaattttgacatttgatttgtactgtttaaccattcgtcttattaaaaaaaatttagaaattatcatttttttcctactttattatccaaagtgcattaagccacaactttttattttttatatttgtataaatttttgaccattcgtcttattccaactttttattcgtcttattttttaaaaaatttatatataaaaatcaagattattgggtcagccgaccccacagtttgtacatacatccgacactggagctgtcggccgggtacgtatgccacacaggtgccgcgtcccagggcacttcatcgagcactgccctaccaacgggcaacggcgacccaagatttgacatctggagggtggctccagctccagcgtcctcatcggcgccgctgcgtggggggaacctgacggcgtcatcccggcggagctctactgcaagatttgccggaacgtgatgaccgacgcgatggtgacgagcaagtgcttcttcagaaattgccgattaagagctacttggagattttcttttcctctcatttgcgtgttgtcatgtagtgtgtgtataagatcaagtagcgtgctatgttgtaatgtagaagatgaactacttcagatctcttttcatcatgtatatactgtacctatgtaatacagtacgtattattaattggaatgattttgtcatcctgtatacactgtatacactctcttgtcatcttgtgattctctctgtctctctctacggagtaatatgttaattggaatgatttttttccaccaaaaatctgaaatcttttgttcctgtaagcgtgactcttccccgtacattttgacgtacgatctcggaacaattgccgtggcgcgggcgcgcgccaacgacgatggcgaattggcgatccaacggcgtcccgttcggcctgacacatcatgctaaccattctacgacggcgcaatgcatgacggctctgcccacccgatgccttccccggcgtgcaacatgccagccagcgccaccggccggagcgcactgggcgattccgctccggcgggacagacagaccagaccatggtcgagcctccacgacgacgaggagctgatccggttcacaacgtataaacaagacacaagaatggcaccttacgtgttccgtgtaaccctcaccattgtcagctgatccaaaaatcatacaggaaatacacattaaaactcgtaataattttcaaagcctccaccgattcgcgactcgacaagtaaacgccgacgctcccatcgcgatgcgacggtggtagtagttacaaaagaggcgaatgcgccgcgtacgcgcgcgcgtctcacgatcgagaaggaagaggcggtggccggttgccggagcaggtccagctcggctcatcactcacctcacctgccgcggagcagggccttctcggcggtgtccatctcctcgaggatgcgcgcgcggcggtaggggtggagctatagcgaaacagaggatggtgccacttgcttaatttactctactttagattgagtataagctaatacagatgtctaaatttgtattgagggggtgcatacatgatgaaaatagatgaggtatagctaaaaaattttcttcactgggttcctaggcacctccctaatatatactagctccacccctggcaacacttgttggggatgggagttgtggggccgaagctgatgtagtgtcccgacacacgacacggtgttgagcgcggagtacatctccctgaaggacagccgacccagtaaactgaaagaagctagactcccgacagattcggtgcctgtttgggggagcttcttctagaatctccagttgctagaaagctcccccaaacagtccagctttttacccatattctgagaatctgtagttatataatcttaaaaataaattagaagccaaaagctgggtttctcagcttctccagattctcagcagctgcttctcagaatcttaagcttcccaaacaggtcctcagccaagtttccgccaaatgttgctggcaaaacctgcatcgccaattttgacgagtgctggaccagcatgcccgtgctcgactctccagtggccagccctgtcgctgcagatagcaacttcgtgggattcagctatgtgaggccagcgcccttccttcagaggccgagtcctctaggctgaagacctccagttgagaccgaaatacatcttgccactgggtatgaagctgacaaaatttactgtttcgatgattattatgtaaaactacctatttatgttgttcggtttgtctgggaaaaccccagtatcttttcttcgttgaagatactagtaaaagatgaacgtggtacttgttgaaaccagacaaatttgtctattgccagatggaacagttaccctggcttctatgatcaacccctgccccttggcacatttaggttttcgggccgttcacatacatgtttccaaatctaagggcttgtttggattgtagcttaaaaaatgatatggttaaaaatagcatcaaagtgaacatgtccaaattcttctgcatgttgtaacacaaatcctgttgagatgcaaattcaaagcataccgtttatgcatgttgaaatgtaaattcgaacagagagttgctaaatttccacgatgtctataaagtatagtagcactagtaataagaaacggaccgccccaagtaataagctcacatggacagcagcgtataggccgagtcggagtctgagcgttacatgccacgcaccaactccgactccgactccgattcatccttgcctccgcgggcgatataagcgacgccacgccacgccatcctcccagtctccatcacgctcagcaacggcacgcaatccgcctctaccctccatcaccctcttcattccttcttacaacctccggcgatcgcagcagcagcagcaatagcacccctcctccgttcaacttgagggagaggctatggcggtgttctacaggtacagaagcagggtggacaccttctccgtgcccgtgccggagccttttgtctccgtcggggagctcaagcgcctcatcacggccaccgcgcgccacggccatggacgttcgcgcggccggggcccagggacagcgtcgcgctgtgcagcgacaagactggcgaggagtacgcggacgaggacgagctgatccctagcggctgcacggtcgtcgtgcggcgccgagtctccgggcctcctgcagagacgatcgtcgagttgacagtaaagaagccaatgtcggagggcggtggttcttcgtcggactctggcgcgccgtcgacgggagctgaagtggacgacgaggagaaagctatcagctccgtgatcgacgccgcacagctcaagtgggaggccccgacgtcacaaggaggcctgcatcgggggagtctgacggcgtcatcccggcggagctctactgcaagatttgccggaacgtgatggccgacgcggtggtgacgagcaagtgctgcttcgacagcttctgcgacgggtgcatcagggaccacatcgcctccaagtccaagtgcgcgtgcggggcgcaggcgcgcgccgacgacctgatccccaacacgacgctccgcaccaccatcgccaacctgctcgccaccaccaccggcgcggcagcaagcgcctcaagtggaaccgacaagacgaggagctccgccggcagcaacgcggcacatccggcggcgccgctgagccccgcagcttcgcaggcgagccgcagcagcaacgtgagctcagagaaggccgagcacagcgacggcggcgcgtccacgtcgaagaagatcgccacgatctcaggtgccctcggcccaagaaaggcgcaggagacggtggctggcgaccactctgcagaatccggagctcgcgccgtccatggcggcgatcactacggcgtcccgttctgcccggcgaccggctacgtcgaccccttcttcttcggcggcatgccattcggagccgatccttacatgtactacggcggcgtgccttacggctgcggtggtgcacccaacggctactacggcggcgaggagctccgtgacaggaagagggcgcgcgtctctcccggaaccggatgttggtgatcggcttcggagaggatcagaagttgccgattaaaagccatttggagattttccttttcgtctcatttttgtgttgatatatagtgtgcataagatcaaagtgaaatgctagagatgaacaaattcagctctcttgtctctctgtattgtacggctgtacccatgtataataatgttattaattggaatggttttccccaaaaaaaaaaatctgaaatcttttgtcttgtgatcctctactaacatgttaattggtattatatattttttcactcaaaacttgaaatcttttgtccctgcgtgagcgtgactttctcgctcaaacacaagacatgcgcgcaaggtgtttgattctgctaacgacgggcattttgacgtacgatctcggaacaattgccggggcgcgcgccgacgaagatagcgaattggcgatccagcggcgtcccatctcgttcggcctgacacaccattgcttaaccagtctacgacggcgcaatgcatgacggctcgccccaccggatgcctcccccggcgtggcgcgtgcaacatgccaaccagcgccaccggccggagcgcatcgggcgattccacgccggcggagctccggttcacgacgtataaacgagacacaagaattaatggaaactctagggagttgcatgtccccaagccaaccgtgtaatcctcaccatgtcagctgaaccaaaaatcatacagaaaaaaaaaatacacatacaactcagtagtaataatttcaaagcctccaccgattcgattccactcgacaagagcaaagccgacgcccggccccatcgcgacgcgacggtagtatagtagttacaaaaagtgaatgtgccgcgtacgcacgcgcgtgcgtgcgtctcacacgagaaagatcggtggccgtaagcactcggctcaatcaatcatcactcacctcaccggccgcggagcagggccttctcggcggtgtccatctcctcgaggatgcgggcgcggcgcttgttggggatgggggccgtggggccgaagctgatgtagtggcccgacacggcgttgagcgcggagtacatctccctgaaggacgggcgggccagcagcgacttctccctggcgtacttggccacccacgagttggacagctcgcggagctccgccaccgcgtccgccacaccggggtccgccctgtccatgttgatcgtcgaccgcaccttcccgatcacgtccttcgtctcgctcacgtactcgtcgtcagacgccgcccgcgccgctcctccgcacggccacagcgccaccgccgccgccgccaccaccaactcgcgcttgttggcttgaagcgcgcgttgaggcggcgttggctttacggcgatggcggcagtggcagcggtagccggggccgtgaggacggccggcacgggggacgacgctggcctcatctcgttcgtgtcctacgcgagctcgcggtgtgaaagggaaagggggaaaagggatagcgcgcgggtttgtaagataggcttgggttgggttgggaaggaggcccgaaggccggaaaaaggtgacacgtcggcttatccccttatcccgactcgtcaccatgcacggttatgtatgggctcgcgggatttccgatgataggccgcccatggtgttcggcaactacacgttgatggttaccggaactcgcaaatgaacatcagccctagatcctaatgatctagcaaagtgacagggtgaataagcgaaaaggagacgggattggccgcaaacattgatcctcatggtctcggataaaactgaaattcacagcagagttggaagcagagttacggtcacaaatacacaaaacggtgtagacacagtgaaaactggacaataattgttgtaaatcggcaaattaggtttttgtagcgatgattggggagtgtatccgaggctctgagcagggtggacgtttaacttaggttccagccttccgacgaccaacttgggcaacgaatccagccttgataggagcaacagatcttgaagaaccacactgcggagggtaaacaaaaccagcagtcaatatttggcttgacgaagcaataacgagaaatggcatgatttggatgacaataatacatcaatccactggcacctaaacaagggtcacaacttgtactaacgggcgccaacaaaaaaaactctcgatatattaagaaaaatccaccagaaagccaagtgaactacatctttttatcctcagatgttgcaattgtttctcacaggttagtcaaacaatgtaggcaataaattttgcaactcatcataggttaaaaaaaaggcaatgaattgccctcttcttttctaaagtaataaaagataaaccaaccagcagaaaatcaagtaaaggggtaactttttatcctcagatgttgcaaattttctcacaggttagtcaaacaatgtaggcaataaatttcacaactcatcataggtaaagaaaaacaatgaattgcactcatattttctagaagaaaaaaaaaaagaaaaaacaaccagcagaaaatcaagtaaaaggagtaactttttatcctcagatgttgcaaattttctcacaggtttaatcaaacaatgcaggcaataaatttcgcaactcatcataggtaaagaaagacaatgaattacattctttattctagaagaacaaaaagaaaaaccaatgacagtgctttatgcctcagaggttgcaaatattatcatgacaacatttgtcagacaatgtaggcaaaagatattgcaactcatcataagcagagagtcaggatttacaaaaacaaataaaatgactagttggcaacaatacaagttagttaattaggacgtatgagtgctgatgcaatgcagcaagaaaaattgtgatagcatctcaagcctcagctacttgcaattaatatcacaaagatacttgtcaaacaatgtaggcaataatcttgcaagtcatcataggcatcattggtatcaaatacatatgatatgcaaaaatagattattattattacagcaatgcaagacaagaagctgaattgactcagctctcgcaactttagttacttgcaaacaatgtaggcaatttcataggaaatgtttgatgatagggaccttgcaaaaaaaaagagaccaaggtaatgctctcaagagcaaatccaggtatggtttgcagtagaccacaaatgcacaaacaaactcttcggactaatataactagagaaccatgtaaagctgtacaaagcaggggggcatgtttgttgcagtattaaagatgcctttagataagctctctctgtatggaaattaactacatttgacacgactggacatgcaaatatatattgaacagcttacctgttcgcaacgaaggaagaacaacctattctccttagaaaggatggtatcaggactcttgcacccattgcatatgacatactcatctgaaaggagtgaaattaaaaaaggatgtaagtttagcacaacaagactttaatgacaatcccacacataggacctcataaaaggaacaagagaataaacgatccagccatatatatagtacccctccaaatcttcctaactctagaccttactgcattaaaaaaataatatacatgggaggtggaaaaataaatagggcccaaggcattaaagaatgtatagtaaagtggttaacagcccaataactcctcctagataactgtatggatacttcaatttcaactggtaaggcttctctgacatctttgtttttttaaaaaaaaccaacatttatctatttctcttaacagattagtaaaccctcttttgaagacagataaggaaagcttcaccataattggtaagattcctttaatttcccagtacaaaacaatgaattggccctataagtctatttaacagaagctaatgaattctggatatcacagctgcaagtttgtttatagttcagcagtaactttaaagagtatgagcaagattcatgtgacattaaggaaacttactgatatatctcctaagtatggcttcaaagtttttaggagcaaatcttccttttataaccaatctttgttgcccatcaagggatccacttgttcccatctcagcaagtaaaaacatcatcacatgttcaggttgcctatgcattctggaagtgtaaacgatgatttcagttagctcatggtaatttatcttctctgaaataaaagcaggcctagagcatatggtatggagtggtaaaaaagtgagatcatacgttttgcacaaatccatgaagttcacaaaaactgtcttctttgtgccttccctaagaacttgaggaggcctcataacagttcttcgtctatcaccagcaagatcaggattattctcacgcaggatattaaatactctgccaagcagctgtcaccaaatagattgaaagggttcattaacagaaacacaattgaatactagttgaagctgagctgagcactacatgagatactaataccatatcaatagcaacaaaaacataagaagatcaaaataaaaaaaaatacttaaaagggagcaatgcttctcctcaatagacaatgaaccttccaccattactactccctccgattccataatttttgacattttggacaatgacacggtctccaaaatacatctttgactatatttttctattataacatatacaataaaaagatacacttttacttttattatagtattttgtaagacaaatctatatgctgttctagtacctttaaactaaatatttcaaagttattgatagttaaagttataaaagtttgacctcaaccttgtcgaaaacgtcaagaattatggaaccggagggagtttaacttaaaaatataattgcaggtgacataatatgaaaactccacagctttctattttgatatgtatatcttatatggaatttacaagtcatgatctgtcaagaacatgacaaggatatagaatcacaaaaatttgaacaggcaaggagtattaacctcttcatatttataatctctgtcagttccttcccaagggtatcgagttgcacctccaagcacaatcccttctccttcttcatcctctccgatttgatcatctgaacaatatatgatcagacaaagcaaaacaacgcaaccagggcaaatatgagcaagccacaattacctatagcatcttcaccatctccagcttcagtaagagatgtatcatgctccacctgaaatttgcaaaattagtaaatagaatagtacagaaggaaatattaatccaacaaacattgcaacaggcatttgtaatttgtaaccaactaaactcacatgcttcttcttcttctttttcatgcctgtaaaacttggctcaccagtctcagcgactgaaaaaaaaaagcaagttaagcatatattagtaaaaatgcatacttggcaattccttttttttttgcagcattaaaagtatacctgtcaagctctcagttttctctgccaacttatccacctcatcagatggatcttggatcacaaccttcttcttcttctttttcttggttgggtcaaaaggagtaagctacaaaacatcacaaacattgtcaacaagccgctggtacaaggaaaaatgatatagaaggctgacaagaaataattgtgaaaggctgattacaaacaaataaaatgctgaaatccaccacggagtaacatttcacttgctttttatcaaattgtgatgttaaccctttgttgcacatgataatccttaggcataacatgtgaccgccatgctcaaaacacaaatgatgaatctaatttgttgatctccttacaggctacagctctacatccgttcaatcaacagaaaaatcccacattgtggtgcatatatcctgacagggccattataacactgataatgaccaggctagcactgacagtatattcagacacaagtccaaacaccatcaaatatcaccataggtgttcactgctaactggttcagtcctcacaagctactacaaaaagatgaacaaaacaaatcattgcttaatctggcctatcactcatctcagatgttttttttattatttttgaagcccactcatctcagaagcttaatccgctcttacagatttcactgattcaatccaagcacacagatcaaacatcctgaagaggcccatggtcgcggattcacgcccaaaacaccctaccagatcacgcatacaccaaacacagacagcacagcacggcaccgcacccagcccatcgctacgccgtttcttcccttccccgccgaaaaaccgaactgaatccgatgtgcagggcaaatgaaaaaaagaaaaaaaaacgagaagggcaggcttttcacctcggagacctcctccttcctctccacctgctcctcgtccgccatggtgacgctggccttcttcacacggcgactcgatccgcggcgcggcgggctggggacctgaactgcaagggacacgagcagcgatcagatcgggtcgggggaatcgaccggaggaggaggaggcgacaaacccttacagggcgagagggaggatgacgacggcgggcggcggcggcggcggcggcgctcctgctagggtttctgatgggcgctttgctaggctttactgaagctatcctttttcttcgactcctctgtttttctttttcttgggtggttgccaggttttcgtttcgtggctgggccggtatttgtagctcgagtcacttggtcgcaacattgtcctagcctagccggcccacatgagagactgtagaagcgacaatggtgggctctgttaactttgttaccacttttaaccctactactaaaccttaatattattaaattttgttagagcaatcaactagaacatatccttatccatattatcacaccaaattttagtaatcatagaaatttctactcttggaaaatttatcaaaattagataaagttctaaaccaaccatgttcaacgttaccaaaattcgataacaccaaaatgtgctacttcctctatctcataatatagtaatctaaaactggatatttcatattacaataaatttagatagaccagataaaatatttcatagcacaataaaatctaaataacctattacttgtgtaagtggtgctcttgtctcacaagaagaacacggagttagggcatgtaaaacaaaaaagtcactaatgcatgattaatttagttttaatttttataaatttaaaattttgatttaattagtattttaaatcaacctttgtatagaaaaattttcgtatgaaatgcatagttaacggtttggtaaagcatactaaaaatgaggtaaaatatgtaggcattgttgacgctttttcgtggccaacacaagatcacctaacgatttgcggtgtaaacaatagagtcatcaaaatcgatagatcaaaatcggctggtgaaaccgatttcgagatcaattcgctttcgtggaatcacacgactaatttataagcaaattagtaaagaagattctatcgtacttacgtgacgacgaacgactagtttccgagcaaactagcaaaggataaccttctcgctttcgtggaaaagcacgaccgtttttcagcgcaaaacggcaaagattaaccaaattctagggttaagcaaaatagaaaataacagaaaagtaaagaacaagaaaaataaaaataatagtagattgattatttgttcggggttccacaaattgacgcaatgccctaatatatataggagcaactaaacgctaggtgcgataagcacggcaactccacgtaccgtatagcttaaccgaatacgattccatctaaacaaatctaactattaaaaggaaatatatcgctacctttcctctgatacgcatataaccagcggcttggctccatctcctctctgaagacgtaaatcgcgccggacgtatacgtacgcaacacatgcgtagcccctgtagtttcccggccatggaaccttcttcgagccgtactcctgacttgatgaagtaataggaaaaacagcccagcgccatgcatcaatcaagcagataacagaccagcaacccaaagcaaagcacttaatctccatcacacgaaatccccgtggtgcatttcatctactcatctactccctctgcatatgattaatatatatgtttaactagccctcaagccaaccaattaaacatatataacagctgctccaatgaatttggcctgctcaaatgaaactgactattattagccaaattatggtataaagaggcatatgtatcctccagtcccccgtcagcgagcaacggatgaaacaaaaacgacatatgctgatgctccatcagtcgtgcaacggaagtggttggtcgacccattggctgccattggttatggcctatgtccctatttttactcttgcgccttgattgtcttcctgcgagtaatgcaatatgactagctgttcttttctgattaagattcagattttatctcggttttcattagcacgtatttcaaagtatggtactttccgtacgaaaatttttatataaaaattgtttaaaatatcaaacatatctatttgtcaactttgtaataattacaacttaattaatcatgtgcttataattttcaagttttatgtgtgtcagcttaatatttatcttaataagttacaaacaccactgtaggacttgactcggtttagaccctgtctctttcagcttaagattattataatctagattattgagtcagattactgtaaactagattgttataatctgtagtagaataagcggttagttgtttctttcctagattattagagcctagattattgggtttgcaagtctaaagagggagtggggtagcatggtgggtaatttttcacccaataatctagaaaaagctcacctaaatgagcttatcagattataataagctgggctttagattataataagctacttcaataagttgtctgtttctttcagtttactcccaataatctgcattataataatcctaagatgaaaaaacagggccttagtcgttacgaatcgactcggtgtgcaattgacatggcaagatttagcacgttgttttgtgacccgcatgctacttgttatgtatctaaacatttgtcactttcgattagatactgcgtgcgattcttgtgcaacatggtactaaaaattaattaaagaggtataactcagataaaacacgcattttatataagtatgaattgttggactgactgggtattcagtagcctcgccatttggtggtgatggtgtgtaggctgggacatgattttttagctcgcgataagaacatttccctcctcttggttgttggggcacgccgctgcaaccaacctgaaaaaggcattccaattcctctttttgcaatatcaggttggaaaattaagcatccaggaatcatcctttctccacgtgaattcccatccatttcctctcttgaccacagtctgtatcttgcaagaaacattgagatttagctgggcagcaggcgacgacgacatgcagatgttaaatgagaaaatgatcaacagagacacggtagtcccctggttctgcacaaatctagctggagacgactgtcacagcacccttacatcagttaaacgagtataaaaacacatcagggttacgtaacacaacgaaaatgaaaaagaaaatggcataaaaagttgttggtaagaaaaattactagcctaaagaaaggccactgaaaggaacaccaagaagaagaaaacaaggttcggtgttgacggtgtcatcgacccattcatctcagaaagtcagaatgtgcacttgagaaaaataacaccccggaatatcatagtccacggttcatcaagatgatacaaattcacgcaatggtgcgactctttcatccaaatatcttcaattgtatcattagactgtacctgcatacagttactctttatcttgcacacagatataagcaagataatcaccaaccatcacggggaaaaaaccaagcaattagtaggttaggcgagctactaaaaaaaatccaatacattattgctcggaaaaaaaaaagctgataagatgggatgacaccgaatacaaagcaatctggatccagacacttcaattatctacgcagctgttagtacaccatcaatgaatatccagataacggcactagtacagtacaacagttcaa

SEQ ID NO: 67354 - DNA, 86873 bp, Oryza sativa
  unsure (1)..(86873): unsure at all n locations
cctttttaatagagcaacatctatttcccataacattatttcataaaaagcatattggtcatagtaaggataaacaagcacgatgacgttacacttaaaactaaatggtcatttcatttataccgctccatgcgaggatgacttggcatgctcacatggcacttttttgggtccaaggactatattaatccaaataattaatttagaggacttgtttggacgatttgaaacctcaaggactaaactgagcccgaagcgaacttcagggaccatattagttattcacaaaaaaaaaagacaatgacttcacttcatttacttgccgtattttcaatattgatcaattagcaaataatgcttgtgcaaccaccaaaataaaaaaaaatagacaataactccacttcatttacttgcagtattttcaatagtgatgaactagcaaataatgttggtgcaaccaccaaaacaaacaaaatagataataactccacttcatttacctgtagtgcattagtgcattcaatttgaaaataatgctatggcatccaaagaaagaaacaaatcacaaaataactccacatcatttaatacatatcaataataaaataatgccaacatatacaaagaaggaaacaaatcagtgaataactccacctcatttaatactattatatcaatatgatcacctaaaaaataatgcgagcacatccaaagatagaaacgaatcagacaataagtcataactccagttcatttactcgtctctatctctttctcgcgcgcacgccaaacaataatacgtaaggaagaagcaatcgttaaattgtcacaccgtttttaactatttaccgcttcgaatacatggactacaagggtcactcccaccatcggtttccaagagctcaggatcacatccacatagacatcgaacctcaaggctgcaaagcatccagcagccatagtccatacgaatatacgatcgatacggcccgtgagagtgaacaaaccaaagaaagaaagtggagggaaaacttcaaatccgcaccccaaacattcaaaaaccaaacaagttccacccctcttccaccggctctcctcgcgcttcgaaaacccacacgaaaaccatcggggtgacgctgacgctggtcaatgacccgtgggccccaccccgccagttaccaccgcgaaacccggctcgcgagactcgcgtgtcatccggcctccttcccccacacttcaccataccaacgccggaaactgacaagaggccgcagcacgcagcacgcagcacgcagcacaaaccccctccctctcccaccccaccccacccccaacccttctccgatttaaaagaaaagaaggtgagagagagagagggattaaaacccaaaccaaaccaaagccgagggcgagcactcgaggagccaagcctcttctctctctcgtttcgtctcgtactcttgcttccccctcaattccccccctcctcggacccccgcgtcgccgaattgggcgcctgattcggcgtccccccgccgcgccgcggccggatcgaggcgccggagggtgccgctccggtttgctcctgggtggcggttgtggggggtgtgaaggagcggaggtggggggtggagtggaggggggaggctgcgtgggggcggttgcggtggcgagggggtaggggtgctcggccgcgcgatctgctgatccgggacatgcgtgaggcgggagtgttgtagcaagagccattccgctggattttgtatatttttgaggggggtgagttgctcgtctctgattttgttttccccttttttggaatcgttgttctgctcggtggtataatctattctgagttcatcacccgctcgggtttcctttttagtggaggaggttgttaattttggccatttcatgtgctttatgttgcattgccctaagtttcttgattaggcatgtccaaatccaaagtagggtttagggtggatcatgctgttcgaatctaagtttagatttacatttttatgagaaattgatgacaacaagttaagattttgatgagtttctggtcatgcacagggtgttggaattggaatgggccataacggttctaagcggagtccggtgcctgagaccaaagacggagcgatgaaggatttggagaagtctacctccttggaggtggacgactctaccattgatggtgatgtggatcttggtggagggctcactgtggtggggaggaagaggaaagatggaaggggttccgtggatgagaatggggcctcgacaaagaggattttgaggtccaactccatgaaaatgcatgtggatgctgagacagcggggggtgtggctttggatgtttgcaagggtgacattttggagaagaaacagtgtgatatcatagcagagggtgatagaggaggggtgctgacagttgatacttgcaatgctgaggaagatggggaagtgactggtgcggtagtgagcgatgctgtggttgaggcagttaggtgttccgcaaataatgtggaaagtttgggtcttgctgaggttgaaattgctgaagggaatgggttggacgctgacattcaggaatctgatggtgagatggataaggcagatgacaaactgtctacaccttctgaggagcagaatgaatctggaggtggaacaagtgttgggggcatcaatgactcccaggaaaacaagggggttaatgggctttgccagggagaggtcatagacccattggctacagcaaatggagatgaattgagcatgggtttaagcagaagcgcaagtggacgagaatctattgagcaagaggataccgttatgtgcgctagtgatgatcagaaagttgagaaccattgccagtttgacgataagcataaagaagctgaaatttctcagattgagctcgcagttgataaccacattatgctaactgattgcactaaccaaaagaaggggatcgacagtcctgtgaatgaaaccaagggggattcaactcctgacattgtttttataaggagaaaatcaataactagaaaaacatgtgaagcgaagcaggtgaaatctgaagatgaggttcgatttgagaagcgagttacaaggtctgctactgttagacagagagaggtttctgctagcatgtgcgtaggtgctacaaacgatgctaacttggaaagcaaagaaaggaaggaagatgttcatcattatacaaggaaagtgggcagcaccgtgcgctcaaaagttcatcacacaggggtggcagaatgcgacactgatacaaagaagaaactaaaaggaactgttaccactcgaagaaactcagatgccattgctaatgatgatcctccaagtatcacgcagaacaaggaatcaaaaactcagatgaagatcgatatcaagtctcaaccactcacaagaaggggcagcatagtaaataaaacagaagacgcagtttctgggttagaccagaatatctgtagttcagccatcactgataaaaatgatatagagctcacagattctgaaggagttaaatctgagaacaaggccgctgtgaggaagtcaatattatcagttggcgctaagattgttgccagtaagaagaggatattggaatcaggacttgataaagctagtggagagtcaccagttgcaataccatccctaaagaaggcaagagatacatcctcagacactgagctagagcaaccaaaaatgtcttctggaaagaaacttaccagaaataactgtggctcaagtaagaaaggtatgtcgacaagacggcaacatcagagtcaaacagctaagttgagtacatctgtgaattgctccaataaaaacgaatctaagctatcacagaatgaatccgatgatgatggaactggcagtgatacttccttgaagaacacttgtgtaagacgtactcgaagtggtggtgttgtccccaaaaaacaagaggattctagtgaatctgaggaaccgatcatactgagaaaaaatcatcaaagaggaaaatattctgggaaaagggctggatctacaccaaggaaagttaaagctcccaaaggcaatagaaaggaagtcaaggcttccagtttgaaatcttcgggtccaagtgagcagataaatacaggaagtcttcgtgaagaaaaacaaaaaataagtgatcatatcaagggcatgcttctagatgctggttggacgattgatctgagacccaggaatggcagaaattacttggattctgtgtatatacctcctagtggtaaaggatcttactggtctgtcacaaaagcttatgctgtgttccttgaaggtatggaatctgagaagaagggcagagctaaagatcagcgaccctcaaagaaatctgtaggtagccctgggaaaagtcatgtttcagaggaaatccttagcaaattaaaaagaatagtcgttaataaacgaagaaccaaagtagaacttcagaagttgaaaaagaggaaacatggtttactgaaaaagcagaaaacttccaagcgcaactcaaggggttccaaaaataaaatttcaaattctagaaagttgcatttaggcagcgaaagaaaaaagcgaggtggttgtgctctacttgctcgtggatcaaataaggatggtggaagcagcactaacggttttgttccatatgaatggaaacgtacagttttatcctggttgattgatcttgatattattgatatcaatgcaaaactgaaatgtgtggatgaaacccactcaaaagttttactggaaggtgtaaccactagggatggaattaactgcagatgctgcagcaaggtctttacagtacttgaatttgtggctcacgctggcgggccagtcagcaaaccttatagaaatgttcttgtagatgggctggacactgaccttttgcattgtctcattaatgcatgggataagcagtctgattctgaaaggcaggcctttttccctattagcactgagactgatgaccccaatgatgacacatgtggtatttgtggtgatggaggcaatttgatctgctgtgatggatgtccctcaacattccacatgagttgtctagaacttgaggtatgcacttaaatcgagcaagtaaatgcggtctatactctatagaagtctatttccttaatgccacccatatttactttagcaatacctgtatgaaaattctttcgagtacatcagtctgtcttttacttttgtcttgcctgctgtatctattatttttgtggttcctggattagaggagatgattgaaatgcctgataacgtgatctccaatttctttttgcactaaggcttgataatttgatgcaatgttttctaatggatataaacctcttattttcaggctcttccatctgatgattggcgttgtgctaagtgctcctgtaaattttgtcaggaacattcaaggcaggatgctcaagacattgctgaggttgactcttcactctgtacttgttcccagtgcgaagaaaaatgtatgtaatctctgcttgtactcccttttatagcgtgtcagtactttagatacatgcacaatttgtttagctattgattaacttcactgaaatatcgtgattgccaatcatttgtttttttgacacaatgtttttgatttcttcacaatgattatgtctgtagatcacccaggttgctctcctgagactactaacacatccaatgtctccagtcaggcatgcgatttattctgccaacaaagttgcagactggtaatactaataaaaaaattgttccttttcattcctagtttcgccgagcatgatttcagaactggttgttgtagtttcagctaagttagggtaggctagatatgaaatccaagtcaaaccacacgaaccaaaagattgaacttaaaagtaaggtgccaaaaaataataagaacaaaactcacctgttaaatatctgcagtgcattagggtttatgctgccacctttattcgtcagttttattgtttccttttgtgtccaagtagctctacttgataagcaactgacattgtgtaaagcaatatagatatgtaatttcaccaaaatcattaacatttaattctcctttagttttttttctgtatcttaatattccctacatggtgtctgtttactatttgaagtacacgggtcgttatttgttatgaatttctgtaccaagtgatgttttaggatggtgtgctactgaacttattagttttcaattagatttctgggcggcaatgatatctatggaactgtcaacagtgctctcatgcagtcattaagatatatctatagtttattttcctgtgatattcattataggggaaaggtaatgcactttggatgatgagggtaactaaaaagaatcatattttacaatgaagtgactataaataatatgtttactataatgcatggaaccaattcttttttgtatccctttagtatgcttttttgccatttaaatctaatcacataacacatattaagttactgtgttcatcttgtatttgaactcgtttagtgacacgtgataactttgtctttttattatcctactggtaaaatattatgaacttatatcccctccctcaaacctcactccacccatggagttactaagagtgatttacaggatctgaaatgacatttatgtgatgcagctgtttgagggattgcgtaatcttcttgctgtgaagaaggatcttgaaccagaattttcatgcagaattattcagcgtattcatgaaaatgtaccagaaacagttgttgctttggatgagagggttgagtgtaactccaagattgcagttgctctttcgttaatggatgagtgctttcttccgattgttgaccaaagaactggcatcaacttgatacgtaatgttgtgtacaactgtgggtatgcaccactctttctacactgctcacattactccatgcaattttgaggttatcttgtgaaacctctgtgatgttgatattgttttctctttgtaactctttgcgcgcacttcccctcatttcttcctctctgcttttggtgagtgggtctatggtgggagtttatcttacattattgctatagattcaatctggtgacggcaccagcatatgatactacgaatgggataatttaggctgatttgctagaacatctgcaaattcatttagaactgagtgcatttgcaagtaaccatgctgactatgtatgcaattagtgcacatatcaccaccagtgcttatatgacactgttcactgttgtcctgcaaatttctgaagataattttgtgtcgatctagttcactgcatgactctttaatgagccttttggcgatcctgagttttggatctggtgtatgcatcagctcaatgtgggaattttgagcttttggcatatttcctaatataatagtatgctactgtagccaagtaaaagtttatggaagccttaacattgtttcctccatcttcaatgcatgatatggtataatcaaatgttttttaactcaagagtggtagatgagtattcaatcactgtatatatgcttatgtggattgtggccttatgtgagatttaactaatcaaaataaacatatttatgcatctaaaggtgtatatgctaaatctaaactatatatgaccaaaacaacagaaaagtccctacccactgaagcatcagctatatgtgctccatataaaaaaggtatccaaatgaaaccatgtgattaatgctagtaaggaaaataaatccgtagtagctcacggtgagtgttttttatgattgacctgtggatctaccagctattgctagttttaactgaacacgtatgtgatactgcgacttgtttggtttctgtttagtatacactgtatcaaccttctagttcacgttttgctgatttactggactacgttattaattttatgatttttagttgacatcggatgaagtggccatgatatatttaatagttgcagaatttcttctgtgtttgacaagttgaaatggaaattttattccttgaaggatatttgattgccatcctgtttttgcctatgtgtaggtcaaattttgttcggatggacttccatgggttttatatctttgttttggaacgtggagatgaaataatagccgcagcatcggtcaggtgagttgccttcctcttgccctttttggatgctttgtcctgtgtatatatttcatctagattgaactctgtgctattcaaaaataacatagatgcatgccatcactagttctccgcatatactgatcatggtctagtgcatagctgagttgttttgtttcagttgcaaggttgcaagtactgcaagtgctttgattgcagtgcacacgcactaattgcaatcaattgtatacagtcattgtgccttttctttgcctgaactctctaatgaaataggcttgctatggttacttttatgtaatgtttttcccaatgaatcactgggcactaataagattttctatttggtctcttatcctgaaacagaatacatggaaccaagttagcagagatgccattcattggtactcggaatatgtatcggcgtcaagggatgtgccgcagactgctagatggaattgaaatggtatattgatctgagcccaaatctaggcatgattcatggtgattatataggacaactgtttattgcagaaatcctatttgcattgtgtctagtttcaagacattgaggcactgctcaaaacctgacttcttaatttatgcaacgtttttgtcgctagctgaaatatgtgacaaaagtaggaacaataacagactctagcttgtaaattgtagtgctctgatgtggttctgactacttcaggcatgctataattggtctttacaaaatagcatcttagatagtatttttctatatggtataatttgtaatacatatgtcggatgatacattggcctttgtattacatctctgaagagaataagtaaactagcttgcctgtctgcgtacctcattgataatagtttatatatgggcttacttcattttgcttgtttgagcatttgttatgtactgtgtgtactaacgtattctgatatttacacttcagatcctcagctccctcaatgttgagaagttgataattccagctatcgctgaacttgtggacacctggacatctaaatttggatttagttcacttgatgtttctgaaaagcaagaagtcaagtctaccagcatgttagtttttcctggaacaggtcttcttcaaaagccattgctaaagaaaacttcacctggggaaaattcaagctctcaagaaggtcagcacataaaatttaaccctcatatatcaatgagttattctcctcccccttttatttaatggtgaatggccatttgtgcagttgatggtgttttctctgagctcgagtctgggaaaacttccaatgtggccaatgaagactctctttgttctgcaaatgctgagactcaaggttcggctgccccatgttatggggacaacagcaaagatgctagtgcttgcaatggtaatgtttcacaataatccatgtaatgttactccatgttctcttttccttttcatggcatgacccataaattgaaaactcagaatacccacttgttttgcaaaacatgtcatgacatcttctacaaatctttgaagaacttgaaccgacatactgggtttcttgttgtttgagaagataggaatgcattacatgattgattaatgacatgaacaataggctacaaacttatgttagtggttcttagagaacaacgcatacatttgaattctatgatttcaatatcgttatgtttgtctaactattttgaatatcttttgcagattgacatgcttcctttgcattattttgtccctgtcaaaaggtgcaccctggtagtttcaagcattgacagatactattgaggacatgaagcacaccgatccttcattgttactattattctcttttgactcggcatgcggttcgtcggttggcagaagtagcctggatagagagggcgagtttttgaagatcccttgcagagcagcagcacctcggttctgctcaatattgatgattcaattgactctttggtttcggtttgacttgaaaccagcctgtgcagtgttggactccgatcacctaactttaagtggtttacctttacctgtaaagtcagcatgtagaactgagatgatagttttattccgtgttttttttttctggatggttaacttagtaccaaaggccaacgtgtgccgcaaaatcttcgtacatgtttctttacctgctatgtgacagtagctttgtttttgctagcccatttttttgcagccagatctcatctgtaagacactaatgcatgggcaagcagaaaaaaaatctcagatatgccacctgttctcatgttggaagtaaatctgataatgttatggcatctatcctcgtgttcatgcagatgcaaggtgcttttgttcgctgaatcgaactactgatcaggtgagatgtggtcaaagatcgcaaggttataatcactctggaaagcatttacttgtaatcatatgttctatctgctcttttctgtctttgccaatgatcttttcgcaggcaaagtgaaggctggctacaatgcaattatcactcgttgattgttggcagatagtactttttttttctgacagaagaaaataaatctctacagaaaggcgtctgcagtgttgaggttggcgaggatcttgtccttgacatctttgggcagcgaggcgaatggccctgccttggagtagaactccgccagtgatctgatggccttctccagcgcaacgtatgactcctggatgagcaggcaaacaattttgttaacaaatcgtcaagtaagcaacccagttatgttctgatgtttgcaaaattgcaactaaaaaaatcatgccatctcctgttccccaggtgagtgaacttgagttcaaacttgctttgaatttttttcatgatcgtttacttgtgtgttaattttcatatttattttaatttgatcggtgtaactcacttcaagcctcctttgaaatatacttctccgtcctgattcagggttcaaaatttgtcgccaaatgtaaggggttttggacggaggtagtttgaattttggaggattttcattagaattaaactatggagctagaagataaatcatgggctatatgtgtatccataaaatactacgggtaagtaacgataagcaaatggacgtaggtgaggattcagccttccctactgacaataaaaccattaaaaccatgagagtttcctagagctcttattaatttctttttttgaagtgagagctatagctttgtctatatttcttcctagatccatcacttcctgggtgtgtgaatgtggttagcagcgttgcaaaaatagggggaaaattggcattattacagccgaatgataacgctgagatgcgcgaaccaaacctcagcagcgacggcttgctggcctcgccagccgccgaggaactcccggatggactccttggcggcgtcggcgcctcgccggaacttggccacgtcgccgccgtcgtcctcccccagcgactcccggagcgtccgcaccacctccctcgccgccttcaggtacgccttgggcaacaccttccccgacttggtcctctcgttcgggtcaaatatcgatttgatcgccccgaccaccccctccccctcgccgccgccgccttcctccgtcgccctggcgcgccccgccgtgccggagcccacgacgacgatggcggcggccagcagcgccctcctcgtcgtcaccgccagccgcgctccgcctgcactgtttgcgacacacacaatcacgcaggaatcagagttaagctgtggattaaccgcgagagacgaaaatcgaaggcggcggcgataagttacggatgtgctgctgctgctgctgcttgctctcggcgtctctccgctgcttcggcgacggcgaaggcggcgacgaacagcagtagcaccggctggccatcagcgacatggggccatgaggaggaggagacggcattgcacgcatgcgatgctactccggctgcgacatgcacgcgaggggcgatcggtggtggtggccgagatgggagaggtgggcgaggagagattggtggtgagctcgagcacgagcacagccaccttatctcatatctgcaagtagcttcagggaggaggagcaggagggaggcgatgcgagttggagagacttgggagtttggcgcgagaagacgacccggcccgcgagggatttccctcgcaaattgagtgggcttttctttggaggcccagaatttgttggaaatgggacgacgcagcaaattctcactagccagaaaatatgcaaaatctgctactccaaagaagtattatcctaacatgaaaaattcccttattttgtgtgtgtcggtgagaagtttgaagtttgaacgcagggaattcaaggagattcgacaaaatctgccattggaccaacataaagatatgtgctttcttccaggtcttaaatctgcagcctctctcttgttttctcccccccccctccccctctccatcgatccgccattacctggcttggacagatagtcatagagcgatacttctagtagttttttttaatcctccctaaccacttcgatgtatgagtaaactccgtacaacagatcacgactttgtaatccccaatggtgatgggatgatgtcattgcttacatttgcacgagctaccaaccaaccagcactatctgcgtgtgctctgagctcttttgtgttgtttctgcagtctgcaacgaggtccacttgagcatcagaattcagaacggatgaccccctgtttgccgcacacagaaagaacgcacggctcgatcgagcagagcccttcctctccaccgggcaattttctgcgagattttcgaaggttcttcgcaatattttttatagctaaacacgagaatacgatatcacagctgggttaggaagcagttgagagaactgaatgttttctcatgtttcataaattaggcttcgattattttttaaacctttgacctactgttacaagtaacaatataatcaagctgtcaacgaatagcgaagtgagcgtagctcagtcgattaggtttcttatggtggaatcagttcacccgtatttaaattctagatttgagacgagtgcttacatatacagctatttatttttccagcgatagatggcgtacctataaacaacgagacgtccatagtgacttcatcaatctcatgatatgctggcctaatcttccaaatatgctcattattgtcgataacgaggcatctgtgatgatttcgtcaatctcaagatatgccagcccaatttttcgaaagtgctcattgtggacatctttgtttgtaccgtgtttctaaacaaaattgcaacaaaccttacgggatttgggaggaggtgggttccgtcaaatgtacacgtaccgggttaactgttagtggggattgtctgcaatattgcacttgtagggatccaacatgtcagtggcagctactgtaagtgcagcactgcagataattcacgtccgttatctgcacatcatacatgcaaatgctgttttagaaaagaatagtttttctctgtttatctggaaactgaacaaatttatgcaaattcctatggaatcttgagtgcctgttcactttgatgccatttgtcaacgtttgatgtcgcgattccggtatttgcatggtatggggatcgttggtcctaggatatatgcgagacttaggtaaaagagacggagacaaggatttttatacaggttcgggcccctgaattgttaggtaataatcctacatcctgttggccgaagccggtgttgctctttattcatctagatcacacaagtacaatatttggggtagcctatcaaactgttgtcgacatggcgatctgaagttctgactcatagtcgacaacagggtagccttccttctcgaatccatatccggcgagatcagagacagcgctatatctctcctgacgatattcgtaggcaccgtaggggactagccatgtctatctctgaagtcgatatccggcgtcttgtcttggcgtatgttggcttatatgttgatcttgtgtcttaacctattgttccgtgtcccctctcctcctagggggccttgtatttatacccatagttgtccccttatccgagtagaactagggaaaccaatatggatataatccgagtagtccttgtcgtttttatgtagaaccctattcatcattccttatgcggaactcctcctatatccgaagtttgtttccgtataggacatgatatgtggtaggtcctgtcgagatttagtcaactactattaggtatatggtatccataaccctgacatcatttttaaccatacctttttttttgtaaagttgccaaaattttggctacgtttagtttattgccaattttaataagtacatataaaatcttgccaaaattttggcaactctaccaaaatttgacaatgccaaaacttggtatggtttaaaatggtaacaaagtgaaccatccctgaatatcgtcttaacctcttttaacatttgtttaaagaaataatagtatgacctgcgagtaccgtgacatatatacaaaaatattttctgagcgagaggagatacagggactagtgacaacaactgacaactgacaagtggagcagcactacataaaaagggcaggaggggatgatgcgggcgctacaaagtgcttcacatctttgcctcgttcgtcctccggttttctccgcagtttcttgatccatccgcctttcctctcgcagccgtcggcggggggagtggttagttggttactggttagtactccatcggtaaaaaaatccctccttttcatatctttttttcgcttccaatcttgcgcaattcgggacctttcctgccatttcgttctgtccaaattcagaacattgatacggttgtttggttgttttctcccccttttctgtgtctgtacactgctgttcgtcggttgattcttgtgtgagttgtgaattttggcaattgaagaataagaccttgatgtgtttgcacgcctatgctgttgttatccgtgtccatgcgagtgaaatgatccgctgaatttttgggtagatctgaacttggtaccttgaatccagtagcatttggtgatcggcgcggggattagggtttaccgttcagaggggacgcggatatttaccgttgtgctccaaaatttcactgattgttttgggctcaccaaccttttgctttcttgcaggcttgcagagttttcagagagatttaggcaatggcggaatcaggccaatcgattgcgagtgatgtgactgcagtatgtagacaaaattcgccctttttatgcttgggactagctgaattgtgctttaattcgcctttagtgatgctgattttctttggtgctcgttttgggatgtcagctgatcggcaatactcccctggtgtacctgaacaaggtggtggatggatgtgaggcccaaatcgctgccaagcttgagatcatggagccctgctccagtgtcaaggataggtatctaaagtaccccagtctgtccctcctgctgatagttttgcgctttacttatttttattctggtggccatggtttgcaggattggttatagcatgattacagatgcagaagagaagggtctcattactccaggaaaggtgagacactgagacctgaaagtataaatcaactctcagattagaatatgatggagtcactttgcttatttgtgactaagaactcctaccaataaaatctactccctctagtcaaacatatttgattggagagagtagcgtaccattagaagattaatgtctcagacttctcatttaaggaaaataagatgttttggtctcaccatccctcgtctagattcactaacatccatatgaatttgaacatatatataaagctcatacataaatctattcaaaacctaaaacatcttataatatgaaacagaggaatggtgatgtcatggttggtaaattaatacaagcgtgcgtgtgtatctgaccttttattttttactggaatacatctgactgtattgtctgatcgatcctccctttcttatagagtgttttgattgagcctactagtggaaatactggtattggccttgctttcatggctgctgccaagggttataagctaatcctgacaatgccagcatccatgagcatggaaaggaggatcattcttaaggccttcggtgccgagttggtccttaccgatccacttctgggcatgaaaggtgcaatccagaaggcagatgagctggcagcaaagatgcctaactcttacattctccagcagtttgagaaccctgcaaacccaaaggtgctaaattgctaatatattattatccttgctagaaaagcacaatagtttaattactgttttgttttactggactatgctcagatccactatgagacaactggacctgagatttggaaggccactgctgggaaagttgatatccttgtctctggcattggaaccggtggtacagtaaccggaacaggaaagtacctcaaggagcagaaccctgagatcaaggtaacttatatactccctccgtcccataatataagggattttaagtttttgcttgcacggtttgaccattcgtcttattcaaaaaattttagaattattatttattttctttgtgacttactttattatccaaagtactttaagcataatttttcgttttttatatttgcacaaaatttttgaataaaacgagtggtcaaacattgtaagcaaaaactcaaaatcccttatattatgggacggagggagtacttgtttgcatgtttttatggttttgtgtatatgtgatggtgacttaactgtgtactaattttgtcttaaagatctatggtgttgaaccgacagaaagtgcaattttatctggaggaagacctggtaagatactgctctttgtatagctcaacttgcataaatcacattagtaatactagtactatttgtgatgcataactatggatgtcaaaaattatttgaaacatagggtgcacagtatggatggttcacgtatttgatgtaataatttagctgtctcgattctgttgaaccatcatgacattatcactgttccatgtttttggtttcaggtccacacaaaatccaaggtataggtgctggttttgttcctggtgtacttgatgtcaatctcctggatgaagtggtccaagtaagcaaatccaaattttctgttccaggccactaatcaaatgaaaaagatcttgtattgtttctatttttctgtaaacaatggcaatgcagtatgtgctgctaaacctgccacaaggcctgcatataaaaactctcttataaccacgtctctgtcgaatgtccagttccagttcacctgatgaaccgtttgctaaccccaacgttagaattcaattgttgatccacagatccagacatgcgcacggttatgtatatagaaacaaatgtacggaatgcaattactaaattgatctgaacatttcttgcaattctactctggtaggtctcaagtgatgaagccatcagcatggcgaagcagctagcgttgaaagaagggctgctggtgagctcagtaccccttaagaatccacccaactcttctccacctattgctgcacatatagcctatggtttaattccatgacaaatatttttcaggttgggatctcatctggtgctgctgcagtcgctgccatcagggtcgcgcagcggcccgagaacaaagggaagctcgtagttgtaggttccctcctcagaaccctgttttgccaggcatttcttaaaccgttcatgatctccattgttttgcaacctacaaaaacctcttagattctctgctctaacatgtccatcgccgtcatttgtgctcgcaggtggtcttcccgagcttcggtgagcgctacctgtcgtctgtcctcttcgaatcgatcaagagggaggccgaaaacatggtgttcgagccatgaacggctccagcattgtgcaaattgtgcttccatggtttagggggcttggagagaatggcgtcccgagtgcatttcttcatgttggtcgcacttgccatcatgtagtcgcttgatctgaataaagaacttacatacatcaatcaaagtctggggattcgatcagctttcctggtgttatatgagcagttcatatgtgtactttcttccatactgaaatgtgtatcttagctactgaagcttccatggattgctgggctgctcgagtgacaagaacacgcataaattaattcggcccgctcatagattcagcccacgcgagcgcggtcgtactacgaagctactctagtttattttcttgagcgagggtagctagcttcttctagtttattttctagaagaaactcgactatttttaggagtttttgattctgaaagaagctgtaatcactaaaagtttccttaaacatgtccctggtcatgcttggcaacagtttaatagtaataataaccaaatcaattctgaattttaaaatttggatttttgacctgttgagttgacagtatcttttcccggcgatttctgacctgaaagtctcaatcagacagctttcgaaaaggaaaaaagaaattccaaatcacacatggtttggtttcttcactggcacagagaaaataaataaaaaagataaaaaagtttttatttaggtggcggtagcaatccccgggcttcttttctcccaccgaaagggagctcgaaccagctcacacccccgcgaccgccaccccactccttcgcaccatcaccacaccaccctgtatattcctcctcttcttcttccttcgctttctccctttccagttgttcgcttcgcgtgcgcattcgcagctaccagtttggtttgcggcgccaagaattggtggctatagccttgccttttcttttcttttcttttcttttttgcatgtttgggcggcggcgatcgagctgagtcgatcggccggagtggatcgacgacggaaatggtcagccgctagcgttgtagtagtagcaagctactagctctgttcatcgagttgcagggcttgcgatcgtgttgtgttgggttgggtcttgggtttggtggtttgaatttggtgtggcgtttttcttgggcaggggacgccggtgaacatcatcgtcgggtcgcatgtctgggcggaggatcccgacgacgcgtggatcgacggggaggtcgtcgagatcaggggcggcgacgccaccatcgtcagcaccgatggcaaaacggtcggtcgcttgcttccctgccactgagctagctgatcattctttcgttgtccccggttcttgatatgatcaagaaccccgagtattgcagagctcgaagcgaactgttctgattttctgaattcgtattttgctgttgaaccgtgcgcgctaggtgtttgtagaattgcctgaatggaactgctactgaagcagcagctgttgcttttttgtgggcagattgtggcgagcctcgcaagcatttaccccaaggatacggaagcgccacctgcaggagttgacgacatgacgaagctggcttacctccatgaacctggagtcttgcataacctcgcttgtcggtacggtattaacgagatatatgtgagtgtttaccattcagaattctccatcttgatatttagtacttcgttcaggaccatttgggcttagccatctttccttttaccatgaaaatatatcgaacagacatacaccggcaatatcttgattgcagtcaaccctttccggaggctgcctcatctgtatgacgtgcacatgatggagcagtacaaaggtgctgcatttggggagctcagccctcatctgtttgcgatcgcagatgcttgttacaggtgtgttctgtactcctgttcacgcctttggtaatctatggaccgtgtcagtctcgaattgtgagtttgtgactgatgttcttttcttcattgtgatgctatcaaactcagggcaatgatcaatgaacaagggagccaatcgatattggtgagcggtgagagtggtgctggtaagacagagacgaccaagatgctcatgaggtatcttgcattcatgggaggaaggtctggaacagagggtcggactgttgaacagcaggttttagaggtacaaagaactccccatttctcaccatcttatttgttttcactatcttttttagaacatctccattcactctattgatttctctgcaatgcatatagtctaatccagtactggaagcatttggaaatgcgaagacggtgaagaacaacaactcgaggtgtagatttgaatcagcaactacaaccatgatatggcaattgatattttgtaatttccaaatttgatatgttgaatttttcagtcgattcggtaagtttgttgaaatccaattcgacaaatatgggaagatatccggggctgctgttcgaacgtacctccttgaaagatcgcgagtatgtcaggtctctgatcctgaaaggaactaccattgcttttacatgctatgttctgcaccaccagaggtaattctctagaaacacttaaataccacttccatcatctgcatgctcagagtgccatagtactgattacttctgaatgttgaactgatttcaggatgtgaaaaagtttaaggtgggagacccaagatcattccattatttgaaccaaacaaactgctatgaagtagctaatgtggatgacgcaagagaatacctagaaacaagaaatgctatggatgttgttggcattggtcaagaagagcaggtatacttcatagagtttttttttaaaaaaaggtccttgcatagactagtaagtactaaataagttgcggatgctataattgattcatcctttttacttctcaaggatgcaatctttagagtagtagctgcaatccttcatctgggaaacatcaatttctcgaaggggcaagaaattgattcatcgaagctgagggatgagaaatcagtctatcacctgaaaatagtagcagaacttctaatgtatgtataaattcttcccatggtttataatctatcatctgcaaatatatatttctgctgtaatcaagtgtaaaatatattttaggtgtgatgaaaaggctcttcaagattcgctttgtgagcgtgttattgtaacacctgatggaaatatcacaaagccacttgatccagattctgcagcactgagtcgtgacgccttagcaaagactgtgtattcacgactgtttgactggtaagaatgaaggtatatcatattcatcagtggacagtgatcaaatagcaagtgctattactcttactgcctggtacgtctagatctgaatgtgacaaaggaacttctttctgagctaacaggattgtggacaagattaacaactcaatcggtcaagatccagatgcaactaatattataggagtacttgatatatatggatttgagagtttcaagattaacaggtttgccagcagactagtttcaattatgcaagtgtgctattggttttgtttcttaatacctgaaacacaaatcatactatacttatctggcagcttcgaacaactatgtatcaacttgacaaacgagaagttgcagcagcactttaaccaggttagcgagacctttagattactactcctccgtcccctaatataaggggttttgacattttacttgcactgtttgaccactcgtcctattcaaaaaatttgtgcaaatataaaaaacgaaaaattgtgcttaaagtactttgggtaataaagtaagtcacaaataaaataaatttttaaataagatgaatggtcaaacagtgcaaacaaaagtccaaaaaatttttaaataagacgaatggtcaaacagtccaagcaaaatgtcaaaatcccttatattaggggacgaagggagtagatattaagaaaaaaaatattgcagaatatttatgactaataaggagactggtgaattcctgttacagcatgtattcaagatggagcaagaagactatacaagggaggaaatagattggagctatgtggaatttgtggacaatcaagatgtgctggacttaattgagaaagtgagttcctgaagcatttcacaagtgataattgtatctattgatgaataacacctgccaattccatgcagaaacctggaggaataattgcactactggatgaagcatggtatgaatagtcatctttccagaagaaaaaagtatttttatcaagaaactctgcatgtgcatgctgacacctgcaacagttaaaaatattacttcttatgttttgtccataaaaaaacattggggtagtttttcctagcaaaaaaaacattcagtagcatcaaatgcaagtttccatgtgttaccctatgacatgtgcctaactgcctatccatgcagcatgtttccaaagtccacacatgaaacatttgcccaaaagatgtatcaaacatacaaggcacataagcgcttcagcaaacccaaacttgctcggacagcctttacaatcaaccactatgcaggagatgtaagtgataatcagcgaaatgtgatatatcgtgtttagatttaccatcaaggattttgaacaattgttctagtaaacaggtcacatatcaagctgatcagtttcttgacaagaacaaagactatgtggtggcagaacatcaggctctacttaattcctcaaggtgcccttttgttgcaaatctctttcctccattacctgaggaaacctctaaacagtccaaattctcttccatcggtactcgctttaaggtgtgtcatgattgtagccagaggcttagagttatatgaattagccttggaattttctgtaacccttcattttgctacaatatgtgcagcaacaactacaagctctcatggaaacactgagtacgacagaaccacactacattagatgtgtgaaacccaatgctgtacttaaaccaggaatctttgagaatttcaatgtccttaaccaattgagatgcggggtatgatgtgcattttgctccacattgttattcagaagccttgtttttttttgtgttattttactttctataaaagctggaccgtgaaggtcttttgtctaaaaaatgttaaaaatggttaatgctgcagggtgttctggaagcaatccggatcagttgtgctggctatccaacaaaaaggacatttgatgagttcattgatcggtttggaatgcttgcagcagagcttgtcgacaggtatggatactgatgttatgcaaccagattaggggattgagacatgtgaaaaacactcttaactgaaatatgtccatcaaatgttctcttattcttctaaatggataataaagtgactctaatgcttgtacagctctgatgagaaggctgcctgtgcagcaatatgtgataaaatgggtttgaagggatatcaggtaatctttgtgagaggtgaaaatggaatatatagcaacaattcacagaatatatatttgcaactcattgcatgcaaccttttgttttgatcagataggaaaaacaaaggtattcctaagagctggtcagatggcagagctggatgctcgaagagcagaagtattggccaatgctgcacggcttatccagagacgtataaagacacatcttacaagaaaggaattcatcaacttaagaaaagcctcaattcagtctcagaagttttggaggggtatttcttcactgatgtgcctttagtaattcatatcttccgtattagtaataagttctgacttggcattgacatacaatgtaattcaacactgcagcacgcctagctagaatatttttcgagcatatgagaagaaatgctgcttcaatcaggatacagaagcatgcacgtactcattcagccaggaaatcttaccttcaaatgtatgagtcagccatagtaatacagacaggattacgtgcaatggcggcttgcaatgaacacagattcagacgagagaccaaagcttccataataatccaggtttgtagtattattaatttattatgatggcactgaattaactttcatgaaaagcaaccacaatttttcttgaacagaaataagcagcaaccacaattaaccgcttcattcattatttccagactcgatggcgccaacacaaagcttatgttgattacaaaaagcaaaaaagagctactttgattcttcagtgcctgtggagagcacgtattgcaagaaaggaacttcgaaagctcaaaatggtttgtccaattatacagttgaaacccaagttattcttgtgtgtatgttaatgcaatgtcaagtaaaaaaatctgaaatggtaaacaggaagcaagagagactggcgcactgaaagaagcaaaagacaaacttgaaaaaagagttgaggaactcacatggcgattagatgttgagaaacacttgagggtaattcactgtagagttttatctgtccttggacccaaatgaatttgctaaattggctgtgtacatcccttctggatgtagaggccgatttaatccattttctaaaaagaatgagtttgctaaatattgtcatgctgacagattgaccttgaagaagccaaggggcaagagatttcaaacttgaaatctgtgttgcaagaaatgcaagaaaagctttcggaagcacatgcagcaatagaaaaggagaaagaagatgcaaaactagcaattgaacaggcaccaccaaagatagtagaggtgccggtggtggacaatgcaaaagttgagctgctgactagacaaaataaggaacttgaggtataatactcgataagctttaattttactaaaaaaatgattcagcccttttgcttagactaattaactaattaccatattcatgtttgcatccaggatgaacttgttacatttagaacaaaggctgaagatctagaaaagagacttctagaggttcaaaaggagtccgatgaattgtcgagggaaattctagaaaaggactccaaacttaatcaacttcaggagatgatagaaaggtattaattattttaaatatttacataaattggctcgtgcatattacaaatgatacccagtcacggccttatgatatatggtgcaggcttgaaacaaatttatccagcttggaatctgaaaaccaggtcctacgtcaacagtcactacttgcatctgcagatgacgataaatcaaagcaaatagagaggtaatttttgaaatgtttgcactgcaattcttatccactttgtttttgaaagcctcataacttaacataacaaactcttcttctagtctggaaagcaagattgccatcttggagtcagaaaaccagttgctccgcagtaaatcttctgtagctgttcaagcagtaattactcctgaagtgattcagccatcagcaatggaggtataatcctgtcagtttaacattaataaaacacatctcttatctgataagatggatgatatttctgaagtatagtacacagttgcactaaattttctatcaaaaatctcaccagggccttgtgaatcgatatcagcttgaagaacataaaatcctcattgtacgtgtttttatagctctctattacccaacatgagagcaaaaaaaaaacctcagttggacattttatttatatggatttatatatttgctttgtttttttttcaggaggaggtggttgttcctcctataaagaatttaagcaaacaaaagtcgctcacggatcgacaacaagtatgtttcagtgccttcaaaatttttttatatcaatgcaagaaacaagttccacgttcttagttaacaggcattgtgcacattcaaaataatttttttctcgatttggttttcctgctctttcacaggaaaatcatgatgtcctgatcaaaagtctggctgaagacaggagatttgacaacggcagaccagctgcagcatgcatcgtgtacaaatcactcctgcactggcactcatttgaagcagagaagactaacatatttgaccgaatcatccatacaattaggtcatcaattgaggttgttacttccaaaatactatataaaactttccgtttgcagtgacattatatagttggtgagcaagctctcatgaaactcattatctgagtatttacagcacgctgaaagttctacagaactggcttattggctgtcgactacatcaactcttctctacctattacaaaatactcttaagtctagcagttcagcaggtaaaggatcaaatcgcagccgaaccacaacaggcaacctgttcagtaggatggtgcaggcaagttctttatccatactcatgctttgcgtaaagcaaggttctttattggcattgcaagtcgaagttttcaacatactttcgtactgattaaccaattacttatatatacaccacatcaacgaccaaagtgatattcacaacataaaaatgagcttacatcccaaaaattgcgtgtcagaatgctcgatcgtcgtcattaggatcaggcatatcaagtggatatagtggaatggttggaaggcctgacactgcatcaaaggtagaggcaaaatactcagcactacgtttcaaacagcaattaacagcatatgtcgagaagatatatggaatgatcagagataacctgaagaaggaaataaacccgttcttgattatgtgcatacaggtatgcaccccagacatttccatgccaatcgtgaatataaggcgatacaatttcgttaacaatttgtcaatttcacaggctccaagggctgttcgtgtgagatcatccaggggatcgttgaaaagtgtacattctaattcactatcaaggcaaacatcaagtgtgcattggcaaagcatcattaagtgcctgaaccatacactcgaaacaatgaacaataatcacgtgagtatggcaataattgttttcagttgtcccatgatcagggagttttccttatgaattatctattcgtaggtacctccaatgataatcaggaaaacattcaatcaagcatttgcctttatgaacgttcaactcttcaataggtatctcaccacctctaagtcttgtaaagtaacttcagttaactctggttgactacacaaagtcatatgaaatatcattagcatatgggggaacaaattggttgattctggactataacaaaatctataccttctcattcagtttgctactccgtcgagaatgctgctcctttagcaatggggaattcttaaaggctggtttacaagaattagagcagtggtgctctgtaacaactgaagaggtgaagtgaaaattgtgtataattttgtttggtgacaaatgagtaaaaggcaaggaagtatttgaccaaatgcgttgtgataatgcagtatgcaggaacgtcttgggatgaatttcagcacatcagacaggcagttggatttctggtatgcttgaaagttgaaaccaattattttcaaattatatagatgtttggttagcatcatgtgaattcgcgtgcaggttttgcatcagaagacacataaaaccttggaggaaatcactgatgagctttgcccagtaagtcctgaatatgactaacttgtaaatacttgaatttctgcaaaagcgtatagtatgaaacgtagtgccactttcccaggttttgagcatcactcaaatatatcgcattggaacaatgttctgggatgataaatacggtgcacaaggtctatctcaggaggtaagttgcaaacttctcaatacttaggcatatttcccttttcaactacaatgactacttccacgcaaaaaaagtaaagaaataaaaataaaatcttcatatgatgtgaaacacaccaacgtggtttcaggtcattggaaagatgagaacaatggccactgatgactcaataactactccaaatagttcgttcttgttagatgacgactcaaggtatgaatatgattggctgctcagtactgctattaagatatgaacctaaaatgggagaaacagtagccattgatctaacacccaaactgaatcaaattgcagcatacctatatcgttggatgatatagcacgactgatgcttgacatagacctatctgacgtggaaccaacaccactgctcaggcagaactctcagttccactttctactgcagcaccacgccacacagactgatggcattgtttgttaatgcaaagttgaaaacataattaaacaggttccgctattttgtgaagttcctcggtggtgatttcccttttttttatgggagtgcaggcttgccttttttttgttggcaatttcaggtgggagattttacaagaaagaaaaatatagaagatttttttaccattcttttcatttgttctgattgtttgaaagaggaaaggttgtatttttaatgtaaaagtgtacaagcgaaagtaaatatatgtatattttcagctaaacctgatgtaaaatttctgatatgattgtttctgtgtgtgtgattgtgagagtgtgtcaattcttaccattcttcatttactctgattgtttgacaagatgtatttttcgtgtaaatttgtacaaacgagagtatatttatatatatgtatatttcccccaaccaaatatgtactggtagagtggtgcatttctggtatgattgcctctaatatatgtttagaaggtaattttttcatccttaaaaaaatataatgaaagataccatattgtctaatataaaacttaatatttttatatatgtatctaacttttcaatataaaatttagatatgttgaggaaccataaaacttttcatgtttgggacacaatttttactattaccaactaacagcgtagtatttcagagttgaactgttcagttcagagttcattacaaaaagcaattcctctggcgcacacgacagagtccaatcacatgtggactcaaaaaatcattcacatcacaaccggaggaggaggggtcgagaagctcatgggcggtgcagctgccgccggatgcttcggtcggcgccgaggccaacccaggcccagccacaaccaaccacggcaagcacacgtcgtaggcggcgtggcgctggccgcatgcgcgagaaaagagagaagaaaaagaaaaaggagagatatttgaagggggggaagccgcgagaacacgctgaaccaacaacgctcccccgtcgccgtcctctcttgttcattcattccaggccgacctcactgacgaccgcccgttcttatcctctgaagcgaagccagagcggcaggcacgcagctgctacaacaaatgcatctcctaccaatttcgtcctaaattatactattaacttacacatatttgtattttacaaaaggtgaagtctattttaattttattattgttatatagtttaattaagatgaaattcactctaagagtttgtttggatatatatattttttaaaaaatcatgagctgtagttaggagtccgatcatctcaagttagcacataagttttttaaacagatttcttatatgattccttatgtattgacaaaagtaaacgatcttaaaaactaactcaaatacatatatgtatctccaaaagcaaacgaacttaaaagcctcatcatacacggatgatgtatcaaaataccgccaaaaacatcttcaatttttataatagtagagataacttacataaccaactactggctccaaatcatctatatccgattcatacaatagttacctataaacggagtactacacaagtcatagctggtcccatatgtcatatacacatgtattttaaaaagtttgtattgcagttggctacaaatatatagcatgttactctcctctatcttattttatattagtctgctattgtacctgctcttagatagtttgttatattttaaaataaatagtactaacgcatgagcacatggaaacaaaggaaacaaagttcaggtccacttctttattcttttataatatcattttggaatttactctggaatgcctcttatttgaatatttctggaatttactgagattacctcttttcatatttttcttggaatttactctggtccacgatggcacaaaagagtttttcttttttttctctttaagaatttgaattgctcaggaaaattattattatgttctttcttcatttctctactaggcatttcaattctggtcatattctattattacgatttctatcctacatgtcagtcaaaaatcgattatacagtatagtatggatgcttatgacatcgtccaacagagtttgccttctctaataaaaagaagaaaaaaaataaaggtttgcctttgttatggtgtttgaacagtcttttgtaacaagaagaaaaaagaaaaaaagaaccttgtcgattctctgaatattcatgttgaattggagttcggggcaatatacgtggccgtgaattgatggatgataagaagacaaaaacaactgagatttttcgtcaagcaacaaacatcttccagatatgaacaaaaattggacctttatgagtatggcagttgaacgagcagcatagcatagcagtatgggcctgattgggtcatgggctggcccaatggaagctagggtttctcttgctttttgtggaagtaatttaatagggggcaatgctatggccacacagccactcccactttgtaattaaaacacactacaaaactgggatgtttggaaatacctgaactgaaattgcaagaatagtatgattatggatgatttattagccctggatgatttagtttgctccactagccactgttaaatttattccctcaatgcctaactacaactatctttaacttttattatgacaagtagatatattgggataggatttccctaaaaattgtgagccacctaaggctgtaatattcctagtataaaaaaacacatttattggatgtgtatggcatgccacaaacttaccaaaactccgttacgtcttcttccatcctagtacactgcaaaaataatgactatagattatcacggacgcatttctcaattttgtaaacaattttgtttttacacaaactttcttcctcattccaccttataaaaactctttaaaaattgacatatcaacttcctaacatttaatcaattaatttacgcccttccataacctattacatctatcaatactttcaacacatgcccagatatctccctaagaactactaccaccaataatagaaaatccttactaccaccagttgtcatttatacatgacacttctgaccagtaaatcaactagtactacatttttgcctcaaacattggctgtgtttagttcaacgctaaaattggaagtttgaagaaattggaataatgtgacggaaaaattggaagtttgtgtatgtaggaaagttcgatgtgacggaaaagtaggaagtttgaagaaaaaagttggaatctaaacatgaccattatgtcgtaataacaacatatattatactccttccgttctactccctccgtttcacaatgtaagccccctgttcgtttctcatgcaatctgaggataaaatagatactcgtggcacgtttttcaaactgctaaatagtgcgttttgtgcgaaaactttctatatgaaagttgctctaaaatattagattaattcatttttcaagtttgtaataattaaaaattaattaatcacacgttattaccacctcattttacgtgaaatacttaatcttcatcttcattttcatctttaggagattcaaacaccacctaaatcattctagcatttcccacattcatattcatgttaatgaatctagatagaacatgaatatgaatgtggtaaatgctagaatgacttatattatgaaacggagggagtatagactataaaataaggctgtgtttattggttgaaattggagatgatgtgactgaaaagttgtgtgtgtatgacaggttgatgtgatggaaaaagactgaagtttagatccaaactttggatccaaacacatcctaagttaatcattaatacatgagacaagtagagttgggagagtaatgaaacacttttgggtgggtgcccggagcagaggtggggaagataaacgagcggtggggatgtgccgggacaggtatttgaatcaccgcctctgaatcgcctaaaaccccccttctttggctacccctccccccgtctcctcctcttctcccctcccccctcgcgtctgtggcggctatcttcgtgtccctctccctcctcctccccctctcctagggtttatccaccaccacctatcgcctctacctaccacaagaattttttttaccatctatattccacccctgccttctttgccccccgtacctcctggaattttcgccttcttgggatccaatccgcgaggagggaaagaaggcgggtttagatcgaactgggacggagggaggaggaggaggaggaaccatggcggccgttgctcctggcgctggcgaccgtatcctttttatttttgttttctttgatgtgtttaatctgttttagcagcggggggttgcggtttgtgcggcagttcttcgtaaagatttgaacttctttttttttctggggtgataatttaaacagcctttttttttctttttctcgtgttcgaatcctatggctgtattattgtttagttgctcgcttttgaatcgaagtgtttcttccttgattcgcaagctacagaggctactgacatgatgcagaagctgtcgttggagagcaagaaggaaggcgccacccctgacgctaccaagaaggtagcttttgctggcgattcttgtctgtgatgtgttgcttgtgccatcctttttgtttgtttggaggagaggtagctaaaaattatggtcctttttgtgaattgcagcctgccgggatgccctatggatctgcaagcgccggcgatgcgcagaatgcggcgtcgccggtggacaggtcgatcactcccctgctccaggaggccgtgaatgccaacatcttgtatcagaccaatggatatggaccctcagcatattactatcctactggtacaaacacctagtactttgctggataatcaggtagtctaattaagtgctgattttaatgtttgtgcgttcgtgtatataggttatgacggctcagccaatgaatgggactccagatatgctgcccatgatggaacggagatgcctcctgtaagttaatgcagttatttatagttagttcatcactttgcgataggtattttaaggtgtaatgtgatatcacgagttcacctgtgcctagaggaggctaaggaccaaatatggagatagaaaccgtgggggacatatgttgttaatttggaatttaatgaattgcttgtctactcatgctatgtgttggagataaattaactcgattctgttacaatgatccagcagagtgtttatggtgacatgtatggatatggctatgctccctatggcccatatccttctggttctcctgtcccaactgttgggcatgatggccagtcatacggcgcacagcattaccagtaccctggtcaatattatcagcaaccagctccaaccaatgcaagccatggcgtcaatgctgtcaattctcagtctgagatgccctctgttgctgctcaccaggcacgtgttccggttgaatcagcaaaagctagtgccaatgggactgctaatgggatggcaaatactaacagtagttcattagcacgtaagcaaacccatcaaaatgtatcagtattaaacaatggttcatatggaggagggactttgcaaggtggaccatctgctaacaattatggtcacagtggtcttcattctccagttcagtggtatgatgggccagtctactctaatgggcatcagagatcaaatactaattccacatcttatggttctaactcgtattcagcaaaaaatcagagccagcgcccaactgcaaacctcatggtatgttctaggactgtccaattctccattgcccccctccttcccccactcttcttctttttccatagcttctcaaagcagtatgattgtctcacaattatttttttttctgcttattaaatgcatttacctagtattagattctgcgattactgccttccccttaagttgcacatagcaaaaatgatagtgatgcattatgtggctctcacaaagtacaagtattagcctaaaatatccatttgtttcagggtatgcatgcacagataccttcgtcgggaatgggtttgacatctcctagttatcataccaggatgtacccagacaacagattatatgggcagtatggtcagtatgggaacgcacttaaaactgggcttggtttcggatcaaatatgtacaactccagaaataatggacggtggggaattgttgatagcaagtacaagcctagaggtcgtgcatcttttggttttggcagtgagaaccaagatggcttcactgagcttaacagaggaccaagatctggaggattcaagcaccaaaaacagtttggaccttctgtcactattgctgtgaagggccaagccctcccctcagtcgggaaacaggagaatagtgccattccagataagggccaattcaaccaggaaggttttccagtaacatacaaagatgcaaagttctttgttatcaaatcttacagtgaggatgatgtgcacaaaagtataaaatacaatgtgtgggcaagcactcctaatggaaacaagaagctggatgctggataccgtgaagcgcaggagaaatccagtgaatgcccagtcttcttgttcttctctgtaagtattattattaccacattatgtgatccatttgtccctcatatcactctttattgacattgggcatggaatataggtaaacacaagtggccagtttgttggtgttgctgaaatggttggtcctgttgattttgagaagacagtggattattggcaacaagacaagtggaatgggtgttttccaatcaagtggcatgttgtcaaggatgtacccaacaacatcttgaagcacattacattggataacaacgacaataagcctgtgacaaacagccgtgacacacaagaggtatcctttctcaataacttgccaagttctgttgattgtacaatggtcaattgcaggccacgggccattaagggtactattaatgtctctgttattttagatagttaatttcatcgtcattttcttgagataattcaaatttcttgctgtggaaccagattagtcgttcagtaaatgagaacttaagacatgatatatatcaatttcttcatcatgcttatggtcatgagtggaccttcatgtataagaagctgatgaattttatttttatctattgatatggcatgacaatgtgatgatcctttcagtatgctccatgtgcgttacttaccaagtagatgtaatgcttcaggttaagcttgagcaaggtcttgaaatgctcaagattttcaaggaccacatcagcaagacatcaatcttggatgattttggtttttacgagaaccggcaaaagctgatgcaggagaagagagctaagcagcaactgcttcaaggacaggcaagcattctattcacacatagagccttgtgtggttaaaaaacctgttcagaatgttagcaccactcagagctattggtggtgataggttctgatgcctctgtttttatgcactttgtacagggctctcttgacaatgcttcacatgaaaaggagaagaatgcaattgatgggaaatccacagctcagaagcaggcattgagcaaggagggcacccctattgtcggcgaaatgctgaacgcctcaaaatctgcagttgaaagcagtgtaacaaatggcaattagcgcgatatattttctgcgttaattgccacagccgagcagtcagattgtgcaaattctgaaggttcgcggcgtggctgagcgatagctacttgggttgggacttggcaactaaatttcgtaacagactttctataggcttggtgcctggggagtgggtcagttcttactttgattttagctcgtgtgactggttttttgcgtcgttaggtctcatatattactcttatgacatcgggttttatgtaacccttatcctttttgttttttttagccttttcatctattgttattgttagcgaagcatccaaatttcgataaatctgaacaacagtaaggtagttttccgagttttgcagcactggagaaggtaataagacaagaactctggttttggttggtcctcccttgtgttgtgtactatctgctttcaagtgtcaatgtgccaaaatggcatcaatcatctcgtgcattttaggcatccacgatgtgcatgagaagaggtcttactacctactttacaattggagaaaatcctctatatatccttgagagagatgctctgaattttgcctattcccttatatactctcgagttttcattttgatcttctctatgtaatcgttaaatgtttttgaaattaactatataacccctctcttatacctgtgttagtttaatgataaaagcacaattcttatatggaaaaaatctatttgtaaataaacaaagggaatataattatttgacaacaaattttaaaaataaaaaaaattaaattaacttttatgatatcatcaaaatttgaacccaacaaataaataattttggttcacaatttcttgctaaaactcttctatggattttgtccaaaaaaaataaatttgttcaacagtttaaattttctattcaataaataattatgtcccatttgattttatcatgaattacaatttttcacattggtgaattataaagtagagtagatagcatataactgtaagaatgggaaatggacgatagggtcattttagaaaaaagaaaattaacaggcaactaacataatagggatagaggagattaaaatgaaaagttaaaggtatataggggatgagacaaaattcagaggtatagaaaagattgcgaaacttttcagaggtatgtggaaatttttttactattgtggaggtgggtaccagaggatgtagtaattccatccggcaagagcattactagtacctggtaagaagcaataaaaaacacttaactctctactctccctttttcaaccaaccaatgttttagacgtgggccctagcttactactatctacacattgtactccctccgtcccaaaaaaggtaacttagtattggaggtgacattttctagtacaattaatctggacataaatttatctttttttcgacggagggagtaggagttaggaataactataacctagtttcgtgggtttcatcttagagcaagttttttaatagtatagtcaactattagctccaaatcatctatagttaatttaatagccaattcatacaatagttatctataaatatatattacactattaatatatggttccacctgttatacacatattatgtcttgtagtcagtactgcaactggctataaatatgtagcccgctgccattctcttttatgtattatctcctcgtatgtgtttatagctggcttataatctagtattgtacatgctcttattgggcctgtttggtagagatttgctgcggctgttcagctgcagcagctacaatatagcagtagaaattgcactgcttgtactgttgaggcagtgcagctattgccgcagccggctgtagtgtccagctaacgaacagatccattactcacttgatcatttatacatcgaggatgccatagagacgtcctgtatagcctttttctccatgagaatcaaaatctcagcagaatcaggacctgattgtggctctgttagctgctggaggttcccaatcgtggaatagtgcacgtggaaatagagcagtccattagcgcgtgattaattaagtattagcttttttccaaaatggatcaatataattttttaagcaacttttatatatatgctttatgaaaaaaaaacacaccgtttagcagtttgaaaagcatgcgcatggaaaacgacaggcaatgccgaacacagtcaggttgacaaaggaaagggaattgagcatattaaaactccttcctcttaacacacatggactatatttatttttaaatttattaattttcatttgtacaccgacttctgaacttacaaatggaattacaattccagttacaatcacagggaataagcaatacaaatagctagagttatttacagagtctgctgtgcacatgtatcatgtatggatattgcagtgccaaactcttctcgtttctgacgagttctactgacacctgacctgatcattgtcctgatcgggttcacctgcatgtgatctcaatcgactgacatcgttccacagattacaagttcatatatagatccggcaagatttttcatggctaaaaacagttcagacatcgattccccataaaaacaaagaacagttcaggcacacgcagagtggcagatgcagaactcggaatccgtcggaacatgacatgttcgattgttcaggcctcccaaatcttaataattacgtgaagtgctaagtatacttataattagtagtaatataattagcagtataactagaatgataaagcccataaaacccgtaaggtcagaattaaggcttagaacgaaaagtaaaataacacaacatgcatgcctaatacataaagttaaatctactgaactagatattattatgttctatgaatcattgtgattgaccatttgttcgttttttcccgttctaaaagttatatcttgtcaatcatgataacaagaacgtggggatttgactgtcaaattttaagacctcactatgtatttcgaacaggaccttcaaatcctagctatgacgcggccccttcacatgcaaagctctaaccttcgtcaaggagaggctctacactgcctagatgagaagcaggtatcaattcactgttgcacaaaagataaacctgccaataaacaaggcaaataggagtattgaatatcacgcgtgccgatttcaccatcggaaggaaacgaatagaaaaaaaaaaggttcataatgtccaatgtatgttgaacacataattgtgtgagactgttaattactcactacatcttaaaatatgtacgtttgaggttttgcacataaatttaaaaatagataaaattatagagaggagggttacggttaatcgagatgaggaggtatgtgaagaataactatattttaagataaaaatttaaataaagatagtgtgtatatataaatgtggaggtgctaatgcaagatattgcatcgtaacttcagtgttagatggggaaccgcctatgacaggctggtttgcatgaaatgcaataaatttaatggacaacagtacacatatagcagcagattgagattctctaacttaataaatttaatggacaacagtacacactatagcagtagattgagattctctaactcaattatttcccactgacgtgggtcactgacacgtggaccctctacccaacggacccatacatcagtgactcaaagttagaggagaataagtgagagtatccttttcagtattcgtattggagtctggaaaatgttctcagagctgcagggaggacatgtccaggttagaaagcatttgtgagatattatctcccattcttatagaggtgtactcctgtatacctctttatacttgagaaatattttttctaaaaaaaaagataccaaaactaatctaatatattagaataggattgagaactaattattttttaatttatcttacattttgaggcgtataaatatttgtgccaattaagatatatttttagtggtatatctagaggtagagatacctctggactaacgtacacactataaggtatatatataactctcatacctcaacaattagaaaagtcttgtcattgcttatcataaacttgtttattaatcaaaataattagtttaatttatttacatctcaaatgcagtgcgaaggtatatacgtacctctccaaacataggaaagaacctcaagctaccaaccgatggttccaccactagctaaacaagacccatgtggaacagaaagataaataaccttgagcaacctcaaagtcatttagtatgagaatattttcagtcacataccttccatatttccaaataaaggattgctaggtttaagataggaactgcaatcaccttttaacctagcactgaatttggaaagacaagcaggagggtaattcactagcaatagcgatagtggcatgaacttccaagtggtggtagcgatgactttccagctatgacgatggtgtgttggaactccgatagagaacgtagagtttaggtttatgggtttggggtcaaggtgggagaggggtttgggagaggtggaaagggtgtggccaatgaacacgggaggtgaggtggtgacgaaaccacgactatagaggagggtgctggacaatgtcggtagtaggaaaaagatgtgctagatcctaattgttaagaggtgaggatagtgatgacttcccgatgacgggggaactgtcgaaaatgaaaagcacaatagggccgagtcacctaactgttattgggcttttgggaggaggagagaaaaaacaagttgagggtgatactgtaattgtatagatcttagtgcaataccagtgcgagctactcaaaataatggacctcatgtgccatgtaggccgagatcacacctcctctcccacaatgcagagttgctcttggagtgttttcaatttttcatgtcaacccttgccatcttgtattttagtcctaatgtgttttcaatttacataaagtcaaaaatttagcacgcacacacctagggatggcaattgtgcccgtttgcccgtttacccgcgggtaaaaaccctattagggttgggtttgttctccattttatacccatgggtatcttattggttcaaaagctatgcccgatgggtaaatgggcatgggtatgggtaatcactacccatgcccgctttgcccgtttacccgcgaaatctaacttacatgtaggctaggagtaaaatccactagaatacataagccacgttctttgttttctacggtttcccttttatttcccttattatttctctcctcttactctatcgccgccagaggagagacacgacaccgaggtggagaatatttgatgttttaagttcgattcgaagttagtagcttgtagactttttgttccactgcttttgttgtggcgggtaaacgggcacgcccgcgggcataaggcgcccgcgggcaatgggcatgggcaaccatccttacccgtcatgtagtaatgggtatacccacgggcacaaataatctcacgggcatgggtatgggtaggcactacctgtgcccgtcacacccgattgccatccctacacacaccctaatttccagaagcaaatataaaatctctcccctctactctcctcaatccaccgatggcagccagtggcaaacgagcaccaactgacggctcccctactccacccaccatgatccactagaggccggcgatatatagctccatggtgcccctcctctctcctcgcagcggcgacgtccaaagaggctgggaacgcggcggcggattgagtaggccgaggtggtggtgaagccaccgagtagcgggggttggggggggaggacgacagctccatggtgcccctcctctctcctcacggtggcagcaaccaattaggaggctagggacacggcggtggcggagccaccaagtggaaggcgacgtgacgagctcggtcgggaggggggggagggagaggacgacgacaagctctgcggcgcatgccagtgcccctcctctcccggcccgcgatgaggagacgaagcccctcctcaaaggacgacgacctcgacaacagcggcgtgtgcgctcggctgccaccatcatcgcctctctcctctcaagcgttgaggaggagcgggattcggcctagagctcgacggcgccgcctggatctagccaaaggtcagcgacagtggctggcaacttgagctccaccatagccaactctctcctttcccgcgcctcagcggtagtcagctcgctggggcccctcccctcccagccgacgacgaggagatggggcttgagggctcggagggcgacggcgacagcagtaatggagctcggtagtggattggcgtcctcctcgtcgtccattgccggctcccctctcttctcctccaaggatggggaggtggggatggtggggattgttgcagcctcgcagtaagattccttgtttttcttagctttttcagctgaggctctcggctctcaagttagtcttgtgttacccacgaagtaatggtctctcaccgccacgatagcatgctatcctacgtggtgagccgtggccatgctccacgtaggaacactgtgaagggccacacgattccaaaaatccaaaagtaactaaattttgatggcattttcatgtgattaaaaaaatagacaacaaacagtcctttccaaatataatcaagagctagcgatcaaagttctggctggaccacacagcatacatgctgcacaagtgcacagtctacactacttgtgcggatctacccactcggccactcctgtctgtagtgctgtagtagatctccaatctcaatcgagaaaaggccatcgagtcggtgagattctttcacatatatagttcgccgtgaaagtctatttatagtaaatccggtgcctatatatacgtcaaatcaaatcaactatcagtgtgtgagctatacacactgacagtgtagtgtgctgctctcctagctagctagagaacgccacacactggactggactggatggaggcgtcgtcgaacaccaacgccatggccggcgtgatggcgccgctgatgctgcacggccgcgtggcaattgtcaccggcggcgccggcggcatcgggtcggccgtgtcgaggcacctggcgtccctcggcgcgcgcgtcgcggtcgcctacatcggggaccccgcgccggcgaacgagctggtgagcggcatcaacgacggctacttgcgcgcggaggaggaagagaagcgcgggccgcgggccatcgcggtggaggcggacgtgtcggacgcggcgcgggtgagggcgctgttcgacgcggcggcggcggcgttcggcggcgagatccacatcctggtgacgacggcggccgtgctggacttcgcgtacccggcgctggcggagacgagcgaggcagcgtacgacgccatgttcggcgtgaacgcgcgcggcaccttcctgtgctgccgcgaggccgcgaaccggctggcgcgcggcggccgggggcgcatcgtgacgttctcgtcgtcgggcgtcgggtcgctccggccggggtacgcggcgtacgcggcgagcaaggcggcggtggaggtgatgaccaagatcctggcgcgcgagctgcgcggcacggggatcacggcgaacgcagtggcgcccgggtccacgggcacgccgatgatgtacaccggcaagacagaggaggacatggcgcggtacatcgccgaggcgccgctgggccgcctcggcatgcccgacgacatcgcgccgctcgtcggcttcctcgccagcgacgccggcggctggatcaacgcccaggtcatccgctgcaacggcggcactatctagctaccctggcctgcgcgccaaaataaatgatttctccgttctaaaatataacaacctaaaataaaaaagatatatcatgtactaaaaatttaaacgtaagatttataatattagaatatgtcatgctagctaggttgttatatttgaaatattttgaagtagattttctggctatgaattgcattatcctggtacacgttgtgctcttaccttcagcttgggagagttgtgcgtgacagttataaacagtatttgtctgaatgttctggtcaccttatgagcacctgtttgttctctgtccttttggaatggttacttcggttttgatatactaataggtgacgtttttaactttttatttgtaacgtttgaccattcgttttatttgaaaaattagtgcaaatataaaaaaagataagtcatatgtaaagtacttttgataataaagcaaatgacaaacaaaataaataataattccaaatttttttgaataagacgaatcagctaggaccatgtatcctcgctactttctccgttttacaatataagtcattctaacatttcccatatttatattgatgttaatatcaatataaatatggaaaatgttaaaatgacttacattgtgaaacggatgaagtatatcctttccgtgttcgtgtgcggtgccgaactgccgatgcgatgcatccaatagttgcgctagctacatgctaaaattcgtcgtcgtcgttgtaacttgtgtttgttcgttcaatgtaagagtggtttcacggtactctataagtaccatgatttttacgctataaaatacgataatcttccggttaactttttaagaaccaaaaggatccacctaataattattttagtaaactgttaaactactataataattgatgactagttgagtagaaaggatcgactagactatttgaaaacacattatatatcggattgtcgtcacgaattatctacttatattcataaaagtagattaaatattttttaaaaatatcttgacaaatactcttctgtcccaaatataatgagttttggttgtattagtttagattggatgggttggatgagacatgttttagtaatataaatctagacagaccatatgcccaaatttatagtattaagatatgccacatccaaccaaaacttttttacattttgagatggagggagtactataactagtgatgtactctctccatctcataatataagggatttggacggatgtaacacatcctagtactgtaaatctggacagactatctgtccagattcataatattatgatactccctccatccacaaaagttacacctataaatagatttgagttttttccaaaaaagttgttcctatttatagtctttatatttttttcgacttaaatgaagagataaattaaatgttttattagaacccaaagagtcatctaaatactcattggttgtatgcttgcattcacttcttgattttggttgtatgcttgcatttcctatatttatattgatgttaatgaatctagacatatatatctatctagattcattaacatcaatatgaatgtgcaaaatgctaaaatgacttacatcgtaaaacggaggaagtattagctaaatatggacccacgtgttatcatgcacacgcccacatcacgttcaaggatgcttaaaacacttggagacattattgtattgtcgatgttgaagcaccttaataacttcatcaatttcaatatatactggctcaatttttaaaggtgttcttacgaaacaaagatagatgtaaagtgtgtgtgcatattcatagggatgattgtgtgcttgtgtcaaaatcaatagtctataatatctttcataaaagaatactcaaggttatctgaaagcatcctcatcatctatggttctgagttctgacttccgagccaccgtcgtccctcgctaacttcgcatcatctcttccgccacccaccaatagattcacgtttatagtccaaacccaccaactctatattacctagggttgaaaaccgtcaaattttgaggttctgaagttttacttgggatggaagtagattccacgtaaaacttgaatggttttcaagaattcaaatttgaaatagtaaaattcgacctaatttatcaagatctggtgaaaaatatcatacagatcagggaacaggaaaggcccatgaggcctccacccgacggttcagagcccacagaaccagacaagcccactagcccagtggatttctctgaaaaaaaatgtttttttgctagccgccgtcctccccgaaaccctaatccccaaatcgaaggatcgggagccgccggattggtcctcaaatcgaccccaaatcgaaggattgagccagggacgccgccggatccgtcctctaatcgaccgccatggcgatcgcccgcaccggcgtgtacgtcgacgactacctcgagtgtgagattgctagctcccgtgtcagaggccgtcgaatttttttttgcggttgccttcgatttgcttctgtttattggctccatttcttgtcgcagattcgagcacgctggccggcgacctgcagaggattctctccaccatgcgcgagctcgacgagagggctcatggtgatgatcttttttacactcctttttcatttttctaaaatacagattatccaaaaaaaaatttaaaaaataatcattttgggtacttctgatatgtagtaatttttaatagttgatacaaggctataatgtcatgtgattgttttgtatagggctagtgcccacttatagattaaatttatgtgatattgatagttttctcaagtttgtagttgtacggattatgtttctgttgatgcaggcattatgggacagaccaaagaacagataaagtatctactcggagtgccatcccatgggttcgacaggtcaaacatggatgatgatgaatctgcctcagagagaatgaaaaaggacatcgaagctagtcaggacaatgcgttgagtctctgcaccgagaaagtgttgcttgcacgccaagcttatgacctggttctgcatgcacccttcatttttttctagtcccgtaactcaaggaacttgtacatttcatttcatgttaagtgccatcttagttgcccgcttttcttttagacgagatcttagataccctttaattgatacacctaaacaaacttgatcgttctatattaaagtccaaacttattttgacagtttgcgtttgtcaagttcaactccagattccataatgaatagttacgaacttagaagtatcacacaggaagactaatgtttgcagtctaaaaactctgttttgttacaattacaaaccactaatagtatctggcatcttgagattatctcatgagatttaatgaaaagcctgatgtctgtcatactgtgttatgtctcatactgcccatatactaaattgaatgttcggatgcctgacactaaattacatcaatgctagaatcatatactaaattgcatgtcctaattctagaatctcaattacattatcaactcactgtgtcccattcagggacccagactaacgaaacaaaatccatttttgatatttgttccaatttgtgtcatttatatcctataatattttgttaatacctaactgtaagtaccatggatggattattgtacagatagagagtcatatcaaacgtctggatgaagacttaggccagtttgcagaagacttgaagcaaggtataatcaagagatagtagcatttaggagcaattgtgtttttgaccctgtttttttcaagtttgctcatttgaccctcttttttcaaaaatgaagatcaggcatgaacctgtttcatgaagacaacctaacggggttaactcagggaaaaataccatttatatccttgctcatttgaccctaatttctcaaaatcttcgtttatttgatccaattttttttaccttatccctataaaaatgtgatggcaatttttgactaaaatatgagacaaaattgacacaggtttgacatatttgacttagtttaacaaatttgacctagatttgaggctgaaacgggaaaggccgatactgtggtcttgtttatttttccaagggcattttggtcttgttcattctctaaatgcattttctaataacactcctaatggtgtggttagaagagggtcagacggcaggttcgtttttgaaaagtggggtcaaatgagcaaaattggaaaggaagggggggggggggcaagttggtagttagccttcagaatagggtctgaatcacaattatccctagcatttacttgtatcttagaaaggtcatcctattgagcagaatattgttatattaatgagctgatctcatttgcagaaggaaagatacctccagatgaaccatcaatccttcctgcaatttcagcatttagcagggatgacaaacggaggcctggtttcagtacacctcaagcaacaaagaagttcagagagagggaatgggacagggaaaggggtatggacttcgacttaatgccccctccaggtagcaacaagaaaacaactgcacctatggatgtggatcaaacaattgatccaaatgaaccaacatactgtatatgccaccaggtcagcttggaatgtatagcgattttcctggaaattagtctacatcaaactttttctaagatgttttctgaaaggtgcctctgcttcttattgatatttcagatttcatatggtgatatgattgcttgtgacaatgataacgtaagtctttatggtgctaagtaatgatagttttcttttggaggagtttaattcctatgttctaagttactactttcacttttatcaggtagttttagagaagctttagaacattctgaagtgtgatttttgttgtgattttaattattatttcaagcaatatagcattggatccatgatgttgtggctagactgctagggtggcggtgatcatcttatcttatgcttgtaatttccttttaccatttgttcttacttgctgccatccagaatgaggacatgcctcactgcttaggggtgatcgtttggctgatttggtcagttataatattttttacaccgaatgaattatatatttctgttgaacaatctggaaaactgaattagcggaataaaaaatagaaacagaacctgattaactgaataatactttggtcagttcggtcaatttattcagctctactagaacaaactgatagtaattacacattgtccatcatgtaaaaataaaatgccaactttgcagcgaatgttgggctgtagccatgggcagtcagccaatgtgggaagacgtcagatgttgggctgcattgcgaatccacacaccacataatcattaggatccacgggtgtgtatatatatattattaccatgtatactgcagcacagaattcttggttgattgtgaataaaatcctcgaaggatcgagccatgcatggtaggtgcaaaattcacgacgtcagtagcttagaaagttgattgcatgttagtcttaggttattacgccgcttcggtctgcaaagcctcgaggccgacagaataccagatcaccgaagcctgtcttggtgatttagccggccatattagcaaaatatgggccgtgtggttcggtttctcggccttttaattttcttgctcactcctatcgctgctttactcttgtcatttagattataaatattgggacgcctcttgcttatatatccttgaacttgttgcaattggcagatgttctagaacttgtcaatacaagttgttttgttcttaatgaattatgggtttgttctacgaaaggcatcaacctatgctaagtgttagctgtttaatgtttctcaacagtgcgaaggaggtgaatggttccattacacttgtgttggtctgacaccagaaacgagattcaaggggaaatggttttgcccaacatgcaggaatctttaatgagaggttctccaaagttggtaagaagcatactacttgccgcttttgctttctacaaatcctaatttgccttatagaagctcttgaattcattccatcttccaaatgaatattcattgttgtagaacagtgtagaggtgtaaaggagaatttacgtcatatgactcaatccttcattcaagtccaaagatttgcttttcagatttttccttttacaaatatatagtgcactagcagtatcagaattccaaattggaatgtcggcctctgtagtgaaaagaatggggtaagttagggggagaaaaagacttagaaaaggcaaagctataggtacaacaaaaatgaacttgtctagagaaacttgctagtcatacatcacataattgttaactaggtcgcatgtagcacattgcagtcaacacataatgccccatctttaaatacttccattgccaaacaaaaactgtttgattaactttgtgcaggaaaaaacatatcaatccaactgtgggatcacaacgggaagccaattaaattgtaattaatcatcacatgatcatgtttgatgtgccagctcatgttatattgatcggatagattcagattttgtatttacgaagtggcctttctatcctaagttcctaactattatatgttggctcaacagtgcgaagcaggacagtggctccactgctcatgtgttagttcggcgctcggagcggtttcagaagatgcatgagggaatcctcagtaatgagttggtccaaagttggtaggatgcaaaatggtgacaactttggaattgtagggtgcgcattacttgacagttaacagtgggttaaggttgttggttcaccaggtttactttagtttgtccatgtatatgcaaggggcaacagtaagactatatatataaacttgttcaaaaatctctccctgtgagacagttgttcttatagtggtgaaatgctttactgctcagtgcagctgctgtagtctcccaaatgttggctaccaagtatccatttccatagttggtgaagcttcatctccactgatctcacatgattctgctcttttgagcatcgcatcttgcataagtagaacaccacagtaatcagtgaaacacatttgcaaacatatatatattgtttcacatgtttttcttgcttattgtgagccaacatgtacaatgaccattgttttgttccccagcagcattgagtcgccagctagcctgtcttgtcttgtctatctagaggtttgggttgcgcaggtactgagcccctgaccatgtggccccaggtgacagcacgatgggctccagcatggcgggccccacgcacacgtaggcgtacttcccgtaccactggtactttgaccccgggctgaacacgtacacctcctcgaaccctctccgctgcacgcaaatggagttcctcctcccctgcaccatcaaacgaatttgatcaaaagttcagatcgaatttgagaaatttatttcacttttattacgaaaattgagctgtcgtgtgtgaattttttgtgtttttttagtaatattattttctttctacctcagtattccttaacacatttcttaaaccgctaaatgatacgtttcatgcaaaactttcttatataaaagttgctttaaaatattaactaaatttatttttcaaatttataataaacaaaattcaattaatcactgataattttctcgttttatctgtccttaattttcatcctcattttgcgaacaccattttggttttggttttacgtacgtaccctgtcgatgatggtgaattggcggggggcgtggctgtagatgcggcacatctcctcggtcatccgcttgtagtcgtcgtcctcctcgccgtcggcctcttgcgcccccgcgccgccgccgccgccgccggagaggaccgcgtcgaaccccttggtggcccagcgccgcgcgagcgtcgtcgccgacgacgaccgcgacatgaagtccgggggcacgatggcgaactccgagagcacgggatctatggcgcggtagtcggagccctggagccccacggcgtaggtggcgtccggcgtgctcacgcggaggtgggtggacaccgcggcggacagagccaccggcgacggcgaggcggcgttcctcgccgtgaactccgtcgccagcgcctccgggtgcagcgtcacgacgcacctcgcctcgacgccgctcgcctccggcggcgcggcggaggccagctcgacctcgatggagcccgtggggctccccctgacgtcgcggagcgaccatgcgccgctcggcgaccacggcggcatcccgtcaccgcctccgccggcggcgccgccgcagcggaggtccagcgacacgccgccgcggatgacggcgcggccgccgaggccctcggcgacggtggtgtggatcacctcggtgggggcgccgtgccacatggccggcttgtaggacgtgacgaggccgcccgggagcagcacgtgcgcggcgctgccgttgcgcagctccatcttgacggcgcagctgccgccgacggcctcgaagctgacgccgtggccggcgaactccgccgccaggtagtccacgttgggaggggcgggtgccgccgcagccgccgccgcgtctgccgccgtcgacgccggcgccaatgcgcgcgcctcaacacttgcaccggccggccgcgccctctggccgccgccggcggcggcggcggctagccgggaagagttgcagaaggcgagctgcttccatgaggtggtgagaggaggtggagtggcatgaggaggagtggtggcagtaggagtgcagaacgccatggccaattcttgcaagaattggtcgagtggcagtgtagccttatctgaaagactgcaagttctctctatctgtacctgtgtgtgtcagcagtgtcttcgggttttgaggttgacatgtgacgaaaatatcccttttccgttctcacgctttttaagtgcaaaaaaaattatatgtgatagttgctttaaaatatcaaatataattaattttaaagtttatactaattaaaacttactccctccatcccaaaataagtgcagccataagtttctgtgtccaactttaatcgttcgtcttgtttatttttttttttttgaaaaaactaaaaaaaataatcacgcataaaatactattcatgttttataatctaataccaataaaaatactaatcataaaaaaattttaaataagacggatgatcaaagtttagcatagaaactcatggctgtgtttattttgggacggagatagtaattagttattccctaatagcccaaacgaacggaaccgaaatgagaaaagaacattgtgatctcggtaggatattggagggtattctttactactacatctcattttattttattttaagtgcagttatggattttaatgtccaatgtttgatcgtttgttttatttaaaaaattaattaaaaatagtcacatatagtacaatttatattttattatctaataacaataaaaataccaataatatttttttctcaaataagacgaacaatcaaacattgcacataaacaatgcaaaactgtactcttttgggacagaggcagtacttatacttcctatgatcaaaatttacgttgctaatcttaccggttcctttaaaacataggattttgaaacacggggataaaaatctcatgccttataaaattcctgcataaaatagtagtcgtttgcataacacgacaaaattataggaattaaagacacgttaaaagaaatccacgaggtgagaataaacttctcaaagataaaacatggaatatagaaaaccaggtctataagatttttaaagttgcattccttcattccaaaggacactacagaaattctaaggatttgaattctttgaaaatcctaaaatatcgtccaatcctaaagaaatgattcatttcatatgattttcaaaggaattttcatggttcatgttttttcaaatccttaaatccttctctcttgtttttcttttgttgcaaacaaggcctaagaatttagactaatggctcctttggtatgcaagatttaaaaatacaagaataaaagaatataggaattagaatgtcaaaacacgggaattactcaatcttgttgtttggatgtttcacaggaaattagtataggaatttgaagagggaataacacaaggaatttttctaagagttttgaggaccctttaaatcatagaaatgaaaaaaaacgaaagaatataaaaaactcaattataatagaaatagaaatacaaaatagaggattgcaaaacgtagaaaaaatacaggaaataccatttaaaaacacatgaattggatgagagagatagactcaaaagaaaattttcaaaaagttgaagctcttgcaaaattttcttcaaattctttataggattgtccattacataggaattttcaataataggatatggttcatttttttatttcaaaggtcttcatagtaaattttcatatatgattgaaatccttcaagatcctataatttttctacaaatcaaagaggccctaagctatggtagatttttttttccaaaattcctataatttaggtcattccacataggaaaaattatcttagaattagaatcctttaaagtttctccaaatatcctttggtcaaaatgggccctaaactatacggttactagcatcattgctgctgctcccgcgacacagatgaattgctctcagattgctctttgttttccactgattatccgtacgtgtgcagctggtagtatatgcggttgtgctactaaacaccacaatgtcacctaattttcagattgggttttacgaggggctaaattctcaatttaaaaaggttgtttatatccgattagatgtagagaccgggtaaaaattattattctctaaataaataaataataataataaatgtcacctaattttcagcccctactaatgcactgaattttcagggatacgcacacagccgcaccgatttggcagcagtgctgatgcgccgcgctgccgctggtccagctctcgcctctctgcactgcgagtctgcgacgcagggagggagcagcagacacattgcccgttaattttcgtcagaaaacaacagcacaaaaataaacgaagtaaaaaaatacaaataaaacttttttatatttatagctgaaaaataaactatcataaaaaataaaaatcaatatttaattgagtttaaaatctatttttagatagtgcgtcgtttcgatagtgcgtcgtttctatcgataaagtaggaattaaaatctaaattttagtttgactgataaacaaaaaccaaacaatgagctgtaaagaagcgggcagataacagtttcttgctgtgtgtgctactgtttgcaagggtacaagagtagcattttctggagggatgcagatcatctgcagcagtactattgataggctgatatgtgagtccggatccatacatcagtccctgctactgcactaaacagtactgtagaaaatcaacattgtttctggagacattgttttcttattcagaattcgagctcatgcatgtgatgggacttagtggaggaaaatgattaattaaaacaacttagtggagaaaaatgattaattaaaacaagcagttgattactttatctatcttttgtgctttttgtctgtaatattgtttgcttagggcctgtttagttggcaaaaaattttgtccacgtatgtcacatcggatatatagatacatatttatattattaaacgtagtctaatgacaaaacaaattacagattctgtcaagaaactatgagacgaatttattaaacctaattaattcgtcattagcaaatgtttactatagcacaacattgtcaaattatagcacaattaggcttaaaagattcgtctcgcaatttcctggcgaattgtgtaattggttttctttctacatttaatatttcatatatgtgtccaaatattcgatgtgacagcgtaaaaaattttgttttggaactcaacatgcccttaatattatactgctggtagtgattcttttgagccgtacaaagcttctaattaaccaaatcgaagttctagacaagttcacatggccaagcctgctcttccctgttctctagaatattccaaggcgatatggtgaattaattttccgcatttttcatatgctcgttgctgaaatctctgtaaaatcaaagcaaaaaaaacagtgaagagatttaccgtgtcaagcaaatagagttacaagtttatacgcgacaaatatataagttgcggccgtgtagagtgtagacccaacattccaacaattttcactattcctcatgtgtctcaattgcataggattattcatcagtgtaggtcagttcccttgtttctctccaacatgtccatgtcatagtggatgcgtttatatttttcaaggaattattgatgcttggaattgaccttgcacttgacagggagcatgaacctgaacatgaacttgcttttccaggtagcaggcgtcctacacatttatctttcttgcaaaaataaagcttggtagacagcaagctatgcttttatctgaaatgttcacgtcttgttctaaagtaattaagtatatttaacatatatttcctccgttcctaaaagatattatttttaacatgacggttaatatattagataattgttacaacacgactacaccaatgcactatcccattctttaacaactgctttccactaaatttataaacaaatataataatgtttaaaataccaaattagttttattaaattagtaattgaatatattttcataatatatttgtatgggttgaaaatgttatttttttataagcttgatcaaatttgaaacaatttgattttgattaaagtcaaaacaacctacaaaattttttcagcatttttgttgaatacatgatattggcatgaacttttaacaattttagtatatgtatctataccgctcacaaatccatgggaaattctcgtaccccccctccccccaacatatcgagtcattgattgcagaccatgttaccagttaatgttatgaaaccagcacaagtcattgaattaaaaaaatgatgctgagaaaatcccatcataaactacttccttcgttttaaaatattactacctctgtttcagaatataacaactttttagctataaatctagacacagttgtccagattcatagctaaaaatgcttatatttgggacggagggagtactatctaacacgtgattgaatttgtccagattcattgttctaggaaatatccaatcacgtgctaggtagcaatatttttgaatggaggaactaagagccatactcaaaatcttgaattacaatatgatgagaagaacgggaccattttacaattggccttttttatttattcagagcatgtacaaatagtagattataaaccaactataatcatactttaaggagacaatagagaaaagaagagcactagattatagacttatagccagctataatatagatttcaagacacaatgattgtatgacaggtgggaccatgcattaataatgtagcatatgtttataggtaactattatatataaattggctactaaattgattatacatgatttagagttagtagttagctatactattaaacttgctttttattactatgattactataatgtaccctcaaagcgtgtagattcacggaggatatttagttagcctgtcctctcacccaaaaaaataaaaataaaaatcgaacccaaatttaaaagtcgtttggtaaaatttattaagatggtaattaaattagttgcgtccccaccgataaattttgccataataaaactgacccccctcgagccgcggtgagggaagcagcagcggcggaaggcgagcgccaccaccaccctctccacctccgccaccaccaaaatccgcgcggcgccgccccaaaaccctaatccgcgcggcccaccgcatcccgcggcgctcagatctagggcatcccccggcgatggcggaggcaagggcgacgaggcggcgggcggaggaggcggagatggaggcggaggcggggacggagggggacgacggcgacggtggcggcagcagcgactacacgtcggaggacgagggcacggaggactaccgccggggagggtaccacgccgtccgcgtcggggactcgttcaagcagggcgcctacgtcgtgcagtccaagctcggatggggccacttctccaccgtctggctcgcctgggacaccggccactccgtgcgttcgaatcccttttgccccccccccccccccttaaatttcctcgtggaatgggcgttccccccttttcccttcctagattcgtgatgatttgtgggaaatctcgacctggatgcgttttaatcatctggtgtattgcgggcggtttcgtttgtacccgcaacctgttcgttttattgctttggtggtatcataatggctaatttcgttgttaatgagtactgttttattcgttaatcccaccatcatcatacacgaaatgtatctgttcttatataccctttgtgtttctgaatttgttggttatatatatgcagagatatgtggcgctgaaggtgcagaagagtgcacagcactacacagaggcggccatggatgagatcaagatcttgaagcagattgccgatggtgatcctgatgactctcggtgcgtcgttaagcttcttgaccacttcaagcactcggggcctaatgggaaccatgtgtgcatggtgtttgagtttcttggtgataatttgctgaccctgataaagtacacggattaccatggaattccacttcccatggttaaggagatatgccgacatgtgctcattggccttgactatctccaccgcacactttcaatcattcacactgaccttaagcctgagaatatattgcttgaatccactattgatccctcgaaggacccccggaaatcaggtgtgccgctggtggcaccttctgcaagaactgatgatcctcctccaaaggcacatgcaccatcagtgaatggtggtctcaccaggaaccaaaagaagaagattcggaggaaagccaagcgtgcagccgctgcaacttcagaaggaagtgggactgttgcatctggggagacggatgggtcagatgataggggaaatttgagtacggcaaacgagggtagtccgaatcaggatggagacaagaaagaagaaggtgaagggagtagacggggtagcaaagggaccaggaaaaaaatggcattggaggctgacctgaagtgcaaactggtagacttcggaaatgcatgttggacatacaaacagtttacaagtgatatccaaacaaggcaatacagatgccctgaggtgatactgggatccaagtattctacatctgctgacttgtggtcctttgcatgcatatgctttgagcttgccacaggagatgtgctatttgatccgcacagtggtgacagttatgacagggatgaggtatgtctatttatttctttccaagacatttcatatctatacaaaacttaactcaaactatcacctgtcaacactttagcttaaaaaaataggagtctatcacaatagaaatttgagtgatcaagccaaatgacatctactggctacagcccaaaactccagtttggcatgtacctaggttttcttttgtgacaatacttaaaaggaacatcactctgaaatttgatatttgtcaacatctaattgtgccatgatctcataaccaaaagcaaataaaatgaaagctacaaagattgttttggagaaattatttcttaataaagcttgagcatttcgatgcatcttctgactcagatttgtgggattcggtaggaatctaaccaattattccagaaaaaaaatgataatcaaattttaaatattgtaaataagaacatttcgttttgaaggcgatcatgtttggacaatggtaaggttgatatacataaaacattgtggggtaccggcctgatacagctcatttcttgttcatgtttgcttactgtttcacaataattttgaacacatagtatattttcttttcatgcttagttatgagacctgacaaggcctccaaaccaaaccaaccaccaccaccatacacaattacacgacgcaccctctcttcctccttactcgtggaagaagtactgtagcacataagatgacaggagaaaactttgctatgccatgtgtttattcaatttgtagtgtacttggctattcgagtctgacactttccttttaaccatgaataacatgcacctatgcattagaaactcgctttgttcaagaaataaacgaagtttcggttattggcagtttggcatggtctctggcatacatactttactattataattgtgattttatcattttgaaaatctgtgaacgtactcgtctacatcacgtgttctacagaagctataacttgtagtctataagagagaaaaaaagagagaatgaaactaagtcataccaatgtgataaaagccacagttttcttctaaaaatgatcggcaacagatgaaaggtaatgttaaggactggtctaagctagttcttttcaggtatgtcatatggttatcttgattgaatgaattctgaatgtgattgataaatacatttcaagtttgtggtatatggtattggaacatatcattgactacatgaatgcatgatgccaattgcttttttttgtcaagttgcattataagctcaaaccttttattcagttgtcctagttgattgaccacttcatatttgtgggaaatcaactgctgaatttattcaaacttttcatttagcaatattactaattgaaaagttctctgagtaatctttttataattcttaaacacctgccattgtttggagatgctgtgtgaaatagatatgggcaagtagcaaaaccataatgatagatatgaaatctagttgtcttccctatagtacagaatgccatccctttccattggaagtttattctgatcaattcttgcttgaagcaggatcacctcgcgctgatgatggagctattaggaatgatgcctcgaaaggtaacaaattttccatcttcgtaagctttcatgtaaattgttctgaattatagataaaatacaaagacattgtttcctagattgccttgggtggtcgatattcacgtgagttcttcaatcgttatggggatttgaggcacattcggcgcttgcggttttggccgctcaacaaggttttggttgagaaatatgaattcagtgatatagatgcaaatggcatggcagagtttcttgttccaatacttgattttgttcctgaaaagcgtccttcagccgctcaactgcttcaacatccatggcttgatgtcgggccccttcgccggcagcctaaacggccatcagacctgacacagaattcgtccgatgatggtgtttcagagaaacagaggattgagaatgaagagagagatgcaatggctgtgaacttggggaacattgccattgacggtgcttcatccaagacaactgaagacccccaagcaagtactatgcaaaataaaacaaatgctacccctgctaagtgagatgctattaattttacaagctgcattgtgtaagactgttttcagattagatatgtttcatgggaaacgagtgtttctttagatatattaggaatagttcctcggggaaagaaaagtagggcagacatttgttgtatggggttggttgggcaatgttagatttgttggggctgcagaaatgtagacacccctgacctttttcctggacatattctttgtacaactagaatctgcgattttttaaaaactctttaggagtgcacaatgatgaaatgagagtgatgaacctgagttattttttccccttgttcttggtgtagttgcaagtttacatttatcacatccaaaactggaaatattactgctttagaaatgttagtcctctttgacttggagttggagatcatagttttgagttgctatacattagtatgtgatatattgtcacctctgcctaattctcactatcgttctcagttattgatgtctttattgatgacctctgtaattcttttagacaaacctagattatgcataccgtctgcatccttttctgttccataatcccaatatcacatttgggtctgatcatgctagaacaggcagggcaatgcaagatagtcaggtcacaattcgcacaatgccactgaatttctggaggatatcggcttgaaatctcagtctaattgcaaggattctcgatcgagagattccatatttggtagagcattcggatcacgaggcaccgtgcaccattttcttgacaagtgtggccatgtacttgccgtggtgctcggcgagggccagctcgagctcggacggcggcctggagccgtcgccggagaagacgcccgcgccgtacggcgacccgccgcggagctcgcccatctccaacatcccctccccgaaggtgtacccgatcggcacgaacagcatcccgtggtgcgccagctgcgtgatcgccgtccagcttcatccatgcatgcagccagagagattcacggagcagagtgagatgatctgatgcgagagggatgcgatctcgcggcggcggcggcggatacttacgcggtggtttcttggccgccggcctgggtgccggtgctgacgaagaggccggctggcttgccggcgaggcgctggtggcggcagagcggcacggtggagtcgaagaaggcctgcatctgcgcaggcatggcgccgaacctggcagggaagccgaagaggaacccgtcggcgtcggggagcccgtcggggtccacgacggggatgacgtcctcgccgtcgccgccgccgccgccgtcgtcggcctccatccgcgcgagcacggcggggggcagcgtctccgggacgcggaagaggatcgcccgcgcgcccgggacggagcccaccccgcgcgccaccgcccgcgccaggagccggacgtgcccgtacatggagtagaacacgacgtagatgcgcaccggccgcggggccgccgccggcgccgggatcgaggtcctctcgcgctggtgcgagtgcgacgctggcgctgccgccgccgcggcggcgcggtgcctcttgctcgggatgcagccgccgcccttgcccatcgctggtgcccaccaccaccgcgtcacgcggctcgctcgcgcgactggtgagacgcacgcgccgcgacggtggtgtttggtttggtctccgcctcgcgcgtgcgcatcgcgtgtgctcgcgaaatggtggattccgcgtgatcttgggccgaaatcacggtggattccgcgtaatcttgggccgaaatcacggtggatcccgcgtggtattgagccgaaatctctgagcgattcggcccggaccagaaacggataggaaaaagtcaacccggtagcggattctttcgtgcttttttcctcgctgctgctccacgcgcacgggccaaagtcagtcggccacaactcctcctccgccttgccgcgaccatcgcgaaatcggaaggcggcggcgcgatggagcggaagcccgacgagccggagaaggcagcctccggcgccggcgccggcgaccctcctccaccgccggtaaacctgcttactttttttctacggtagagtgtcctcaatcttgagaacgaggagaaggaaattggctcaatgtgggtggtgtgtgtgtgtgctcgcagttcttggaggtgaagtgcaggagctccggcgaggtgcggcggttcgcgttcgggacgacggcgcggtacgcgctgcacgccgtgaaccgcaagctcgcccccggcgcaccggcggcgctgcacgtcgaggccgtgaaggacggcgaggagcccgtcagcttcggccccgccgcgccgctcgccgactacggcgacggatggaagctgcagaccatcaccgagcaggacgcgccgggttactaccagacgccggcgtccgacacggtatgcaagaagttcagaaaatttttttcctcctcttttcttctcggaaatcaagaacaaaatgagcaacgatttcctctctgaataaaattttcggttgccatgcagagacgagatgacacgaagcagtcggcgaagaatcctcgcgaccaggagacgatggcagcgtacatcaccaagatcgtgctcgcgttcgtgttcatcttcttgctgggcgggctgttcacctacctgctcgagacgctccccgacatgttccagcctgcatctgaacctcaacctctgtagaatttactactgatttgctgatgaaaatgcagcacaaattgtatcgtttatttttgagtgattttggccttcttgataaggataaagtttgctgttttgagcctcgtacggcggtcagctgcaggccttctctttgtttctgtgcaatgtcagtctgccaaattggagtattttgtttttcccttcatctaaaaaatattgtttccccaaagaatctccagagttatatagagattccaaatgcaaaaccacgggccaggaaggtgcggattccaaacacacctcggagttggtcttctccttaatttttaatcaactttgcaaagttcactttgatgtcttcaccatcaaatgtcaacggggcaaagctgtatcaaggtcaatgaagaagacaaacgtctgtttcacgcacgtcatagaagaagagaaaaagatcactgttgtacataaaacaaattaaggaatcataagataaatgctaacgaataggccctgtttgaaaaattgcaatggaattatcagctgagtagatcaactactatttggttcacttcgtttttacatgttacaatctcatctgtgtttcccagtgaggaggtagtatacaaacattaccaagaaaagctggtaaaacctacaatctaacaaaattcatttgcccgcatgcaaaatctttgatgacgtgtatttcttttctgtgtgttcagtgtttgcttagtgtgggcagggcaccaagatggcacaagcaactgcccacactgggaaatgctttccaccactgtgttatcaccaattctgcaactgcgatgccacgcttttcaccactgggtgatacttcgtgtgtagatacttctttgcgttttctgaaccaggttgcccaagccattcatcatataatcttttcgcaatagggttctcgaaggggttggataccgatacctggtacataaggccataagctttacagttagtggaaattctggcatacagcaaacataacatatttgcacagtagtaattagatcctagaagcatcacagctagcatttcatatgcacatgtgatgatcggtaaatatgaattgcatactaccacacagttatacttgattggcatgttaacagcaacatgatggatcaccataaatgaactgtgaggtcagattattctctctgtttttttttactaggatacatcaagtaagaagcttcaggtctactccacattgacatggaagaatccaaccaatgctgagacaacataacatagcatagaaaagcaagttccaaacaaacagcatgaaatttagcgagagatttcgctagcttacatcttggatgtacacatcctctagtagttggataagatccttcgcagactggcctttggcaggttttatttgacctcccccattcaggcagcctgcaagcgaacaattaaggtcatagaatcaagatcctatggctcagaaccatttacttaaagcgggcaagccacactgtatcataaatgggagtacctgaaggacatgccataacttcaataaagtgatattcgcattttcccatcttaatcttcctaataatgttctgcagatttctgaatccataacaaagtgcaaacttaagaacaggtttgccctccacctgtgcattaacacaacacacgttatacaaaattaatctaaggccacttgaatcatgcttaagagagaattgaaagcaggccaacatgatgcaggatgaattcacctccagtgtaacctcacgaaaatctgaatttcgtaagattctgaaatcaactgatccttcaatttttctatcgaagagaacatgtgccgcatgtcgaaagactgtttctgcataaccccctgagccaccagaaaccccatatagttgaccgtcatcatcaacattggttaatctggatcaacaatgaacgtaagtatatgtgagtttccagatatgacagataaaacaactgtgatataccacagcatgttatccaaagcaacatgaattattctattgactttttattgaaggagtgattaaattcaatgcaaaatttgtaaatctgaaatatcggttgaacagataatgactgattttactttccaacttgaattctattaggacttcacccaaaggggctaaaggcacactagggactcacaatctgtccatgggagactcctctagggtcttgaaatcaacagatctggactgcacaagcatgaaaatggtataagcttctcatagttttttaaatgcatatcaaaagacaggacatgggaaaaaaatcagttacctgtatcaaatctaacacttcaccagtggttaatacggaatctacctctgtaacatctttatcttccactgagaaaacaaaatcatccctaacagcttctagttttttatcataacagggcatcacagtaacatgataaacatcatgtggcctacacaacaaattcattcatgtacaactgtaagtccaaatatttaagggtctatagtatataaaatatgaaggtaacacctttacatcaactatggcaaagtgctcacttcagaccaagttttccaaccatatgatgcttgatagcagcaccaatggcctgttgggggctcttcacagctgagatgtaaggcaagataaatgaaccgagagtcttttctgcatagcatatccaacctgcaagttgaagaggtttgaatatatttgtgcactaatcttactcttgtttataaaataagatgcaactaataagctaccccctacggtaaaaaaaaaaagggacatttaggacaagatcctgcccaacttaaaattccaacaatcaattttatattagaattagtttataaaatctaataagtttatgatattatgatagtacttttcgaggtaaatctatgtatatcatttgttttgtttttaaactaagcattcgatgagaaattattgatggtcaaaattttaaaagtttgagtgaatcttattctaaacatcaaatattttttaccagagtacaagcattatgtggaagtacagaattcatgatacctaaattacatagtaccctgcaaacaattttacctgggcatgcagatgaaagcatgggaagattttttccagcttctttgccactagataactggttttgatgataacgagtaacaaattcactgcatgcttcaattagggacagatctcgactggaacttgtgtcgtaaactgcctttacgcccatcgacttgaacagcgcagtgagttttctgaaaacctgagcataaaggtattaagctcctgcttttgttaccacgttcatgataaaaatgcactcctttatgcatctctagtcgtggttatgttcaaataaactagcatttcggacaaaacattttataaggacagatttgacagggaagcagataactgaaaaaaatatttaatcacctgtgattgagaaagaccaaagaatgcagctagcgatgctcttgactgtggagagaccgatactatgacagctttgtcagagttgatgcgagtaatgaagtcacccaagctttgcttctcaagcataactgtttctgctgatgttatgcaaccactatgggattaaaatgaaacagtcagcattatttggatttggacaagctgctgattgaatgaacagtgcaaggtagtaaagaaaacctgcaagccaaacagtccttcagtgaaatcttgactgcttcctctggaggatttgtgctcactgcaatttccttttgtttgatctgttaacagaagtgccaagatatgaggaatggtatgcggatgggaagcgaatcatccagttatactaattttgaagctacttgtacaaatgtgtgcagagatgtaaataccaaaggtgcaaagtctggtattgagtttattctgccattcaacaaacaattagggaactaggtgccagttagaaatcatatatgattgaacgttgctttcatgtttgcaaccaacacctgatactggacttctgttttggtttcatatgtttctctattactaatcaaaaagttttcttcaacacctctggagaggttgttcactcactgcaggctttaatttgatttctctcgactaaaacgaacagcaggaaagacagtatgcagcaaaaaaagcatctgataccataaatcccacccccgaactccgaagaattcagagtgttcgataatggtggctcgtctttagccaagaccattttgtcccctcgtctcgttcacaaacaacctaacagcagaaggacaaaatcaattccgcctccttttcctcctcctctctactctgcacgctctatcaatcgatgcctacaggctagacatcagcagtacagcactcgaaaatcttccaatatcgatacagaatcatcccgcatcgcatggtgagacgaactagtacgctgctaagattaccacgcatcacccatatggctacacaaaactacacacactttttttggtacgacgcacggttccacggccagcgaccaaccacgcgaccggcaagccaaccaacaccggagcagcgccgccgggcatagctccaatccagccccagcctagggcagaaagggaatcagcgagcgcggggtaggagtctcaccggaaggcggcgggcggaggggcccttgttgagggagatgatgcagtcctgcgagggggcgatgaagtcgttgagatccgacgcctgcagcgccggcgagaacctgctcgacgccgacgacgacgacgacgccatcgccgccgctctcctctctctctctctctctctctcctccggaacggaacgagagagcaatcaatttttcttcttttctcctgctttgaaggagagagaggggaagaaattgctgggcctcctgggcctggattggcctggagcccacggcacagtcagctctcgccccatgactttttctagtagcttctagaatttaaaaaaaagttttggatcagataaaaaaagggatttaattattgataagatatttttttgtttgctattttgggggtggattatgaaatggaaggggaggagatggaatgtaattcgtcttccttcatttgtatacacaagtgtgagatgcaaaagcaaaaggatggttggttggttggttggctagttgtgtcatgatattcttctcctcagactatcactcccccaacaactgggagacgcgacagcgacgcgaggagaggataaattaatcaagtggtgaaggggcaattatggtttgggtttctctttcattttgtggtccacagccttgacgctggcgccacgggtgacgcacctgatcaagcggagacgggttggattgaaaccaacttttgttcttccctcgaaaaccaatttttgtcctactttctccgtttcagaatttaagtcattttagtattttctatatatatatatatatatatatatatatgtctagattcattaacatcaatataaatatgaaaaatgctagaatgacttacattgtgaaacggagtgagtcctagttttttttaagtttcaatagtagagtttgaatgtttgttttgttaccaatttatgtctatgataatacacattctacgctatcaatctagaaagtatcaaaatttgccaaggttttaacacttgcaaaatattgataggataaaatttgattacaattcaaacaaacctaagtggtcgccggcggcagccgcttcagttttgacacgaacggattacggatgcacgacattgccagtgaatgcggaattagtacaggcaaaatccagtaccttccatttttcctcacttctcgatcatacatcatgccgttgtatacataataagctgtacaaactaacaaattacataaccatgttcaagggatgcaaccaataatggtcacactaatttgagcatctaaacgctcgacacggagcaaaattccaaaaggggcgatgaatccggtgaaaccaagctcgaatgcatccaaccaataggccaacaaaaaaatggcaccataacaaaactatcatgggcttcttatgaacctaagtactagatgtccttgacaggaaaatcatttcctggaattgtttctggaccgccgcctcggtctactgagcaacttcagcatgttatccgtcaggtcaagaggggaatcatcgccatcatcctgaagctttgtccctgaggtctgtgtcagccnnnnnnnnnnnnnnnnnnnnnnnnccctctcggcgagctgcttgttcctcttgggtttcccggcaaactgcatccctttgaactccactatggccctgaactcgttggtcttgaggtgctttgtcttgtacttgggaggggtgtggccggccctcatcagcagggtctggagcaggctcttggggttcattccgtccttgataatgttgcctttggtgtcgtcgctgctgctgagccttgctctgctcgtctcgcggccaaacacaaaccttccttcgcataggtcgcctgcagcgagctcttgtgcggcatataagatgtactttccttccttgtggatgtcgaagctggggtcttcaagctggagttcagattgaaaacatcgtagagttattacacatgactgatatataatagatgcggaagaatttgactgaaatcaagaaaaaaaaacactgcacagttagtttcaatcttttttgccctaaccgatgatgtaccacaggccatgtttcaatatcaaatatcatttcaagtgactggcaataaacaacaaaaggttgtctctctgtccattgcatgtgaattttctcctttgttcctagcttccacagaaggtggacagatttaagagaaataacatttggcgcactatagcagcatatgcaatgttagttatacatgcctcataagtcataacagcattggcaatgcctgtcaaatacttattaaacgctgactcggcaacagaaatatctagtggaacgaaatcaatagaatattgcatggcttaccttcttctgtacaagtttatcaagctcttctttaagttgcaagtagcattcacacaggctaggatccataaacaaatcgatgtaaccatcgagcatcttcaggtgcccagcctatgatggacaggttagaaggtatataggtagggaaaatagaaatgcaaaaatgtcataaagcacttgaacaagatttaatatttatataccatgcttccttttgtaacagcaccaccaaataagatcaggatggaatctgatactccggttgagtcacggatgaagacagcatttaccttcaccttctcaccaaagaccagccatggataagggatggtctggtacttagcattcactgaattctggaatagcgtaaaatgcaaataaatcagcacaattttggtatctgtgaaatgtaaggcactatacatggcaccctagatgggctatctcccatgaaaggtcaagtgataagctagtaagcagggtgttgcacatgaaaacttcaagacgttccagtatgaacttacagcataaagaagaacttggccatcatccatggtcttgaacgacatagagttttctctatgctgaaaggaaagctcaaaaattaactgacaagttttgtgttttcaaatagaatggaactttacaaagtagtctgacagatctttaccacaactgatgttatgcctgggaaaagtccagaacatatgataccacggaccaatgattgattatggctcaaactattatttgtatttgcatcagagtctaccaaaccagcatcctttaatatatagctgaattgcttccgaagagagtgaatggcttgaagtgtttgagcagaaaggaaatttctccagcagtattcataagcagacccttctctctctgcatccttccatccttcataagcccggactagggccatatgatcactataatcttttgctgagaatcttgatttggcggttcctgccaactaacaaatagaggacaaaaaatcaaacacatccttcttgccataatgaatacacaaagcctgaggcccaattcttccctttttttataaattttctatgaaagcaagaatagtgtctcccaattaataatagtaattagtggaaaatcaaggcatacatctctcttgtcctgtggcagcaggaaaggatcccgggcactcaatccagcaaccacggtaagtataggatcaatgcagcggaaaactgcacccattataagcatcttccccaactttggatcaacaggaagcatggaaaggtatcttcctacaaagttggattagggaatattaaataggtttcagtaataatatgttttgcagtgttagcaaagaaccaaagtgtaggatagatgtacctagatcagttaggttctcattttcatctaatgctccaatcattttcaggaattccactgcattttggacctgtatatttatcaattgatcagccaaaaaaaaaagcggagatgattgaaaacaagaacccttttgctagcccgtagccacccaagacaataagacatacagctagtggtgccgggggctgtaaggcagctgatagaaactccccaatgctgccaacttgcaaactttttatctgcaaacatagtgaattcaatggagttctaaggagctcaggaagctggtaatctgcaaatgcatcatacacacatctagggtagaggtgatagcattctccaggttgcacacgaccagctctgcccctcctctgcacgaagataatggggagactatcagacatatggcaaagaaggatatggtagaggaaaacaatagtatagtgtatctgaattaaggagttatcttcaagtttgatcacttgttacaaagtttctgatttttaatattgagtacatttctgctgcctattgaagcagaaaaaataaaagataggtcgactagccaagctcataagcaaaagagacacatggacgtgcttgttcagaaatataggtatttcccaaccacaaatctaaggcatgccctccccgagaaaatgataaaaaaagctgctaagctgcaaagtaagagtcaaaagtactaatataatactatagactcaaacaggacaaacgttcaattatattacattgaaaaaagtccattctactcccccgaactagttcaatggatcacctaaccccctaaactattttttggctcatttaccccctagaccatacagaaggttaaaatcgagagagttcaagaaaccaaataataatgaaagtaggtacaggcacatgccattttatgctgctgctgctgaaagacgagaagcaaaaaaaaaatcaaagttgggcattttacctgacgagcagaagcctttgaaatccatgagggaagcaagcagggagtgttatttagtgcatcgtatgtcgtttcctttgcctttccacaatccacgccaaaaacaatatcatttattgtaatacttgcttctgccatgttagtggcaagcactatcttccgaacattaggaggtggcttctcaaagattaacctctgcgaatatcataatacattcatagatgtcaatagcatgaattatacgatgcacaaaagatgctacagaaataagtatcaatagactagcagtccagatgcatacattatatataaaatatgtttatgtaatactcatatctccaatccagtggtttaactcgtatcacacaagcaatctcaataagataggggcaaatcagaagcaactacctgttcagctgtagccatggaaccatggcatgcaacagtaaatctctgttagggtcgcccaacaaagggtgtgcctttagttgatccttcaagcaactgatatcatcccatccggtcatgaaaactagaactgcaccagaccgctctttacgacatatgtggcaaagaacagcttctataaggttaaaccctatgcaatcaggattccaatttgacagagaatcgcgtgtcctcgatccataggtctcaaagctagaagttttaagggcatcctgtatagtacaataataatatcagaagaatgttgggaaagtgcgcgctctatatatatatatatatatatatatatatattgaaaatgtacctcaacaagcgttgtgatttgatttttcctttttctaggtaatagttgcctctgagttttccagactttatcttgtccataatcgtcaagttgattgcttgaggtcaacttatagccagtcctctctaatatatcttccagaaaatgtgccctcactggatatgtgaatccctgatagaagcagcattcatgagaagaataagacagatgtcagatgtaatatatttttttatatgagaagatattaactcacaggaatatggatagttggtgctcctccaaaataacttgagaacagttccgcatttagagtagcactcatcaagatcaacctcaaatcacggcgtcgtgataataggtcttttaggacaatcaataagaaatctgagaaaccaacaaagtaatgcaactttatcaggagtttaataaagacgatctcagcaaattcaaaggaaacaatgcaatcttccaaccttcattcatgcctctttcatgtatttcatcaacaaatacatgagttactccattcaggtttctgtcactgagcaatcgtcgtagtaatataccacttgtgcagaaaagcaaatgtgtgtcttttcctttgattccctccaatcgaactttgtagccaacctattaaaaaaactagcattgtatacaaaaaaatacaatagaagaatctagtaaagacattttgtccttaatcatattagagatgggacatggtaccatatgagacgaaaaaagaaagctttatcttaccgattcaccaagattctctcctctctcagtggatactctctctgcaactgccattgcagaaattctccgaggttgtgtgcagattatattacaaaaggccccacggccagattctatctctgactctaatacaaattgaggcaactgggttgttttgccacaccctgtctctccagatatcactataacctagaattgcataagaatgttcagaaaaattgaaagagacaaatgaattgccaaacatgtatgcagtatacacagattctatggctcataaacatatgttgtgaattatacagtatatatacctgattgcgtgcaatggctgctagaagcctttccttttccttgtatgcaggaagtgatttccggaattctagcatcttaactccttcaggtgattcctattgttacagatagatggatgatcaaccacaatggaattgttgaaatgagatataaggcaaattttacactaaatgctgtagaaggaatctctaatctatgtgtatccaggcatttgtaaattatccagatagagagctccctaaattctgtacccattgttgaggtacagatctataaaccatctaaacattttcaaataatccaaacctgtatccagattgaattcaaagttacgtagtcatatcaagagtgacatacctgccaacttctctgaaaattgcgcatccgtatgctcttcctctgaaggatcttctccatgaccgatcgatcgagaagggaatcctgctgctcatccaggttcacattctcagctttctcagccatctcagaaccatttccagttccacatttatccggcaagagtgcacgatcaaggtgctcctgcacaagtccttcaaccctcctctgtaagcttaatggaatcaccacctgcgtatttccatgcataacaaaggcattcgcagtatttaaacaccgtcaatttgcataagggaaagatgtttgatcttgccagtggaatgcatgggctcacctctctttgtggccgcttgtcgtccaggtccggcctgtaattcggcagcgggaccttgctcgcaacaatgaccttcccatacatctcactgccgttccacagagaaaacaccaaaccacaaatttcaatgtttcgacatctacatttgggaattatgaaccggagatagcaaaattacggtggaagacctgtagaggcccatcctcttggcgaggttggcgatctggtcgtagtcccggcgatccctccggtctctggagatgatctcctgctcctccgcgttgcgctgcagcatgctcagcttccacctccactcgtcgatgttcgccaccgacgacgacggctgcgggtcaccagttcaccactcgatagctcagcatggcgaaactggagaagaacaaaaagggaagaaaaagctagctcggcgcctgcgcggaggtggtacccggtgatcctcgtactcgtggtcgtactcgtcgtcggagaactgctccacggcgtagcccccgccggagctgcagaaggaccggcgggcgaagacatcgaggcggcggtggtagacgagcagagcagcgagcgggaccggcggccgcggcgcccggctgggcgagctggagagcgggaggagtaggatgcccagcccgcggcgcaagccgccgcgcatgctactgcccgtcggttggtagggtaggcaggctgggctctaccactgctgctgctgctgcggcgcgggcatgtgttagcaggtggggaggggaggggagggagagtgcacgccggcgtcggcaaaggggaaaagccaagaagccggcgtcgccgtcgtcggtgggcgctcctctgcttccggtcagatttgggctgaaatggttttgttcgacgtgggcttcttccgtcgtgggccacgtggcagacttgttgggccgttgccttcggttctccaaggctcggcttactgtgagactggacctgaggtgcttgatgggctgatacccaagtatagtactgatcgctccactaatggagtggtaataagttttggatttattataagttaaacttggtgtttttataagaaaaatgtaacaatatctataacactaaattaattatattaaatcctgctataagatatttgtattgcgttaggaatgttgttttatttttccaaagtttgaattataacaaaccaaaaatgacttacaccacaaaacggaatatagggattatattattgctcctttccttgataagtttataattcttttctgtgagcattggaatattcatgtgaaatttctacgtttaaatcaggtctaactttagatactccaaaaactaaaactatagaagtatatgtccatgttaaatgtagtgctaggtctttttcttttccctacgttttaaactgggtctaactgtagctccctccggcataagaccctgtttaattcccaaaaactttttccaaaaacatcacatcgaatctttagataaatgcatgaagtattaaatatagataaattaaaaaataatacacagttaaggaagaaattgcgagacgaattttttaagcctaattaatccatgattagctataagtgctacagtaaccagcatgtgctaatgacagattaattaacctcaaaagattcgtctcgcggtttccaggcgaggtatgaaactaattttttcattcgtgtccgaaaacctcttccgacatccgatcaaacgtccgatgtgacacccaaaaattttcttttcacgaattaaacagacactaagaaccaaacctgtagataggaaaaaaaacaaacttgtagataggaaaaaaaaacatcatataggtaggatcctatgttgtagtaacaacattaatttctacagtacaatcaattactaaacccgtatgctgcataatggaataaatatcccggcagtatgctgccatatggctcgtattgaagcgttgcagtaaagtgcttacaatacggatcctgtgtctatagtgagatggtactaaccatggcatttattgcactatgctaaactcgttgcttcttgtttttcaatttccacttcatcgtgataaactacttatacgagtgacataatgacacacttatcgtaataaacaatttcatcagacgttcaaagaaatttcacaagaatgaattcgccgttttacacaggaataggcagaacacgaccttacttatttttagttgacaaggatctataagcaaatggagagcacccgttttcgggataaaatttcatgaattatctttcaacacgtaattagccacgcgttttcctgtgaagactgaagaatatccacaaaccataattcgaggaggaatatatttttttcaaagaaattcaaggagaaaacttcgtcttaaaatactacaacttaataggttaggtttagatttactgttctaagatgattaaatattatcatactccctgtctagaaaaccaaactcatataggatattaaaggttaatttattttagagcgaaggaaacatgtcgcagtatgctggctgagacggagaaaatatgaattttagtagggcctgctcgccagcgagagagatggcaagatggctcacgtcagagcaggtacaatagcatgctataagctaactgcaaatatattttaagcagataaatgaggagagagaagggcagcgggctacagatttgtagccagctgtagcatggacttcaagacgcagtgtatgtataataggtggaaccagatattaaaaatgtagtatataactattgtatgaatgagctattaaattggctatagatgaattggagttaatagttggctaaactattaaacttgctctcacatgcaaagaatacagagctcttgtcatcattccgtggtgggaagcagacggcgacggatgtgccacttgacccccgaccgagctggccgtgggcccaaccaacgaccgttccatttgcacgagaccatatcacatcgccctggggggcccacctcgcccatcagattagattaaccccacggccccgcgccaaaattaaacaccggttttataccactcactaccccacactgacggtgactggagtgtgggcccagccgctgccgtgtcattattaggtcacttaatacagtaatcacccgaaaaaatattaattaatttaattatactagtaagcaagactggtcttgtttacaggtcaggagagatggcgccgccgcgaagcaaactcagcagccagcatgtctcacaagtaacaccccgaccctgcgaaaatactattttacccctcgtaccatccatgtgggtgatatggccgtgggcagaacgggtattacggcctccgaggtggagtttggttcgtgtcgcgtaaataactttctcggcgatcagcgaagcgaacagctcgagaaagaaaaagaaaacgtagaaaagtttttcgcagccgcggcggccagccaaccaaccaacccaaccagccaacgcggatcgcctctcgagcaccaaaccctacccggatcgccagcgcagccactcaccaagccttcccccccaccctgcttctgctgctcgcgccgggattcttggctcgtctgctcttcgcggtcggtgtcgcgccatcagcaaccatggaggtgagcggttcttggttttttcttttcttgcgccgcggcggcggcggcggcggtaggaagaggagtgatcgtgtgagggggttcgctgcttgcagggcgagaggagggcggtgaggacggtgcgggtgcggaacatctcagatctggcaggggagcgggaggtgcgggagttcttctccttctccggcgaaatcgagcacgtcgacatcagatggtgaggcgccgctttgcccttcgatttctttgttcggattgctaatggttgcgcctctgcattgctttagcaatcagaagtggtatatttctttttcgtgttctctgaaatccgcattgtgattttgggcttgcagcgatggggtggcgacggggaggacggcctacgtcacgttcaaggatcccaaggccctagagatcgcgctgctgctgtcggtatggctctgtgcattgattggctatgtttgtggatgggacttttcgctattggttgtggtggttacacaattggtgtgcctaatgaatgatttagtattttagcatactgccattgtgaatagtgtagttggtatgtgtagctacaagcctattatggcttgtttaggcgctgaagaagccaaattttgtgtcggttgctatcaatattgtagcgtgtagcgataaaaaggaaaatatgtattatataaacgggtattttgtcgttattataatatgtcacacttcctatagaacttgttggcatgcatgtacatattagagagcacataaatgtttatgtactaaatattcagttgtgttccttgtggagctctttcatattagatggatgacctaaaagtaagtgaggatcattatgtgaatcgaaggcatttttgatgcaaaaaaacattgaatcttgaatgctttatattcttcctatgattacacataaccgtgtgctttatggtttcatgcactggcaagcaaatgattgaaaggcggtgctttcttccgttgtcggtaaaatcttagaagccattgaccatggactataataaacaaaaacaaaatagatttatattaatgcctgctttgattggcatggaagtgagcagcatattatatggtgttactactgtgatcatttgactttgttattctgttttgccatttaagaaatctgctcccagttatatttctttatgtgcagcatgtgtgcaaatctgataaatgtgcatcaatttcaactgagattgtcataatgaaacacagtgcacagataacaatccagtgaatcttctaattagggtatattcagtttaaatctcattacgctacctaggtcttgcagcactgaaaagaaatagatgtttgataagcttcccctttcagtatggattatggcttattatcttctaagttccctttttcagggagcaacaattgtggatcgggttgtcaacataacccctgctgaagactacatctacatccctgttactgaccaggtgcaccatccaactaatttatgttacccaaatgtcagtactaaatcctttgattcgtctttttcatagagacatctgttttgaaaatcatgcagcaacttgtggtcagtgaggtggtcggtgaggtgacaagtacggctcctaatgcagatttggaccaacctaccgaggtgtccttcatttccagtgtactctattttattttccccggtatagacctgtagcatactatgaagttcccatgaaccaggggaagtgcgcactgataaagtttaacgaaaggagcatcccataacttgtagtaggtgggtggtagggatgaatcaatcaagtgcaacagcatgtgtgacatcttcccctggcatgacaattgggaacctacgcttattttcttatacatttatttagtgtattatgatcggtgctgatcaaaagtatctcattgtaccacataggccaatgccagccccactactggccgtgtttatgtcagcaaggctcatgatgtcatgacaactgtgattgcaaggggttcagcaatgcgacaagatgctgtgaacaaagctaaagcattcgatgagaaacatcaattgagggcaaatgcatcggccaagatcaattcctttgataagcgtgttggaatttcagagaagataaacagcgggataacagttgtaaatgagaaagtgaaatctgtagaccaaaggctacatgtttctgacaaaacaatggctgctttgctggctgcagagcgcaagctaaatgacactggctctgctgtgaaaaccaacaggtctcttcttatccatgcttttgcttatgttcagccaacaaatttgtttgacgttgtaccaataaccaatgaacattttttttttgtaatggttgagtagcttttaattttgatgaaatctattacctttataatgcctaaattcttttaggaggaatatataagatcttttatatacatgaatctccaaacactttactgatttttttccatcttcccctacttgtaggtatgtgtctgctggaacaagctggctaaatggtgccttcagcaaggttgctaaggctggtcatgttgctggctcaagaacaagagagaagttccaaatagctgtgtccaatctaacagcgaaagtaagtcaataataaacttaactatcggttgctactgagtaaatgaatcaagactctctatgtaggctacagctgataaatacttttagcaactctcgagctacagttccattttcctctttcatttagtcaaaattaataaattaccatgaaacagaccttcggttgcattgtcatttataggcatcaggcatgcctgataatttaggtttgactgttaccgtgctgcttcagtgtgtgcaaaggatctctttgcatctacacaatcacattaataaactctcacatgacaccatttctttctgttaggggctgtgttattatattatcctgaacgattaacttaacatcatattttcctggatatattttactcagacttgatatgtatcacaagttcacgatcttaatagaagaatcatctgttataatatctcaacccagagaaggagagaacaaagaagaataaataggggcaaacaagggtgggtaatgctggaacaggttgactgttagcatggaatcttaactaagaacttactgttgacatatagtgtgctgctaggtgatgattttgttaactttttggccaaacctaagtagcatcgctgaaggcagaacaaaggcacataatcccaccaggaacaaaatagcttcttgcaaagttcgctccaagccaattgatatgcatagccttttctcaccagaggaaatagtaattcaaattggaagggctatttatgtagcttgctgggctacaatgttatgtgtgtgtactttgcttctgagttctcatacttaaaattccattatttctccattatgctgcaacagggtcctgctgttgttgcttgagctgctgtggtcctggttttggaagctcttcttcctgggagaaaagtcgatcataaagcatcgtgcaatcaccttcactcagagtgtatcgacagtgtggcttgtaactgtgtatttcactgttcccattttttcttcggggaggtttttccagtgagccatgtcagatttggtacatagaggatctcatgtttttggaactttagagtcgccattcttttctttgtagtgtcgatgttaaattgattataggtgatagtgatattctgggccatatgttgttgactcggtatggattattggttattgaatgtctatgcttgtgccatgtttgttcttagcaatttaactgtcggtaattggaatgctcatccattggtagtgagtgttgttcgttggtatgtgttggcattgcttgaattctttactcacaacagcgactggttacttctgtagtggatacttaggcgccccttgatttaaaggaaattcataggaattttagaggattttatttctataggaattttttctatatagccctttaaattaaaggaatgaattttatggaatcctataaaattcctatggaatgcctaatgccatgcaaattttggaggaattctaacatgaggtagaaactttcctttgagtctttatctctcctctaattcctgtgttttgtctgcggtccaatcaaacggtcattcctttgtttttcctgtgttttgcaatcctctgttttacacttacattcctatcaaaatcctacggtccaatttccaatcaaacggtaattcctctgttttacacttacattcctaacttacattcctatcaaaaatcctatgttttttcatttcaggggcccttaaatatttatgactacatttggcacgcatctaaatgttgcttacttaaatcttgcactgggacttgaaaaatgagccgtttgccactttgcctgtttgaaagtcccatcgtatgctcctattcccgtcttattagggaatttttttacgtgttcttgtcacttacaaaatcaatgctgaaaaaggaactacattgtaatatcttaaaattaatctcaatattaagtttgaaaaattaaattttagttttttctttgacttatttgggcatccgatctatcaatgcaaaaagaaaagaaaggaggaaattcatatgattcttttaggaactgaactaaatcctgcaaaaattatgtaaatttacttcgattcagaaatcaaacatgacgcatatgcgtatatcctgccgcaatttcgcaatccgtagaacagaatctggactggaggtggtccaaagcatctattctcagcctctcaggaatctgcccggcttccgggattcccccacctcagaccttctctctctctctctctctctatatatatatatatatatatatatatatatatatatatatatatatatatatatatatatactcgctctccgcctctacttcgcgccatttccaaatccatttccctcgcctcacctcggtcgtggccgcgaatggcggcggaggcggcgccggagtgggtggagaagggggacaacgcgtggccgctagcggcggcgacgctggtggggctgcagagcgtgccgaggctggtgatcctgtacggcgactgcggcgcggtgaagaagtgggccgtcaactcggcgttcatggcgctctaggctgtttagatgctatactaagtttgccaccattcaccatatttttgtgccacacttgtcttaagttgtggcttaaaaaaatgagccacaccttagctagcaaaattggattgtaccacactttattgagttgatgacatgtgagacctaatagataagaaggaatcttgccacaagtgtggctatgaaccaaacaatagactaatttggttaaacttgtctaacatgagaggtggcaacctttggcaaactttgtgaacaaaccaaacagcctcgtacgccttcgccgcggtgctcgatcgtctgctggtgcgcctgggccttccgcatgtcgttcggcgacgagctcgcacccgttcgtcggccgccctgacctctccggcctcgaccaggcgggcttcctctctcgccggggcttcgccggcgcgtaccacgactaactgttcgatcgccgccatgcttggcttgagtgtgatggtgatggagccatgcatcatggacaggtcggtccgaggacggagaaggacagggaggcgttcccgccgaacaacgtcctgctcacgctcgccggagcggggctgctgctgtggatggggtggacggggttcaacggcggcgcgccgtacgccgccaacgtcgacgcgtcggtcaccgtcgtgaacacgcacctctgcacggcgacgagcctcctggtgtggctcctcctcgacagcttcgtcttcggccgcctctccgtcatcagcgccgtgcagggcatgatcaccggcctcgtctgcgtcaccccggcggccaggctggtgccgggcgatggtgatgggcggctctccggccgtggttcaccatgaaggtgctgcacaagcggagccgcctcctggcgcgcgtcgacgacacgctcgccgtgctccacacccacggcgtcgccggcagcctcagcggcgtcctgacggggctcctgctcctcgccgagccgcgcttcgccaggctcttcttcggcgacgacccgcgctacgtcggcctcgcgtacgctgtcagggacggccgcgccggctcggggctccggcaggtcggcgtgcagctggccgggatcgcgttcgtggtggcgctcaacgtcgccgtgacgagcgccgtgtgcctggccgtcagggtggccgtgccgcagctcgccggcggcggcgacgccatacacggcgaggacgcgtacgcggtgtggggcgacggcgagacgtacgagcagtactccgtgcacggcggcggcagcaaccacggcggcttccccatgacggccaatcccgtggcgtccaaagccgacgagatgatatggatataaggtgttttgactttggtcatgtttagataatatattaaacttagttaaatttaaagtagtttaattttgtctaaagtcaaaacgtgctataacctaaacggagggagtatttgctaagggaaatgctatagtaagggcataca

SEQ ID NO: 67355 - DNA, 43140 bp, Oryza sativa
gcgaattcgagctcggtacccaaaaaatgaacaacaagaaaaacatcaaggtggttggaaagcagtgtgacacgaggtcttgcaaaattagagaagccaccatgtttggctgccttgcataaatttttgaaaatacgttgattacgctccaaccaaatgttccaccaggaggtgatcaggcaccctggagttctttttcgctgggtttttggtcgaaaggttgagagcaaactccaccaacttttctaaatctaaggtgttaggcaaagtgttttgacctaaaccctttcaagcgcaaattttgttccccacgttgatggtgaaaaagcattctttgaaaagatgagcaatgttttcgaaagcctccctacaaagagggaaaatccaatcacaaggccagtggcgttgaaggagattttgtgcggttagagttttttggtgcaagatgagccagccaataaaacgatgtttcagttcagtaggagctgactagatcctcgtaaaatcgatggtggtgaagatgccttgaaattgcaacatgtatgcactttttgagatgtaatttccgttaggcgagaatttacaaaggatatcatctggcaaacttggatggagatgcacgttctgaatgagggcgcctaaagaaatcaattcatggatcccctctattgtagtgagctgccgaaaggaacatcttttacatttgtgcataggggatttggaaggaggagaaaaaggacaatatgccactccattcgttgggtttagacaaaatgcacccactaaaatgcaaaggataaaataccacatgttaccttaagatattttgccactttgaaaaattttaagaccaaaatacccttgactgtggagagagaaaaagaaagggaaccgttctgctcgctagtgatggaggaggacggcgttgctgatgggagggaggggacggtggcgctgacaagatggcttcgcgcgctcgcagcttgccgcctccgacgctgcccacacgtgggctcacgacaccgctgtcctcctcccccgtcgttttccgcccttgtgcactcaccacccgccggcggcgagcacggacgccgcccaacttgaccttctccggtgcttccctctcccctctttcttcctttctctccacagccaaaggtattttggtcttaaaatccctcaaagtggcaaaatattttgaaggtctcatctattgagtgacattttaacctttgcattttagtgggtggcatttcgtctaagcccaatgaatagagtggcatattgtcctttttctctttgaaggaacatggatgcaaattgtactagtagtatatttgctcgctaaacaagcttcccttgataatagcagtagatatattaggttgaaccagattccctgaacttcctgcaattcaacatgaaacacgttcgtgctgaatttatgaggcctaaagctaatactaggagaaagaacaacaatttttgaacaaaactaacgccaatttgacagtttatatcgattcaatttgtaagattctccaatctactacaattcagcatcctgttgtgatggtaggtttgttgacttgaccacctccccatgtgttagtgttaccaactcatggcattttctacccaatatgattgtcctttgatcctgtccctatttgaaaagcccccgctccttggctgttgttccggacacgatcagattttattatgactgaaataactactagccaccgacgacgtggttccctttgcaaatcatgtgctatctccaggaaaacgtgcacccaagattcattagtgcccaacacgatccgcacctccccgattatccagatatttgcagccttgcacagctatacgtattgtttgtgaaggaaagaaagaaagaaagaaaaaaaacgaagcgttgaagttccttttccttctccagcttcctgtcaacggttggcgacattactttaccgtaaaaagtcaggattaggccattagcagcctcgccctgtttcttgggtcgtcatctactcatctagatgggcaacggagaggaacggcgactagtctggaatctggatagacgccgggcggcaggggtttgaactgtacgcaagggaataaagcgttcgtcctcgatctagatcgcctagaaacaaagcaaaggcgcccgcgaactggaccgggctaccgatgatgaatcagcggtgccggtgtgcaacagccgacgcaacggggtcggggcaagtcgtagtataagacccgtggaaaatgcacagatcacgtgatgaaaaggcccaaaaccaggagaggtggtggaacactggagcgcggaggacgcgcggtgtgtcaacgtgaggcgtgcggccacatatgcctgcagagactgggagggattgtgtacgacttcgcagcggcgcattccccggccgaggccgcgggttggcgcatgcggccgcggtgaaggcgcgcgcgtggttggctgcgtcttccgttctcttgggagggggctggtgcctggtggtccgagtcgtaccatgcatgtgcgcgagttcttcctaattccaacaacgctgactggctgacagtagtagtaagataatcagccattcagcctaatcataaagtgaccacatggatgatagttgagtttttttttccgtgacataaaagacagcaataccctaggtaatcacacgctgcgctctcccgtttaatacgtaacacacataaaccagagaaagttaccaaattaatccacaaaatctaaatgaaatgctacccaaagaaatgcactagcacttgtataaaatgtccaacatcattttctttacgtcgcacactagcaataatttctcgaacgctggaagaaacggtgagagttctctgcctgactctcccccgttactgtgagaacactgagaaaagtaatttctcgaatttcttcaaattccaatatcatttccttgttttcctacacgctgttttctcgaaaacaatgtcagtcacccaaggcagtcaatgatgagctccctgtggtgtacaatgatccatgcgaagtgggggcacacacatcactgaataatccgcaacccaacaattttcccgaccgatctgagagaggaaagcgactcgaatttcatggtcaccaccaactttcagatttttatgtcacgctgtgttttcacatgcctgccagagcccccaagcgaggtccacaccgggagacgggagtgtacatgatgcccgcaccgctcaccgctaactgaataacgccgcgttttctcgcgtttcgcaggcaacaccgccgtgcgctgcgttgcgccgcgtcgcgtgcggcgtgtgcccgcgtcaactaacgcaagttggtcaagtacaataggctcttcggtacaccaaagatacacataacgctctcgttggtgatgcatacgcgcagatgcggtgtctggttggttaacggcaaaccaccgccatacgaacgcggtttgtacgcggtgagccctctcccccacgttgcgtgttcagtttggttcgcacatgtgtagtgtaggtataaccgcttgccttcttttccggtctccttgccgtactagactagactaatatagatgtgtttggatcagggacttaactttagtatctatatttagatattaatttagagtattaaatatagactacttataaaactaattatataaatgaaagctaattcacgagacaaattttttaagcctaattaatctataattagagaatgtttaatgtagcattacataggctaatcatagattaattaggctcaatagattcgtctcgtgaattagtccaagattataaataggttttattaatagtctacgtttaatatttattattagtatccaaacattcgatgtggtagggacttaaaaaagttttagtcccatctaaacatgctcacagtaatacgtcctagtagtactacgtgcctcatctcatcgtacgcagttgtagaattcgatcaagacgttttcctgaaccatttgacttttacgtgtctacgataatataattccatactactccttccgtctcataatataatggattttgacattttgcttatactgtttgactactcgtcttattaaaaaaattatgcaaatataaaaaacgaaaagttatgcctaaagtactttgaataataaagtattaaagtaagtaaaaaaataaaaaaataatttcaattttttaataagataaatggttaaacagtgcaattaaaatgtcaaaatcttttatattaggggacggaggaagtagcaaacaattttaagacgtcggtcaaaactgatatcagatgtaattatccgttttcttttatcaaattcgtcacgcttacgaacgagccaaagtacatcgaaattgaaagatatcgcctccgccgccgcctggatgatttgggcttgccaaaccaactaccagaaatcaggaccaactgagagaaggcagcagcagactcgctaactgaacgagcaggccgactcatacatagatatagagcccacaaactcattaatctaccagcccagtccaaacgagaggcaacagtgcaacacgtcccggccatacatcggaccagtgtgcctcgagacgaagcaaagaacaacaggtcgagcaagcggcgaagggaaaagaagcggagatcgtcccctccccgccgccgactggacgcatatgcgccacggctgccggtgagcttccccgccggcgacgagtggacctcgccccacgcccggctagatccggtgccacccccgccaccacgaggtacatcttcccccttgcctctcgccccgttctcccctactcgctaggttcgctctcggccactactaggctttcctcgcacaagtcgatctagatgcctgatgccgctttcctggtggtttcatctggggcatatgcgagcgctgggtgtatggattgatctatctggttgaacgggtaggggatcctagctaattcctagcacgtatgctcaagggcgaagccaggatttgggaatgggggtgacagaccacaaggctattgtttatatgtatgtatatgctccattgtagctagataagaaacacgtatatgtattgagatacaagagaaggttcaatataggtagctagcagctagctccaacatcatataaatagcaaacaagacagcacatgttttgccatatgaaataaaattatatctcaattaacttaaatttagctctacggataccaggttgatcaaaggccttaataatttcattggaactaatccttgctgccaaatccctttatacgcaaaattgagtatttgactatagtctccagattaggaactagtaaaagtgttgtttaaggatttagggtattagaatggtcagaatttactccctggctcctgtgggcggcagcttggtcagactcgacaacgccacgatggtcaacgacaagacatgatcactaatcggcattgggcagaggtgtcatgaagaaaccgtggtgttgtggccccctagctgcctatctcgatctctcattgttctctcttactaatgggctggctgaagcactgattgggctgggtaggttgggggtgggtggtcgttgattcaagtttcgccacttcgtatactgctgatgtgatatattgtgtgtatgacatgtgaattctcggtagtggtcactatgccagcatctgatcaaatgatcattattcctgtcaaatcatttatcgtagtaccaatattgttttctttctcagtgcaaaccttgtggttttcttggaaattttacatgtaagtttcaattgcatgaattgtgctagtgaaaacaggtctttatgttttttttttggtctttattattttccagtaatgttcacattccaggacgatgacgtctttgcgatattccatatggagaaattatttcaaactaaaatacctactacctgcaggaatgttcttctggccgttcctagagggtcttttgattcttgcaaatgcattggcgatactaaatgaagaccgctttcttgcacccagaggatggagcatgtctgaagtctcaggaaatggacgatcaaagtcattgaagggtcagattgtaggactcatatatgccacacagttctttaggatgccgttgatagcacttaatgttcttatcattgttgtgaagttggtgtcaggctgatactatgaaggtttcagttgttgggcttgattgatttcaatttcaatgtgatgtaaaagtattcacgctaaatatttctgcagctatattaatttgtctatatatgtgccttgttattgttctagtaaattaattctaagcagcaaattgtttctttggcacgtataccatcagagtatgtttgcctgccaatctgctgcgagggttcccttttccttatttctgttctgaatcaaccacacatttattttcttattggtgtgtgttgtgctcggtgttgtttgatattcagatactgcttaaacggaaggtcctcctaggctcctatggtcttacctcatgtcagctggtgataaactggcccttcgtctggtccagccttagctgagtactagaaaatcggcgcgctggataatttatcctgtgagtttttcccctagggcacatgcatagtttctagagtaattactttaatactgataaaatctatgtaaatatcatatattcaaaaatatcattcaatgtgtacttagttttatgtttgtataatacctacgaagaattatagcatgacagtatacgcaaacaaacggtgcatttagtctcacgtttgtaattttaaaattttgtatataagctgttagaattagtaaaattaaaataaaatattttttatttcttgctatcttaaaaaattgtttaaccttttctataatatacttcctccgtttcacaatataagtcattttagcattacccacattcatattgatgtccatgaatctagatagatatatatatctagattcattaacattaatatgatatggaaaatgctaaaatgacttatattgtgaaacggagggagtaggatattaacatggttaagttacatgttttcagctttaaccaatcacacttagcactaagggcatgaataatggtacgatcaccgtaggagagaatgccacacagtatattttttgatgtggaggtgagtgagaggagagaggatacatacgtctattaattggtagacatatatgctagacacagaattttacatagatagcttaacactatatatgcactccatatacaaaatatagaaccaaattagtaattatataatgtaggtaatatgctatatgaattcttttgtatatcgtgtaaatatgatgtgtgactattatagggcaaccactctctgaactatttttcatgttttttttgggacatttcacaccaacattcctataatagtatgtaaatattgatatttgtagaactacttcctccatttcacaatgtaagtcattctagcatttcccacattcatattgatgttgatatttatctagattcattaacatcaatatgaatgtgggaaatgctagaatgacttacattgtgaaacagagggagtactatatttgtcagtttttatatttgtttatacttatcttttttatacacaaattttattattttttgtcttatttttaagtaatatatgaatattataacccagtcaaagtgtgtgcattttttctttattctgttgcagactataccatactttctctttttgagaaatatatgatgtgttagcttttaaaatggcattgacaccaaaatttgatcatcaatattcattctcattatattattattgactataaaactaatactaatttaatgccacaaataattgtatatgagaccaatatggtttgatttatttttttccaagcctgtcatatatgctacaatactcacatgtatgggttcagctaacaggtcagtgatagctaactcggccagcacaggtgcacagcacgggccaatgtagctaggccagctgggatgattgatttttttttatagaacggggatgagagattaatgagagtgtttggcctagatagcagggacgtgaggtgagacgacatccagaagctgctgttatttttgttttctgccgcacgaagacagcaatacatgcgcgagacactcgatcgtttgccgaatgcttcatggacacgtggcgtaaaactgaatgggggtaaacgaaccaatcagcttgctggagaactatttttatccatcttttatcaattgtatacatgtttcctggagaactatttttatcccaacctattatgctgtgtagtatatggtcattcttagttggctttaacattgtgcaatgctatcactgactttttgttattaatccatcatggacttgttaacttttagatgatatccactggaggaaaatggaattttctgttgaaaactgacgagtactcagagcatgttcatcatgcaggtatgctgcgaacctcgttcttgacaaacaatttcgggttcttcacttatttgacatgcatttacctttaatgtttccagtatatgttgccttttggtactcacaacataaccatatgatgttgacataaaccatttgtccattgacatcttccctatagttaaacacatttaagctaagttctgaaacatgccatgagtacgatcaagcctaaatagtatggagctgtatatgtacttttttttttcaagatgcattcatcatattacaattttctctccatcgacctggatagacactgtcattattatgtccaaatcaccaccctattagtgtctatatgcaccttgcactctcgttaaactgaggtccacaccaaattctggttccacaatgagtttcagtgttggagaatgctcatagtttggcgagagcttcaatacaaacttggagatgatgagggaaattagggttttgagttcagccatagcaaagccctgaccaaggcaagttcgagcaccagcgccaaatggcaagtaggaatgtagctggggttgtgcattggagaagcgctctgggttgaattctttcacatctggaccccacaggttgggatcaaggtgcattgtggaaacagggatgtagatgttgacaccttttggtatatgtacacccccaaacttcagttcctgaagggcctgccttgatacaaaggcgccagctgggtacaaacgcaaagtctcctggatcaccattgtcaactacaagcagagaggacctggaagttagtgagctattgtaacaaatgtacaatttactgcaaagtgcactaatggactgctcatagtcaagtcttgttttgttttgcaagattaaaaagatgcatttctttaattgactgaatggaagatgcagaaaaggaaaggagcatatacattcttcattttctgaagggactgagagtctactggctggcctgcacagacctcctgcacttcttcccgtaccctatcctgccactctggatgtagtccaaggagcattagacaccaggcagctgtgacagctgtgctctcatatcctgcaaaatatatactcttgcagttatccactataaagttctctgcctcagcgagctccaccttactgctgcttgcactaagaagaattgcacgtagtaagttcctttcttctccgctttccttcacaatttctagtattagtttgtgcacttgtttgtgaagctcccacgcttgcttgttcctctttatgggaaaaaacctacaacattcaaaattttatctcttgcaactgaattgaaatgggagtttcaacatgttgtctggaactgacaaaagttttaatttatactcttgcactaaagaaatgacatacttggttgctaaccttaggccagtcatttcagctagtacatttggcttggacacagccttttgtagttctctgatctttaaaaatatattctttcctttgatgtagctgcttccaaagcatgttctagagataacgtctgcagagtaagcccttatgtcatcatcaatctttatgtctatggtcccgccatttttgtctattccttcttcccatgacttaagcagtgtttgcgcagaatctaccatcagatccaccatgccctaagtatgtgaaaaaaacaaagaatcaggcaggcaagtaacactcattgttgtcttctgtctagctgtatgcttgttcttaaatctttgaattctaatttactgatgacaataggagaagaataaaaaacccttatgtaagtgtgataaatagctcatcagaatgatccaatgttactgaaagtggtcctaactagagtggggtatagcacgttatcttggtggatcagaatattgtagttttgctgtcgtgagtggtcctaatcagaaattttaatgctcgtaacacattatctagctggatcagactgtagtagtcactctgctccaggctctcttacgttgaactgtaattctaaattgcgtttgctaagcgggaacatgtagatccacatatttatttctccctgaaactatgaggatagctttgaatgcctacttgctggggcctaaggttttcctccgatgccttcaaatctttgttagcaacccaagtctatttgaacatatatctcactgtcagttcttttttggtggctatagtgggagtgacatttcagagtcattctgggcctcaacctcaagagtttcagtttgccataataatttttatttgcatgtatgatagttggatactaactggatattggaacagtgcgatatattgcacataccttgaccttgtccaggaagaactcacgggcaatgatctttctctggtgtgcccacgcctctccgttggatttgaggatgcccccaccgaacaggggctcgtgcgtcgccttgaggtaggagctcttgcccaggtccagcgacacgcagaggttgatgtcccgaaccacgtcaggccggctcacgtgaaggaacacgacgttccccatggagtaagtgaatattggacctgcaattgatcgtaaagttaaacggttaagatcatatatgaataaaaatcgtaagataaaaaattagattcaatcgtaagaacatatattgaagctgtttggttaaaggaaacgtatgtcttttctgccctttaagggcagaaacccactcttattccctttagttatactgtactaccctatgtattcatgttggttttcctctgaaagtacggcaagggttcattttaccattcgtcaatcgatctgagagctattgaaacacacgattgagaaaatagaggagtaggagaaaaatacatggttagcagggctgcacatataaaataaaagactgcaataatcatgataaaaaaataaccgtttggttaggctatggaaaccataggaatttgagagataataaaagacttgaaaggaaatttttcatgaggtctaaaactcatgttgattttttttccaaaacttgcacggattgaaatttcatagaattaaatagggtaaaatcatttgtttcaaaggagcatttatgaaaaaatctgtaggattgcaatcatgcaaaatttctattcatattctaaagtaccggtttcggcatacactctccagtgctagctaactgaccaatgacagtgtaacatgtcggagctatcttgatcacaaagaatccagtccagaaatgccacgcacgcatccgcttgtccaaatcaatccaacatggaaacggaggaacatttgggaccatcaatttggtagtatcatgcctggctcgagagcgctgcccctatcggaaagcatcagctggatgccctgccgggaactgacactgtggcaccgcgtacggttcggccccgtgccgcccgatcgaaaaccaaggcgcgccgtgcagaggccaaaagccggcaggatagacaaacataacccacggcggcgaccatctacggaacaacagtaatacagcacgtacgtcgggcgcactgccggtctcacgcctccctggcggccgccgcctcgcccaaccaggggacgccgccgcgcgcgcccgcccctgtccccgtcccaccctgttgatctcacacgatcacatcgcaaacgccggcaacggttcggaaatgggttaattgggcacatcgctcaccatcaaggctggacgctatgccgttggctagattagaagtggttgttcgaggcagagtggctgatatacgagtcctaattaataataaatggagtaatcttttttaaaatgttaaaaacaactttcttattcttttcacgttctcgttgaaaaattctcaagacttttcacgtactcgttgaaaaattcttatatggtgctcttttaaggtattccatggctgttgtgggcctggacttgatttcctcacgcctcatccatcgacacgtacgtgcggccggcgttgcatgcggttggcgtaggtggccgcgcgcttctatccgggaacaggcgctcactcgtctaaacgacgtgatatgtcggggttttggtgctatatgcattgctaactatgcaagccatgcccaaccaccaatcgggtaaccgatcttcgatcgtgcactagctagtataggagtagtagctaatagctctgcatcaggattcaggagctagccgtcagcaccatgcaaggctgcgagccgcgccggctatgtgcgataaataaattgatcttgatgcctcttatctttttgtgattcatactcatattattgagatgtgacttgattgtgcccccgatgggactttgattgttgaatttgatggccttttgcggattggttttatagcgttgttgactcgtcgcaccatcgattgattgcagttggtgtgttgtatattccctcggtccacatatatagtgaattctaggttttatagagtttaaggctcgggtgaaattgctttgatatcttgaaagtttacttgattaagaaagactatgactagtgagcaataaatatagtggttagatgatataggtaaagtatacttcaaaatctctacattcgtggacataatatgaatttttgaacataaagtctcttatatatcctatatttgtggatagagtggatatttaggaagaaacaaaataaaatgaatattttttagttgaggggaacgtatcctatgcacacacatcttctcgtgtatacactatacacaccaactaacaaacttcaaaaaaaatttctagaaaaatatatacatatacttttagttgtatcataattatgtctaaagtctcgtcttcaaaatcattctatatatggagaaaaaaaagacaaaattttggactatttatacccttaaaatcgtcagaacttttatcttaggctaaaatataatgaattcaaggttaaaactttatacataagtataatgctatcaaaagtacatgtacattttttctaatttttttagtgaaatatgttagttggtatgcatagtgcgtacacggaaagtttgtatccacatgatgtcatatgtatatatgatgtggaattgatgtggtgcataattaattggtttaggctttactaaatatgatatgttgtataattaattgaattttaattattataaacttaaaaaatagattcattatatatttttaaagcaagtttttgcgcaaaatatatcgtttagcaatttgagaaacgtgttaatgaaaattgacatgtcctgtctcacatagctatatgactgatccttgggaaaaaattctttatttgtttctaaagttgatcgattctctcattttatcatggtaaaattggatttttccttttatgctcttcattctcaaattttgttttttatttgtactttccgtacgtgagttctctgtcaacatagcattaattagtacatgtgtgcaaacatgattttgccattgtgcatcattttctgtgtatcagcaaagcttgtttattaattataaataaattatagattaggttttcacggttaagatgtatccataataaatgaagcaacaacaatagttttagggaagactttgatactgcttcttgttaaattaatgggctaggcccaattaaatcctaataaattccattggcctacattaagtgttatgggtaataataccaccttggaaatctaagtgaagaggtctcaacttaaatatggagctagtggagagtctctgttgaccggttgagatggtgcgcggacaactaggcggggcgaggcgaggcaaacagctgctgcgctctctcgttttgtaacggacggtaataaacaacggatatatactctcttcacgactcttgcactccgagttcctcctcctctattcctgagctgcagaatccttccccggttctgttcacctgcgcgcacaggtgtacaggacgagcaggtgcctccgaaactccgtccgcttgagaacttgcacggataggcgggcgatcaagtttttgggtagcgcttcaagcgcgactgctcttgttcttcgcggctactgctgctgcatcagcgccttcaccaagatgtcaacggagattggagacaagaagatgaacgacatcaacggaggcaatactgcctcaaaatccagcggtgggacattttcgaggtatactttcattctcccgattctattagatgtttctttgttaatactcttcgcaatggcagcattgcattactatataaatgtttatgcttatttcatattaagcatactcaagttgtatacatctagcactgtcactagatctactcatattgcaaatgtcatgtttattgtcttaatattttggattaaaatatgccgaattatgaccaaattttcaacacttcttagcttagttgttgaaagtcctagactgcaaaataaaaacaaaaatagctataaaattaagttttaaaatttaaattcgactgactgataagatgacgagcagtcaatgacaattaatttgggcctagcccattaattgggatttaattgggcctagcccattaatccaaaaacttagcctcgaacaaaagtgtacgtgctaaatgtacttcctatcaagtttttggattgttggaaatttggtcataattcggcatattttaatccaaaatattaatacaataaacatgacatttgtaatttgagtagatctagtgacagtgctagatgtgtacaacatgagcatgcttaatatagaataagcatcaatatagataagagaacgcaataatattgcgacagacagttgtaggaaacgaaggacgaatggtaatagtgaaacgttataccccgagaatggccttccgctggagtttgaggcagtattgcctccgttggtgttgacgagaggctccttctccttgtctccagtgttgttgttgtcgccggttgtcgacatgttggtgaagatgatgcagagcagtcgcgcttaaagcactacccaaaaacttgatcgcccgtctacccatgcaggttctcaagcggacggagtttcggaggcacctgctcgttctgatcacccgtgcacgcgggatgaacataaccggggaaacagagagacagcgcaggaacagaaggagagtatcgccaaggaacaatagtaggaggaagacacacactttgagagcctctgccttgcgttatatgtagagagagatctccattaccacacaaataaatctcatttgttgtgaaggttatcacaaaataaatcccatttgttgtgaaggttaccacataatgaatctttcatttgttgtgaaggttacaacaaataaatctctcatttgttgtgaatgttacaacacaatgaatctctcatttgttgtggaggttacaacacaatgaatttcatttgttaatggtgactttattctagtctgttacaaaacgaaagagcagcaggcaggcttggctcggtcggccgcctcgcctcgctacgcccacggccgaggccgactcggcatacgcatatgcgtgtggcagtccaaccatcacctcaaccggtcaacagggaatctctaatatcaccctatttaagttgaggttcttccacctaaattttcaaggcagtattattctctctaacattacttgtgggctcttgagattttaattgaattaaattgggcctagcccatttattccaacaatccccaccaaatttcatggctcacaagaaatgttctcaaaactgaacctgttagttataccagtgtttcgatggagactgttaagttgaacttccacctaggaaaagagctacaccagatcacaactgaacaatagactatgccttgaattattagtcttgtgcgattcaggtttcactcaaacccttaactggtattgggctgtcatttgcatcctctctgtttggagcgtataagtcatactcctggccttttcatgagtatctagagatcacctagatctcataaactgtgactagcagtcggactcatataggtgtgttccttctaagatgttctgtaggccaacatctctgctttatgaaaagccactcagatcacattaaggtgtataccatcctaccatacagattagaagagaagtgcatcatgaaaataggctcattttagggtctcttctctcagctacacaatagtttatttcgccatccaaattcacgggatctccgatcacaatggacaggtttccactattgtgcaactctaagtgggtctcaagcccatctccctcgatgcacagtctatcacattacgtggtagccccttggtaaattgatctgccagatttttagccgtctggacatagtccaatgctatcactccggagtttttatgctttctgacagtctttagtcttcttttaacatgcctggatgacttcatgttgtccttcgaactgttcactttaataatcactgtttgattatcacagttcattaggattgctggtactagtttttcaaccaccggcaaatccatcaggagctcacgaggtcgttcggcctaaactgtggcagtatctaaagctgtgagttctgcttccattgttgacctcgttaagatggtcttcttgcaagacttccaagaaacattgcaagacttccaagaaacagcgccccctccaagtgtgaacacatacccacttgtggcatttatctcatcagcatcagatatccagtttgaatcactatagccctctagcacttttgggtacccggcgtagtgaattccatagctcattgtcccttttagatagcacattactctttcaagagcatgccaatgatcatctcccggatttgaaacaaaccggctcaacttgctcacagcaaatgagatgtcaggcctcgttgcactagctaagtacatcaatgaaccaatgatctgagagtatcttaattgatcccttgctattcttcggtttttccttaatagcacactaggatcataaggagtaggagctgccttgcagtcactataaccaaagcgactcaagaccttgtccacatagtgagattgcacaagtgtaatcccaccctcatgtcctctcagtagtttaatgttaagaataacatcagccactcccaaatctttcatttcaaagctttttgacagaaagtccttgacctcctcaatcacattgaggctggtcccaaagatcaatatgtcatcgacatataaacacaagatcactccctctcccccaccatagcgatagtacacacatttgtcagcttcattcacaacaaagccagcagatgtaagtgtattgtcaaacttctcatgccattgcttaggcgcttgtttgagaccatacaaggacttcagcagcttgcacaccattcccttctgaccttctagtacatacccatctggttgatccatatagatctcttcctccaactctccattgaggaaagctgtcttaacatctatctgatggacgagtagaccatgagaggctgccagagcgagtagtactcgaatcgtggtcaagcgagcaaccggtgaataagtgtcgaaaaagtcctcgccttctttttgggtataacccttggccacaagccttgccttgtacttttcaattgtaccatcaggcctaagctttttcttgaaaacccatttgcatcctacaggcttgcacccatatgggcgctcgacgacttcccaagtaccattagacataattgagtccatctcactgcgtaccgcttccttccaatagtcagcgtcaggagatgaatatgtctcttcaatggttcttggagtatcatccacaagatatacaatgtagtcatctccaaaagactctgcagtcctttgtctcttactctttcgagttgttacaatattatcctcctcaggatttttctcaagcgtttgatcaatatgttctatcggcacaaagtgctcaggggataaaataggttctttactagaagtgctaggtgcatttttcataggaaattcattctcaaaaaatatggcatttctagactcaataattgtaccaacacgcatgtcgggtactccagaatttactattaagaacctatatcccacactgtggatagcataaccaaggaacacacaatctacggtctttggtccaagtttacgctttttggctataggtacatttaccttggccaaacagccccatgtgcgcaggtgagagagatttaatttcttcctttcccattcctcgaatggtgttacttccttatgcttagtaggaattctattcaggacatgacacgcagtcaatattgcctcaccccaccattccttggaaagtcctgcagtgtctaacatggcattcaccatctcagttagagtgcggttctttctttcggctaccccgtttgactggggtgaatagggagccgtcctctcatgaataattccatactcttcgcagaaagaaataaactcattggaaaaatactctccacccctatcagacctcaactgtttgattttcctttccagttgattttctacctcagccttatagatcttaaagtaatgtaatgcttcatcctttgttttcaataggtacacatagcagaatctagtgcaatcatctatcagtgtcatgaaatatttctttccccctttagtcaacacgccgttcatttcgcacagaccggaatgaacaagttctagtggtgccaaatttctcgcctcagatgccttatgaggcttgcgaggttgtttcgattgaacacaagtatggcacttagagcctttgactaaaatgaattttggaattaaactcatgttggctaagcgtgtcatactaccaaaattcacatgacagagtcatgaatgccacacattagactcatcatcatcattgcttacatggttcacaactttattacacatatcatccaaggaaaagcgaaacaagcctccgctgtcataaccttttcaaataaacgttccatattagatacgacacatttattagattcaaacacaagtctaaaaccatctctacacagtagagagtcgctaactagattcttctttattgaagggacatgctgcacgttcttcagctgcacgatctttcccgaagtaaacttcagatcgatcgtatcaacaccatgaacagctgcaagcgatccgtttcccatcaacaaggaggaacctctcccgacctgataggaagaaaatagggaaatgtcagcacacacatgaatattagcaccagtatcaacccaccaatcaggtgagtgacagacagagagaactgtaggtaaaaatttaccatacctcgatgttcctccgccctcactaataaccatgtttgcagacttcttgtccttgcgctcaggacaatccttggcccaatgcccagacttgccacacacaaagcaatctctttttgcctttcccttacctttcttcttaaaattggttgtagccttgggtttgacgtcaggtttgactttcttgttgttgttgtgggatgcgtgagggttcttcttctacaccaaattggcgctagaacctccctcgatctttttgcccaagttatcctttgccctcgccttctcctcaacacccaaagagccaatgagatcagtaagaccgaactcttgcctcttgtgttttagagaagtagcaaagtctgaccaagaaggtggcaatttggcaataatgccacccgccataaacttgtccggcaactcacaattgttgttctcaagttcctttgccaacatttgaatctcatgagcctgtctccacaacagaacggtcatcgaccatcttgtagtcatagaattgctccatgacatacagctcgctgcggcgtcggaaactccgaacttggcctcaagtgcatcccacatgtccttccccgaaagcatgtgcatgtacacatccactatattgtcagtgagtacactgatcaatgctccacggaacaagcaatccgaagcctctaacttagccttctcctcaggagagagaggcggttcactcggtttgccccgtgagacaaagaaacaatgcatcgttgtcaaccacaaaagtgtacatggtttccatcttttataatttgaaccatcgaaagcatgtggttttagtgatgcaacaaagccaactaccgaaaaagacctagactgcaaaataaaaacaaaaatagctataaaattaagttttaaaatttaaattcgactgactgataagatgacgagcagtcaatgacaattaatttcacacaatatactaaatttaaagaatttcgcataactcctgattacgaaaataccatttaggttcaggagagaaattcaaccttttgtgcataacaagctagtatagaaattgctgaccatgcatgaaacaagttaaggggaaaaagttgtgttttcacccgcctactaacgacggtaggttgatggaaagctaacggaaaggacaaataaaatatgaaaagaatgagaatgaggagcaaatttcacgagagcaaataagggaatcaatcaattccgaagggcatctggaaagctaacgaagaagtttctccttggttttaagtggaagtctagtgcatctgaacaggctggcaaaaatttcaatttcctgcggtaactaaaactatttgactaatcgccgggtacatcaaattaatatgattgcattctagtgcaatcatatcatctgaacaacagatttaattaaatgcatgctcgactgcgatctttcaaatagggaaaaaggctaggttacttttatgggagcagagttgcacatggtgcagcatgtatactcagcttgatcccagcagtacttgtccttttgcatcgtttcgggccaaaactacatgacaggatctggctagctattattcaccccgttccataatataagaaattttaatattttacttatgttgtttgactattcgtcttatttaattttttaaattattattattattgacttactttattattcaaagtactttaagcacaatttttcttttttatatttgcacaattatttttaataaaataagtggtcaaacagtagaagcaaaatgttaaaatcccttatattatattatgggacaaagggagtactagcttatatatatataattagtcacctcgacactcattccagcttaatttctttatgattttaacccctttcaaatctttacatacttgtcatgatcttcacctttctatcaaatagctagggtccaaagaagttgtagaagaaggtgatggccagctcacctaatgtaatcttgctatccaacagtaacagcgacggggagggttgcttaattagcagcaacgagttggacgtgaacagtagtttagccaagctgttaacgttgggatggctacaattaaagtaagatcaacatcaagatgcaaatggtggattgattaattaattttagaagtaatcatttccggggcctgaaagggatgtcacttggtgacacagtagatatataacgtcgtaatacctttttttttcattgaaagaagaaattaaaccttttccgttttggctactcgaaattctgtctcagtggcttggctagctcagtaatgaatcaactattgagcgactctgtgttctgttactgtagtatattgcactcactgagttgcacggctgctgccataatctgttaactcagtgatgttatttttaaccaatcctagagaagcccagattccattggtctctagctactagtacctaaatttgtgggacccatggttccctgaacccacattttaaatataatataatatacttatggttactcttatactcacttttacatttactgtcaaatataattgatatcgccaacggttgcggagatatatagacaaacagtccaatagtacatcatggtcaaacaaacttgagtgaaaacaccagtactgataatagccatatttacctcagatgcgattagtgttagttttggtttcttctaataattggcctttgtatatatgcagtacgtgcccagcctccttggaagattaattaattgaagaaaacattgaatatttttttatattaactaactaggcaacaaaataaattaaaacgctaacgccaacgtaagcagagcaatgatagataaatcgcacacatgcaccaccaaaattaattaaacgatcgttcgagttcgatcgagcagctgatgaggcgatcgagagagcacgtacgtaccgtagtcttttctccacttctcgtagaagggcagcacggcggggcggtagtcgtgcacgatgccggcgccgctgccgccatcgccgctgtcgcgtgctcgccgtcggcgtcgcgcctccgccagctgatgcctggcggccgcgacggcctcccgcatgtcggcgaggttgccgtaggggaaggaagggcgcggcccgccgatgccctgcctcctgaactcggcgagcacccgccgcggcgccacccacacgacgcggtacaggtacgccgcgaggcagcacgcccccacgcaccacaggctcaccaacaccttcgccgccaccaccaccaccatgcccacctccatctctctctcactcactacgactctctctacgacgttaattaactaagcttctcctcctagtgtttgtgtttgtgtgtgtgcagagagaatgtgagtgtgtgtgtgggcgcgcgcgcgcgtgtttcagctggtcgtcagtgttgtgcgtgtatgtatagacggtgtccggccggggggggagaggggccggggttgcgagagctagagtccaaatggtgactttggcgcaaaaaaaaaaagatactgaaaaaaaaggagggaagttgcactcacacatgttgtacatgtatgtaggctacttcctccgttttatattataagattttttagcattgcttaaattcatatatatgtaatgaatctagacatatacatatacatagattcattaatatctatatgaatgcgggcaatgctagaaagtcttataatttgaaaaagaggtagtatgttatgttagctagggggtgtaataatacaatgcctccaaagtgcaatgtctatccattatgttgatcggatcccttatgttttagctttgttggtgaatatccatctcgcctctgtgatgaatgaacagatcaggggagagctagctgaagtgcagctctcaactaaccgatcttatcccggcaaagacgtgcgacaacctagctgctcattatattttcgccttttcgggtgtaaaaattagtcacatcgatcattggatacggatggcaggatggggctttggtcgcctgtagtcactagtttttcacaagcaatgcatgggtgcaaaaggggtaaagatgcatggggtgtttgctttcacccattcgatcggatcaataattggcatagtgtgtccagggtttgcattatcgtcggtttacgttcggcaacagggatttgctattagtgtgtggtaacggaaatcacaatgtatattcaccaagtttaatttttattttttaagataatattttttgtgtaaaatttgtctagtttttattggttttgcttggtaagtggtttggttataccgctaaccgacggtaacaaaaaaccaaaaccctgacagtgtgccatttatttaggagcaattttacggtctttaaggatgtacatgaggtaccacgtttttttattgtaaatttggtatctctgggtacctactaccttgtcccagaaaaagataaactctagctacgagtccaggttcgtagctactaacatggacatatgcatgtgtccagattcgtggttaggattggacttttttttgggacggagggggtaggtactgttaggtatcaaattttataataaatttttagtatctcatgttgcctcctcaagaattgtaaaattgatatttatttagagtgtgaatatgtgtgcaccttgattcaatgtacgagcagaggccttggatctgcaattttaagtacaaaaatgtttcgtaaaagaaaccgagtgaaaaagggagaaataaagtccatctccggtacacaaaacgatgtatacattaatgcatgattaattaaatttagctattttttaaaaaaatatattaacataatttttaaaaacgatgtatgcattaatgcatgattaattaaatttagctattttttaaaaaaatatattaacataatttttaaagcaactttcgtatagaaaattcttgcaaaatacacaccgtttagcagtttaaaaaacatgcgtgcgaaaaacgagagagatgagttgggaaagtgaaaaaagaactcagccgtatatcaactaagaacaagttgaaggagaagaaaatccatatttttttaaaaaaaaagaggaaaatcagtattatgcgcattgctttgattccgaaaggagaaacgaagtccatacattaatgatatcttttgtttttgcttggacatatttttgatatcgactaacaaacaggacaaaaaaaatgtgattccacacgtgggagtgcaaaaggaaaaaaataaagcctatatatattattaacatattagttatatggacaaaaaggaaggccgaagaggcatattttgagcacgtatctgaattctatggacattacttaaagagagcgctgcccacatatcaatggcagatagattcgatcctctctgcgatcgatctcacgaaagaagaaaaggcgaaaattggacatgagcacaaagtataatcacacaatatatcagtgcttttggagtagtctttcaatcgatctgccatacatatatttctccacatacgttgtactattatttaaaagtaagtgttgatgttggatgtgtctagctagctaagtgtcatgcttgtgcggccgtgcatgcatacaacggatatataggaatatatatattacatcgtttgtctaatcggacaatccaaaaatatcaagagctccatcgattggcgacgagctgatcattataatgccaaatgatttattagcgacccaagattagtatatatatatccttggagacttaaaagtcggatgctgaaaaagtaaatacatcaaaaatatcctaaaatcatctccaaaattaaattttaaattaaattttggcagcgcttaatttcatataggacaaacaatgagactgcaagagttttatgtgttgctgaattggcgggtccttagtccttatatgtgtgttgctatcatccttgttgctatcgtgggagatgatttagagccttcttggcacatttctttctaaaaggctacattttattttaaattttagaatttggtttttaaagttaattttaagagttttcttggcctcttttattgcccaagcctttatttcacgattgttaagaagatgactaattttttaacccaaaactatttaaaataacacatttaaaaatttaatttcttatggtactatcgaagtggagtttcgtccgttcgtctgtcatccctctcccgttgctcacgcagcaaattaaaaatttgctccgcgtaaaaacctagctagcccattaaaaaaaaaacaacccaccctctatatgaaaagagtcccaggactaatataaaaactgcatataggaaaaaggaggaattaattggtgctaagagacccacacctgcaaccaaatgaaaaccaaccctttgcattctgcgttaaccaaatagggcggaaagaggagaaaaacaaccatacttatacaccaaatgtcaacctggaatatttcttttaccttgcatgagttgcatgacaaatttagatttctgttgcaaacgtataggcaattatctggtactttagaaaatgcaaccaaggtgaagccttaattttttattacaggaaacgataagggaaatgtggatggtggcaggtagatttacatgcccaatagctgtaaaacaagatacccgatgacagtacagttgcagtgagagagatagagcgctgatggattacaggttggttctgggctgtccggctggagttgcgcccacaactgtgaggcagtacgaaacattagatcatctgggggcctttgcattgcattgcctttgccctgcatgcctggcctgaccaagctgagcaaagcccggccggccaccagccgcagccagcccatgtgccattcatcaattcctctcctcgcctcgtacaacagcgtgcaggctttacacctgcctgccgccctctggattagtttcactgctccctttatatccataaatataaaggattttagattgtttagtaaagttaaacataaaattgcttggatgtattgaagagtttattacttgattagaaaaaacaatatccttttacagtgcttaattgtaaggtatctcacatacctcccaaactcctaaaaatccaccgttgattttgggagggtaattaaggaaaaaaaattacgcaaacatggtttgcattgtgatttgtccttagacgtgattttctctaattcccttgcatttgttcatttcttctcccacggcgatgaaccccttatccctgattttcatcttcctaatcaccatagatttataaatttattgcatcttgaactattatatcagttaattaatatttagttacatatgattaattatatagttttataagtagttacatgacctatcatgccaataaattacttagttttactattaatttcgtaattcctgatcaattacctagttttggtacatgatctgcagcaattcgtgatcgatattgacaccctgtaatcagcgttgctagctcctgagtgtcatctttaaattcctgttaatatatttttaccgttttgcctttcacactttgacgtggtaatgatacaaattatctacttaaccttccactaaattacctagcccacatatcaaataccttctaataggtacctttgtgtttcaaatcgttagattgaacagaatcaacggatctcgttattttgagaaacacggatctttcggctagctcaataagggtgggctagacgatctgggtctgaagtttcaccccttctagttatttgatattaggtcctttcgtaatattgatgtcttttttcttagatctccttatttccaagcacaatagaaggtattgagaagatagtgctcctagcaatgtactattgtctgacagaattgagaagatagtgctccaaaaccccttaaatttgtgaataatttttaaaccccagaatatgttactctttatatcttaaaatataagaatctagaatcagatatgatattttctaatactacgaatttgaacagacaacctgtctagattcgtagtacgagaaaatattccatatgatgttactccctccgtcccataaaaacccaacctagtattaaatgtaactcatcctagtactacgaatctggacaaatatacgtccagattcgtcgtactataatgtgtcatattcagttctagattaattttttttaggacggagggagtatattccattattttaggacggactactgtatactacctccgtcccaaaataagtgcagctatgagtttccgcgcccaactttgatcgtccgttttatttgaaatttttttataattagcagttttgttgttataagatgataaaacatgaataatactttactcatgacttatgtttttaatttctttcaaaaaaaatttcaaataagacgaacggtcaaagttagatgctgaaaaccatgattgtacttattttgggatgaagttagtactattcctatgaggatcaccgtactgattttgttggatatattcgccgggaatcgtttcgatcagctgagctgatatgatgtttgtggccaagtggtggttgagtggttgatctgcaggccccgggcggtaggcactaggctcgagtgtcaccgtgagtggagagctaatagctgccccgtacagaatgaggccaaccggttgagacgataaggccaaccggctgcgtttccagagttgaacagatattttttcgcacgtatatattttaaactactaagcagtgtatttaaaaaaaatctttttatataaaagttgctttaaaaatcatactatctatttttgaagtttaaaatatttaatacttaaataattacgcaataatatcttatcttattttaagtatcttctcaatattatttattcctctctctcaaacacactaatatgagaagcattatagtaccatgtagactaggtttatgggtttaaaatttgagttttcagcaagacaagttgctttaaggatggttttgattttatattctagtccttaataccttttgttttagttatcatattttctcaatttgtgtggagattcaaaatttacaccgaacaccctagaatccagaaaaaaatacaaaaatctccatcccccctctctcccttatcctctcagcatctccctcaatctcgctaatcgctaccggcggtgactcccggctcccatctccttctgaccaatgctcctcatctcctcccccgaccggcggccctcctcccctggctggcatgcgcgtggagcatgttgaaggcgagatcgacggctcgggagtgggggatggcaagacttggcggtgcagatttgggacgagctagctcgagctcctctccctctccccctcatgtcttcctcacggccggggccctctcctcctcccccaaccgacgcctctcctatcctctcctctccaccccacctagtcgacgcgctgatgagttcaacggtgcggcacgggggaacaatgatgagctcagtagcgtttgtcgagggcagtagaatgagccgacaagcttctccagcccccaccgccttccccatcgagccgtgcgggcttctccagcgtagatcaaggtgggcggttagggcaccatcgacagcccaacaagctcccttcacctatccccaacctccatccctcaccaagaaaatctgcattcaccacctccactcccctgctggcacccatctcccttcaccactcgatggcgacagcgagatccacaagacggtgaccacgagctgtggatgggctgagggtttgagaaggccaccattgggctactgcggcggacgggtcgaggccaccgccaccttctcgagctcatactcatcgtccacggccgtgatgttgccgacgcaacccaagtgctccacgaccatgaggatgacgcccggtcaccctcctcccctagccaatgaggttggcggcgtggagcgcaggttggcgatgaggtccctatcctcccttctctagcggcaagggacatgagtgtaggccagacctgcaaattttgagcaagaacctatggctcatcttgtctccgcaatcttcatagggcaacgagaatggcagacgtggcacctatggctcatcttgtctccgcaatcttcatagggcaacgagaatggcagacgtggcatggaatctctgacctatcatgctgaggctgaacgacatctcagtgcattgtgaaagcaccaagagcaagttttatagtgaaggtgacaattacctttaattttagtcatatcatttactaggaataatcattgattaagagataacatgtacatcaatttacacaaatcccaataattttttgttggttcactctcataccatctcactttgctcttggaatttgagtagtggtggctcatcctctctcttctcacttctccctttcacctcatcatctaatcttatatggtatttttagagtacttgctctaaattgatcggcgagcgttcacgatacagctggataagctcgatgtaattcaaggatctgagtgatcagcaatatgaattgtagaccccggtgagtttacctattggtagttatggatttattcttacttcttacagtacatactcttgttttttagttgtcggtcaatgtcgatccagaacccattttctcgagtaggtaaacctgcctgtgtccaagtgtttgcgaaaataggaattcttcaatcggataacacaaccacgagcaaaaagatttttttgcaggagaacgtgttatgctgcccatatgaaaaagaatttcggcgaaaaaaattccaaaaaccaaaccctagcccccaacccagaaaaccctagccacccccaccgccgccaccaaaaatacattgccgcacggtggtgtaggcgcccatgccgtcttcgagctcccctgcgccggatccaccatctttgaggtcatagtcatcggatccgcgtcgttgaggccgttgctgccacccgctcgtggtccctatcgttggatccgccgtcgatgaggtcaccgctagcaaaaagtcgttttttaagtagtcgatgcctcttaatatcatcttgacttgaggcaatgtaaataaaacatataggagtaacttccttcagctatgtaccttgctctaaataatgtcaggccttattcgttttgaaggattcttaaaggaaatctcaatccctttggaataagcactattcatgcattcggtttgtaggattcaaagaaaaattttccataggaacattatgccaatcctctaaaaaacctccaaaatgtactaattccataggaatgaaaacatccactccattctcttttgtttagctcattgtagaaaaaattcctgtgttctaatcctttattttacacgtgtatttctatattatttctacgtttttcctataccttgaaccgaataggccctcagtatgtgtgtctcttcaaaacaagttgcctgcctagctactaacgtttgcagcctaaaattggtcgccagtacagtgaccacttaagcgcacctaatatgtcagcttgttcgatccttatcctgttagtatttgtgattcattcgctcatttctccataataattgaagtgcagactacacttcatcctcccgttcttggttagttaggcttgcatatattactttatattgatttgctagagtttgtatcgaatacatatgatctgtttatatatcttgtccttcacttattatgttcgagtttttatagctgtttggtttgcacgcacgtcctgaagccacatgttctaatgtgtatcttaacgatgatgacactagtggtaaaaagttaattagttggtttcactctcaatgcatgcggaatgtgtgccccaacaggaagattcatcttgtatccttgtttggcgttacgtgggccgaattgttctgttgtcttcttttttcaaagataaactagctgattgccatcctttcttcttacgtggtgtcacctggaccctttttttttccttaaaaaaaagataaagtactccagattgtccagtgcaattttgcacggagttaatctgttttcactagaagcaacctacagatccaatgtaacttatgggtattccgaatacccataaactttagacataaacctagcatacatagggtatactagtaatacatacctccatatcctagctagatttaatatctatacctctaacaacccaactttatccccttctagctatcctctgtccaaaagatcgagcaacgggctctccctagtccctcccagtttggcaccattcatgctaatttggttagctcactcgcttattggcttcagcaattgatgagcaattagttaagactagtatatatctctgaatgttgtatattcttctatttcctctgtgcatatagcaatagagcttggttgtagctagcttcacccacctagttgtttttctctccattttgttatgtaattgatgccaattatcttaaagaagaagatccattcaattgccagtagtttctttgtggttgcaagtttttttcttcgtcaacacaagaagttaaaatatccttgctacataaagttgtcaaccagtgcaatataatctcccaaaagtctgattgtttggtactcttgacaccttaaattaacatgcagagctcctaccaaattttcttttttaaaaaatggtttgatgccaattataacaagtcatcaaattccttcttttaatatatatatacgcacatgttgcgatatgagtggtgtaattaagaaaatggtgtgtatcaataccatcgacatattgtatcgatatcactatatctaagcaagctactatagtagtttacaaatccgaatgcctccctaagaagatgaatctacacaagaaggagattgtgcaaacccgttttcggcgattcttgtgtagaatccccaaagatgaatctacacaagaatccgaatgcatcgagcaacactatgggcccagcctctacacattttattgacataaaagcttctacacatcgaggataggattgtagtttcttcttgcaaagaaatcctctcttcctcccttctatccatatgatttgttcatgtaaagaattctgtacttgattatctttcaaccaaaattcaggtggggaaacccttaatttcttaaagaagaaaacccgaatatcctataaatcctagctctaccactggttgggcctcaagccagcccatttgtcacccagcatcgcggcctaatttatatggcccagaaccgtgacattgattttgactgttgacatttttacacctatccatttgtgctttgttttggacgtctatgaaatgcaccgtttgaaaattctacaagatgacttgttggcattgaaagaggccaatagtgatatggtgatgttgtataccattgcttgtcatggtgatacaagagaatataggctgtcctatttatgaccttcgaactaatgtcagtaaaaacgaggccataacttctctaatacattactgcacatttgctgcacccaactgtttttttgggtcatggccatttgacaaatcctcatatgccagagtataccagcatttagccaatttatgggaagagctcacatatggaaaaatcaggtgaaaccggtatgttagtaatagtaaattagtaatacacaaccaaagctcttataagcatgcttaaaatagcttatagaggagtatttttttcacaaaaaaaaaacggaactcatattttgtgacacatagaagataaagtattttaggacccttgtcgcatttccaagatggactgtgaacttccttcctttcctttgtactctctgtgaatttgtcatcttaactcctaagttatcactctcgcattgcttattatccataatctgctataccagaatagcaagctttaatgtcctacaagataatggcgttgcattgcctctattgtccaatcaacaattccatggcaagaatgcattaaaataataggcatagatgggctaccagctggagtagttacatcttttcctttatattgtatatcatggaacataaactctactgttgtgtggtactattgccattgtggcccttagaagaagaggtgaagagatgtctggaaaagggaagaggcgaagtgctagattactgaagcttgaagagcagaagaacgatgacactactgccactggttgtctcctagatccttggcagataatccgaaacagcattgctggtgttcgagggaagagaaaaaggaatgaagaaatccaggtaattgtctgtctaggtagtcattaggtaccctgatgaactctcatcaaccttgccgttctcatctcatcttgatctgtatgttctttcagcatttgcagggagaagcttcttctagccaagcactgtgtgcaacaaccgatatcagtaagaatatttgtttctttttgttgtctcgatgtggtgttgcttgtgcaaatctgaatttctgtaagagagagagaaagcagcatatctgaattctgccgcttcgtctttcagataatttgtcaagcaaaagttcagcagtacaaatcattgagtacattcttgatacactagagatgtaagtttgaactatcgtgttcttttggcttccacatcaatcggagcacagattttgtatgatgactgatgttaaggatatatatatatgcttatattatcttatcttttcctctgttgcaggagagacactcatgagttatttgcaatgcctgatgacatccaagtaagccatggaggaatatatcaaaaaatatttaagttcatgttaaagaatgataatacgctgtttgttctctcatgaaaaaaaacattaacaaatcacttatttcttggtttcatgtgctgatgtactatgtgttattatcttatagaaagataatttaacatgttaacgcaggtaactgattatgcagaacgggtgaacaggcccggtgactttgcaacattaaggcagaagaacaaggatggcatgtacaacacactggagcaattcgaggtccacctcgttgctcatttcccaaatcatcctctcttctgaacatataaagctgaatattatcagttttatcggcttcctgaaattcatatgcaactgcagaatgatgtttacatggtgttccagaaagcaatgtccataaacagcgaggacactataccttacagagaggtcggttgtatcaaaacttagatagtacggagtatatcacaatcacatcatagatgtatcatgtatcaaaactttgatgataataagctcactaattcgcatggacgttttctttgtttcctctcttttgcaggcaatgtcactgctacatcaagccaagcaggtattcctgtccctgaagagcaaccagatgtactcggagtcagagctcgcagcgtggcgccagaaaaatctggtgagccagtcgccggccaagctaaacgggaaattcgatggcagcaaagtaggctccggctccggcgccggcggcgccgctccgaccacaccacagcggccgagcgcgccggcgaggaagaagatcgccgccaaaaccggcgctgtcgccgccgccacctcggttaagagcacaacgaggcagcgggcagcgagggagagcaacggtgcgccgggaagaagagcaagaaaaggtaagcgagctgttcattgagtgtttcatccgccgtgatgtgatcgagacgccttacatttggagctgcagctgcatcggtgacgccggggacggcggagcacggtggcgccggcgccagcgccaccgtggagcagagacggttagcctacgccgacgaggctgatcacggcggctggcggccagtgcccgtcgtctccactggccagcacgccactctcgtttacgtaagcccggcctactgtatcgagagattagaatccatctccagcagcctagcaatgttccattctttgaactgaactgaagtgaagctggcttggcgccgtttttcttttttttttcagcggccgcagacggcggcgcacacgtaccaggatagcctccggcgattcgtccggcacgccgggcttaaggcgcgcgtcgccgccgagttcaggaacctcgagtgcgacgtacgggccaggcaggcccgcccggcgccgggctactgccgaactgtggtttcgcttccagctccggcgccggcacggccagcaggtcgttcctcccgcaacggccgctgcccgccgccgtctcctccgagcgcggcgttcggaggcggcggcgctgccgctgcatcatctgccgacgctgccggcaacaaggcgccaccgcggtgcaggctgaagacggacgaggtgctcaagctcctcgtgctgatcggcaggccggcgttcatggagagagccaggagagtgctcggccatgagcgccaggagagcagctcaaagcagggacacgatcagaaaccagctgtgaccagagccggtgacgacgacggcggcgcgaaggccggcgtaacggcggccaagccagggaagaagaagggcagtgccagcaagccagccgccgtcgagttcgggccattcgcgccgcccaagctggtcatccccggccggcagctgggcttcagccagttcgccggctcgtcctcccaaccgttcaaagtgacgcctaccactccaaatgttcctgacaagaagaagaagaaacgaggttgaaccaaacaagctgcagcttgctgctccaaccacatcagcttattaccaattctttagtcctgttgggaagaatggcacaataatcttgattcacttcacccttattatgcgtttatatgtaaactggaggatgactactacctctcgttttcgacttttcaaagttaaacaagaccaactccaaaattcatacgtagctcatgtagtacagtgatagacaagaccagcattaacatgcacatctgatgatgtctccttgaacattaacatggagcttatttatagcttaaaactcttcctaacaccatcgctcttaaagcgttgcacggcagtaagccccacctacagggtaagctttctgcattagctaacctcgagagaccggaccatcagacgaagagtaacagttgcatcggtattaacttttccagttatccttggtcttcctaacttctcgcagggcctcaactggcgacttggcaccaaactttgcctgcaagatcgatggcattatctgcataagcatcaccggcaaaggaactatcttcgaaattaagaattgatagttgttgattcttgtcagtaagaccgcaagtttctaaacaatattagctttatcttgctgtcaacctccatggacgcaaagatttttccaacacagccacaaagaaacatagcatcatgttgaacagatgtaactaataagtggattagaacctgtatttctggcagatcaacacgcatgaaggtgtttgtctcaaattcctctcctatagttgatggaatagttggttggtttgcttcacgctgcttttgagcccattctagtttctgcttcactttttcgttatctggctcgaccgtcagtatgaatttcaggttcttcacagtgtactgtaagtcataataagactagtaagaataaagtatggctgttaccttttttttttcttttgaatgacaagaaccataccatgataagtagaagtacataacaaagggcaaccaaaaatttccttggttgcacacataaactaatggcaatcacgttatcctccatttatgaagaactgacagcatgaacttatttttccttaatgcagaaggccagaccacattcttttttttgccagaaaagaacacgttagttattatccttcagttaaggctgcacatactagcctcatctagtttgtaatctagattcaaagcttccagcatctttaataatggaggtttatggacaggtccaaattaaagtaagaaaatagcatggaacatgaagtagaagccaaagggataaaacatcagttgtcaacacaaatcacgaggaagaaggaaaaaaataaggcaaggcacacagcatacatatcctacatatttcactacagattcacatccctcaaaaatggaggaagagcaaagaagcaaatgggggaaatagaaaatgtacctcatgcccgcagtaaacttgagttggcttaggcagcgagcccagtgttacacaaagggattggtacatttgctctgcagtgccctcaaaaaatctcccacaaccagcaatgaactataccaaaaaggaaggtcgatatgttaaatagaaaaggagccatcactgtaagtcagatgcatatactaaccaaggtgtctccagtaaacactgctggatcttcctcctctttactagtgacgtaatagctgatatgtccttttgtgtggctgttagaagaagggaaatgaaaggactatgagatttaagtaatcaacaagctgttacagaaacatataaaaggttgactagactgtacaaccaatgcactacagcaatattgtttaagtctttgtgctatcaactatcgcttagttgcatgcgaagtccttgaacataaatgtttcataaacttctcaattggcaaatctgcaggatgggttattatagtgagtacaagtggaaacatgttggatttgcctatctgttattgtagaggtttaaatcctgatcttcagtgcttctatgattccatcgaagtaatcacactgatgataccataaatgaaatgtgacttataaagaaaacagcataccacggtgtgtgcaggcatagtatctcaatgtccttcccaagggacaatttggttccattctccacctgatcagtgcatcctttcacattgtccagggatcctccatagaccttaatccctggcactgactgcgccatcttttcattgccaccagcatgatccctacaaccacaaccacggattagttgggcttttcaattaccacttctctacatcgttgctaatgaattcagcaaaatctggcaaataatattctatgcatagaatgcacctgagagtaatcctaaaaaaaatcaatccttttaatgtatttgtgtttattttatcatatggtgcaaagcacttcctcagccgcatgctcagacaccgtatttctcaatttattataaaatcctaatgcaataaatcccaatctgcaactaactaaaatcactcactttctggtggtaggtgattggtccctgagggtgggattggggaaaattttggcacagcactgattgcatcccataggaaactctggaaggccaacatttgggcggaatttttccataactaaactagaaggaggactaggacgctcaccagtgatggtgggtggtgagtacgcagtcgatgcggacgccgacctccgcggccgccgcaagcaccttctccggctccacggggtcgacggccgccgccgacttggtgctctcgtccacgattcttcaagaacaaaacgaaggataatcaagaaagagccaagaaacaagaaccgaacatacagacaactgacaaggatggattcaggagggtacaggtaggcatagttgtcctccaggcaagcgaccgggatgatcttcatctgcttcctacgcggagagatttggattgggcttatggtctcttggcgagatttctggagccaacaccgagtcgcgacgaagatgagcaggtgtaaacgggaggattggtgtgtgtggaaggtttaagaaaggggaaaacaggaaaacgcagccgcttaacgtagaaaacggccagccgcttaggataggctgacaagggaaaaagattgcttagccggcacccggcagctcatatctccgttccaaaatataacgatttttagctacgaatttatatatgcatttatctagatttatagttaaaagttattatattttagaacagagagagtatatcactagatttttaaatattggtatcatcttatattacttgatacctacatatataaatttgatatctactccctcaataaaaaaatgtaagccggcacctggcagctcatatcactggattcttaaatattggtatctacttatattacctgatacctacatatataaatttgatatctactcctcatatcccaaaaacaaatctataactagctgtctagatactacacattttagtacaacgaatctggatagatatattttcagattcatagtgttagggtgtgtcacatccagtacaggttagttttttatagtaaagagagagtacatagtatctaagggcaatcacaatcagtagcgtaactaggatgtaaagtaaaggttgtccatctatatgtactgtgtcaattaaaaaggtggttcactgtataatttttattatattaactagtacatataggttgtgtttagttcacgtcaaaattggaacgatgtgatggaaaagttaaaaatttatgtgtgtagaaagttttgatgtgatggaaaagttggaagtttgaaaaaaaaattggagctaaacaagaccatactatagttttaaatttttagtccatggaccacagtgccacctagctagctacgccactgactacaatatggttcaaaagcaggtagtaagtaatgaatgcattcttattaataagatataagcattgtggaaggaggtaacaacaactactggttgtagtgctactatcgcgagtagcaatcatagcaagcaaataaaaaaacaatagctttacactgcagatgaggaagatagcaattctactagataggaaatatttttttttcttgatggacctcatcttattctccatggcaggcaagaaacactgtgccctctgtaatgcactacctcctgttgcttgtgctcatactaataccaagttgggtgaggatgcctaaacactaacaggtaccagatctggcatctaccaggtattatctgagaccaacagatatcaggtttggtattgtacagatatcaaatctggtaccgcacatgtatcgttggatcctctgttctcaaagctgcttttgccaaaccccttcgtgtagcttgtcgtcaccgccatcgttgagtccctttgagaaaggtaattctaggacactgggagaatgaaaaagatttttcctaaaaaaccgtcaaataaatagaaaaagaaggtgattcatcttacaaattcgcttgattgggcctgacctctgctgccaagtcaacaaccttgtccaccaccatgaaatatcatgtgcgacacctgcttccccaacctccgtgagctctgctactgagcatcaccatggtcgctagcacgcaaggacatacaatcatcgctacctcaagtgtggccatggagaccgtgagcagagagatctaacacaagacaaggctactccgacgagaccgtcatagctgcccacgtccatgctttcgacctcatcctccatgctctggatctcatccaggagcttctcatccatcaccaccactaataacaaaacttactagtagcacataagataatttgctactatattccccttccagtcctctacaatcaactacctactcttgcatacccaaaatccaaaatctctcaatcctcaatccaaatcccaaactacgtaccaagctcgtctcgttagctagtggaagaaggctaattaatcaataagcttagcatattggaggaatcaggaggaaggcaagttggctatcgagtgaatggaagagaagaagaaaaaggcaagctaagccatgaaaaataaagaaatctaattcaatggagctagccaggaggtatttgaggatcagtcgggaagctatctctttgcccaaatcaccgttgccaccgcccacatcgactctgacaactccgcgcgacgtgtgctccaggtgcctcgtccatgcgtgcgctcatatgtctcattgtgcgaggatatcggtacataacatttccttttttaaaagtaattacactataattgggatgtaatttatattaaacttatatataattgatagcatagtgcgtgtggctggttggctagctagcggatgatcttcttttcgagctatttttgttatgtgaagcatattccaaacgaaaattgcgaaaaatatagagaagttattcatatttacaataacaatgacacacactgctattcttttttttcgagataatcacataaagagggtcatataaatattattaagattgagaaaaaaaattaaaaaaaggataaaatactatcgataatgttggttatgtaccgaagtgcacgtctagataccatgcatgaaccctacaaacatatgcaagatagtgaagcctagcaccaaaacaataaccactatacgtgaccgttcgtcgctaagcggagactcccaaaagaaaggcttggttcagtctgtcgaatatatggattacaataagcataacttgaaatgttgatgatatgctagctgcagcgcatacccatggtggcaatggtgcaagaagtactaataatgaactagccctttttttcacacgaagaataattcaccaatctttatttattcgcatgcagagttaatttacagcacgaaccgtgctaccaaagaccaacaaggcttactgcacacagtcaccgtcatttattccactaccataatatatacacatgacatgtcactcttttaacagagctcgatcagacactgcagcctgcaaccacctccaatgagatggacagtgaaagcactcctcatgcgtctgagcctgcaacggagggtgggaagacccctctcccgggctggcgatcagcaaccgatccgtgccgagttagcaactacatgcagcgaaacatcacatccattatattagcatttttttagaaaaaatattattttaataaaaacttgtaaaaccacaaatttagcaccatgtcgaacacatgacacatggtgtaaggtagggttgttgtgcagtaaaaaaaagtgatatcacatgatccatgagctatgactaataggaaagcaagcaactgtactatagg

SEQ ID NO: 67356 - DNA, 6251 bp, Oryza sativa
attacttgactaatcttttgctcctgttttgcagacaacagagtcctcccctctcatcaaagtaacaatggcaagaacatcgaatatgctttaggtctaattccgaatggatgtggattatctcccctgttatcggctaccatgcccccaagacttcaactctccttcacagcctaaccagggaaccagccgatgcaggcaagaaaagaaaaaccagatcatcggccgtgagtaccttggccttagctccaaagaaaaaggccaaattcaagaaaactaagtcgactgataagccggctgatgatctacccgccttggatccatctattgaacaagctttagatgaagaggaaattggtgaagatgttgaccaggctgtagccgaaatgagtgacacagaaaaaacaccatcggcttcacccaagcaaacgcctccaactccttctgcccccgttcattttacaagagtaagtatctctctttgacttcttctaaaattacttccctcttcggctaattactgatagactttgtggatgcagaaaaagaaaactgctgtgaagaaaagccagcagcaacgattgccaagtcggctccaccagtaaaatgtttttaattcttttacttaatcaaactcaaccagctctatataacacttgtctattctacagcctcctcctgcttctcctcctgtacagcaaccgtcaagtgaccagactccatcggctgtggggagtcatcacatcgaggaggaagaacaaccagttgctcctgctatcccagtaagttttcctttgtctcaacaatctgatcggctacattttacccagctcttactctttctgaaattgtctctgcaggttctagccgatctcttctcttttgacatcagggattaccttaatgaagcagaagaagatacttcaagcaaagctctagctcccctatatgatgacgtgagaagaacacttgaagatatctctcatcggctagaagcctcctctttagataacttggtagttgactgtggatcaattaggtcacggctgcatgaagttcaagctctgattctcgaagatttggccgatgtcctaactccagccgcttatctcgagcaacatcagttcaagctggaaaaagccaagctaagactagccgaacgccgtgagcgcaaagagattgaggccacaatccaagctaatcggcagcttgtgcatgaagaaaaaaccacacttgatcagctatctgaaggtccgatcaaatccaatattgatcggctcgaagctcgcaagattgagctcttggcacaacttgaagaatgcaatgccgagctagatatggaacacaaaaagctagccgatctcccaaaatcaattgaagaacaaaaagtaaggctcaatcggctatcaagaatgttgctgacctaaccaagtccctgaaagtcatctctagaactgatgctcaagatgcctaagctattgaagaagtagaacaaattaggcaaagggctattttggctatccagcgatacttgtctcaataacttttgtgtaataggacttagaaatttttgtaatcggctataacgttctagtactttgttatcttgacaatccttttcgccgattaatatgacttcgaaattcgctaaaaaaatttgcctcaaaaaattttcattgcattttgatatatatgtgcccccctaattttacaatgtcaaaagcattgataaaattataaaacaactaagggtgatataacaatatcggccattgtacatcggcaaaccacaaccgattacaccatggaaaacaactaagggcgatataaccatatcggccatctcaaggcggtgtaaactcatcggctgtcatgcatcggcaatgctagccgatcatgcgttaacccaaacacttgggtaatatttctttgaatatttgccattgagcgctcgcccatagacttcaccatcaagcccttgcaacatatatgctcccttagacacaaccttataaatttggaacggtccttcccaattcggcgaccacttgccgaatttactatcacgagtaccaatcgtcaaaatcaatttccatacaagttctccttccgaaaaatctttaggtaccactttcttattataatgccgagcaacatgttccttatccttggtaacctttgcaagggctcgcaatcatgactgaaccagatcctccttctcatcggccataaggttgtaatactcatcagttgttaaatcgttttgtaattccgttcttcgagagccgattctaacctcccacggcaaaacagcctcatgcccataaacatgtttgtaaggagggacttggattgacccatgacaagccatcctataagaccacaatgtttcggccaaccgagtatgccattgccgaggataatcagaaattttccgcttaatcaatttgatcaaacttttattagacgcctcggtttgcccattaccttgtgcataataaggtgaagaattcaacaatttgatacccatgctatcggcaaactgaacaaactcgtcagacacgaagattgaaccctgatcagttgtaatagtttgaggaataccaaatcggtagattatatgttcttgaacgaacactgatgcacatcatacctccaatcatcggctgtcattgctgcaatttcaactttaacatctttgatcatcggcttataccccgatgccccatgggccaaatcattagcttcaatattttgttctcgagagacatgctttaaagtaaccagccgaaactccttctttagttcttggcacttctcattataaaccatcaatgtatcattcttgcattcatactctcctgccaattgactgattactagcagagaatcccccatgatttcaatggtttcggcttcaactttcttgagtaattgcaaccctttgagcactgcttcatactcagcttgattattagtcgcatacggtttaatagtataagcaaactcgaaataagcccccctaggggaaattataaccagaccgataccacaaccatgagtacacaccgatccatcaaagaataaagtccatggcactatttcaaccgagccgattgaatcatcacgatgttccacaataaaatcggctatagcttgtcccttaatcgccttcagcgactcataccgatgatcaaactcggttaaggaaaatatccactttccaacccttcctttcaatattggagccgatagcatgtacttgacaacgtcggctttgcatataacagtacactcgttggatagtagataatgcctcaaccttgtacacgaaaaatatagacataagcataacttctccacaggggagtaccaagtttcagcattcaagagccgacgactgagatagaatacaactcgttccttcccttccaactcctgaatcaagactaagccgattgacttctcaccggccgataaatataacctaaacggtattcctttctgtggaggaatcaaaataggaggagagctaagatattccttaatattatccaaagcattttgctactctgcccccccccccccccacaaaaagtaaaaaaaaaactctgctgatcggttttcaatctcaacaatggtgtaaaaggttctaatcttctagacaaattagaaataaatcttctgacaaaatttatcttgccgatcatctcttgtaattctgtcttattctccggaggctgaatcttcttgatcgcattaacactcctttgagttacctcgatccctctttcatgaacaagaaatcccaaaactggccagccgatacaccaaaagcacattttgtcgggttcatcttcaggccatattttctggttctctcgaaaaccttcctcaaatcggctatatggtcctctatttctttagacttaacaaccacatcatcgatgtagacttcaaccaaccagccgattaaatcatgatatatgtaattcatggctctttgatatgtagctccagcactcttcaagccgaaagtcatgacaacccattcaaataagccgattgcaccagggcatctaaaagctgtcttatgcatatcttcttcagtcataaagatttgattatatcctgcgtttccatctataaaactcaaaattttgttccctgatgcagcatcaaccagctgatcggctactggcattgggtattcgtccttcggtgtagctttattcagatctcggaaatcaatgcacaccctgaccttgccattcttcttaataactggaactatactagaaacccattcagcgtatcagcaaggacgaataaaaccagcatcatacaatcatttaatctcagccttaaccggttcaagcatatcggctttacatctcctcggaggttgctggcgtggtctaacccctggtttgataggtagccgatgttcaacaatcgatcggctgagtccaggcatctcataatattcccaagcgaagcaatctctaaactcttttaagtgctctatcagcttggttctaaactctagagataagttcttactaataaatgtcggccttggccgatcgcctggacctatgtctatttcttccaaatcatcggccgacatgaaaccttgaccttgcttgtcattgagatcatctactgtatccttattgtagacatttgaaccctccacgacgccctcaaaataatagcttgggttctccatcttcaattggctatatatcagaatcggacacttttagaaaatctccatcccagacttttccagataaacaatcaaggccatccatctcccaaagagttaaattggcactggcaacattactgacctgtcggctggcacgatctctatcttgtcgccttgccattgaatcaaacattgatgcatagttgaaggaatgcaacaattagcatgaatccaatcccttccaagcaacaagctgtaagaacccttcccatcgatgacaaaaaacgtagtaggaatagtcttactgccgactgtcagctccacattcagaacacctttggtttccgatggattaccaccaagtctttgagcaccatgtttgtcttgatgagatcctcggcatttctacccaacttcctgaatgtagcataaggcatcaaatttaccgcggccccaccatcaaccatcattttagacatcggcttcccattgacgtagccgtttatatacaatggtttaagatgccgattctctgtcccctcgggtttctcgaacactgcctgttctggtgatagaaccaacttagccgattcctcttccacctcgttgacatcggcttgatcgatcccgaattcggctagcaaggtaaagaccatgttgaccggtgctgtcacaacactcttcccttttgccaacctcttcacctcatcggctgcaacatcatcggctacaggaacctgattcttaacacgccactcctgccttggctttgctttcctcagccgatgattaatttcttgttcaacctcctgaaggcgctccctgttcctcaatctttgaacccttatcttctgattcttcgtgaaaataccagaaggacaccattgattcttcctgattacattgtcctcttggccatgatcttgattcactggacccaatcattgatgaacagaaactcttgtctgccttagccgattacccctattatatgatcggcttgagctctcgacgatatctctgcacccagggcagttttcaatagatggcaacctcgtaccttcattccagcagaatctaaagaactcacaaccccaatgaggatcaaaaccatcttcgtattcttcatgatgcctctcctactgcttgtcatacttcctctgatatttgtcgataatcttagccgaattcgcttgaaaaccccttgcacggaccctatcggctgtttggctagctgaatgcaccatattaacaggaaaagggttaccatcgaccttcatcggctttttggaatcatcaaacctaatcttgcctccctcaatggccacctgaatctgctgtctaaaaaccttgcaatcgttagtagaatgagatccagaattatgccatttgcaatacctctttttgcctaattcctcagccgatgggattgtatgactagtaggaagttgaatttgcttctctcggagtagcagatcaaagatcttgtcagctttagtaatatcaaagtcatacttctcttcttttccagaacttt

SEQ ID NO: 67357 - DNA, 17072 bp, Oryza sativa
ggctgccgatacaagcttccagtctcttttggtttaagcccaaactgttccctcattacgtcagcaatcacatcggcccacggtcgttgccgagctgccccttgtgactactgttgcatgggctcgaactgaccgtattgagacgcaaactgaggttgagccaatccccctggctgatattgggcttgcggggaaggaggctgatattgataattcaagttacccccttggtaattatgaaggttcggctggatattgcgtaccaagtgctcaggaacaacttgaggcattactgtgccatctggctgtacgtggtgaaccagatgttctgggacatcttggcttaaaaattgttgtacaggctgaccaccaggcgttgcaaacccggccgatgcgcttattgaaccttggtgctggataggctgaacgatttgctgtcttaacggcgtctgctgaatcggctgcaggggctgctgccttggtggtgtttgttgaactggttgcatgacctgttgccgaattggttgtacaacctgctgaattgggagtgtctgttgaatcggctactgctgtattggatcaacaacaggttgagatggcagaaacatggcagcaacctgatcttgggtcagccgactcgtaacctgcccgccatgctgtggctgctctctcattaacaaccgagggttcatcggctggcctggcgccatcgctgatgaagcaggtaggggagttgatgtcggcgctgttggctgagttgttggtgcaacggagggaaccgcctgagtagatggctgaacatctgtaatcaaagaccgataatttgggaagacacctccgtgcaaataaaccgggcctgcagcctgatgctcagctattgaaccatcggctattgacttcatcatgtttgataaggtattgactaacaccccagactgattgatcaaagcatgatgcacagcgtaatcaacctgatcttggaagttattgaaaaaatcctgtgccacatcactattctgattaagatttcctccctgcagcccctgagcaccgtcaccttgaactccatgcaccccgtcaccttgtactccatggactccttgagaattgtcgccttgatttcctagagagccgtcggtagcacctttgatactcggctgagccgagccgtctggagcttgtttcccatctccatccttagaagaactggtcccaggatcatcagcaaccacttttattttgtacttctgaacaagtgtccccttgcgggtctgcatgaatgatttcaagaactgatcccgtgcttgctgcaatattgcttcaaactctttcttctgctcaggtgtgaatttttctggatcgatcggcacgacgtttccttcattgacgtcagtcaatcctaacttcagcatcttgtccttaacagagcatgggctagatggtggtggtggttgtttcttggccatgaggaagaattgttggctgacttctcaaatgtcccaccaggcgtgccaaaagagtgtgccaaaagagaagagaggctaaatcaatcaaaaccatttggatagataaaataaatcaattttttataggtgagtgagtcgtcatatccgatttaggttgagggaggaaaatcggagtcagggcatctgttgacagaaaacacgaggcctgggagatctgcttaactccagtgcaggtccaaagctcgccttggggtgtgctagcgtgccagttgatttgatcctgtaatcaataagaaatagaagcaaagaaacctcggttaaatctataaatgatagccgatcggctaggcgccgatgacatatcatttatctttgagccgatgtcatatgtgaatcgatcggcagttgtaaatagacaataaagaactaaatctattcgatcggctgtagatatttccaatatatagttcttatatcgatatatacttaaatcaagtgattgggatagatcggtcgccatgccgagacagtataaatcacttagatcgaaatatatattactaacaggactatatatgtttatagcatagccgatcagatagatctagcatgtatcggctaatactccgatactactctatcaggatattaaaacaggtataatatatcaaacaaaggcctaatatacttagatacagcaatatcttggcataaagggcagatttaacatgtcaatgaagcatatagagcaaatatagttaaatcggataagatcggctgaaacttcgatgctaccctaatcggcaaccagaaggcaggctagagattgatattctaagcacgacttaatagatcaaactcaactgatgcagcattaagtatgaaaagaagaacaatatctagacaatcaagccgctggaagtttcatagagtggtagatatcttatataatctaaatcaacgtcaaaatctaacctaatcagctgccctcttcgatagatgttagtcgattgtaggttagatagcgatattaccagagattatgtaagatatatgataactctacgaattacataaacaagattagagtgtcataaagatagaagcactaatcctgagaatacaagccgtcataacaagttttgcctcttgttgaagatcaaaaccgatgcaactcaacccgaaagcaagaactcgttgaaacagaactaaagcaaaagggtggcggtgcgccgaaattgtattgaacatgtgtgttcgaagttatatagggctcgggtctatttatacccgagaattacaagatatgtccataacggatacaactactatctctaacaaactctaagataccatacgtctttgcggcagacttttgcccaagcgtatctctaaggagatcacataaaacatcctaattaatagatacaattgccttctcaggactctatccatgtgcggcaatcaccttgaagcgcctcaattcaacctgatatctcattcatcaagttgcattgtcggaatcggctacaccggcttacctagtccgactcagacccagccaatcctaatcgtagccgatctggtctccagccgattcctgctctgttttcgaactcgatctccgcctccgactttgcttcgatctaatcttctttcctgacgccgatgttatcaaatttggttgttaacagcatcgtaaagggaagcataataattatttttttcttaggattttgttgcaattttttgggcctgacaaatccagctcacagattttcattggatggaagggataagtttattttaggtctctcaaatttgtcgtaaagtctgaaattcgtctctaaacttgtggatgatgatcctgttttgtaaattgagggatccattctctagtatttcagtttggggacaaattttaggctcggcgatgaattttattccttggatggaacgggaattaaatttgaaaagatacattgttttttaatattttatgtttatatacatgcatgtaaaatatttgcacaaatatacctcctccgtatgatgggaacgcgggatcgaagcggtgccgcgctttcattctgtgggaccggcggtcgcgtagcacatccgtgtggcaccgctcgctccagcagcccaggagagcggcagcgtggtggagggcggctgcacgcggtgctgagacggtcgcacggcaccgatgcgcgggaccgatccggtcgcgcggcaccatggcgtgtggcaccgtcccgtcccgtcccgcgcgtgcacgtgtacatgtcgcggtcgacgcgcaccatgcaagcatcacctgtcaagcacgcatggtcgcatgcaggcagttgatccagtcaaaccctacaatacatagtcactagcttaagggatttattaaacctaattaattcgttattagcaaatgtttactgtagcaccacattgttaaatcatgaagtaattaggcttaaaagattcgtcgcgcaaattagtcacaatctatgtaattaattatttttttagcttatatttaatactttatgcatgtgttcaaacgtttgatgtaacatggtgaaaaattttagggcgggatttaaataggcctagggtgtgttcgctagtataggttcccaaccaggaatgcgcggaaaatggagtggtccattagcgcgtgattaattaagcattagctaaattttttaaaaatatattaatttaaattttttaagcaactttcgcataaaaactttttaaaaaacacaccgtttagctgtttgaaaagcgtgcgagtgaaaaatgagagagatgggttggaaaatggaggtgccgaacacacccctaagctagtgcctgggatttgactggatcaactgcctgcatgcgtgctcgacatgtgatgcttgcatggcgcgtcaaccgcgacacgcgcacacacgggacgggacggtgttgcgcgaccggcacggtcccgcgccatgatgtcgcgtgaccggatcggttccgtgcatcggtgccgtggaggcggtcacctcgaccgtgtgcagctgcctataccacgctgccgctctcccgggctgcgggagcgagcggtgccacacggctgtgctgcgcgactgccggttccgcagaatgaaagcgcggcactgtctcggtcccgcgtttccatcatacagagaaggtatatttgtgcgaatattttacatgcatgtatataaacgtaaaatattaaaaaacaatgtatattttcaaatttaattcgatggaacggtgggttgagcccaaactgtcttcgtccaactccaatccccaaattcctcgtctcctcgaatccggccgtctctcgtcgtcctccacagcgacgctgctcagccacgaccgagggtagaggggtggttcgcaagcggcgccgccgaccatggtgagagcttcgccttgccgccagaactctctggaggccacatcggtgacggtgccggcaccggcgaagcagccatcgccgtcgtgggggcacgaacacctggcaccgcgctggaatcgccgcgtcgttggacgggtggtcaaggggttctctgcagcccaaacacagcaacctctctgccacggcgccgcgccccaggggcttgccgccgttgccgcgcagtcaggcgcagagccaccaccgccaccgccgccgctgcccacggttgttgatgtcgccatagcgaggttcgccttcctcaccacccccatggccgtatccccaccccaccataccttatctgacgcctctgctacgctatcaccaggggaacaaagatgatctcgcgtcgctgccggatcggagaacatgctccgcctcaattgctggtgagtttccgctttccctctgccagaagcaacattccaatccatggatttgcatccaaagcctaaactaaaaacagctcactaagatttggtcgataaaccgatgaatatcaaagattgttgtaatatatttgccagtttactgcttgatttacgacaaatttaatttctgatctcactaaaaaaaaaactccatgttctagttcttctcattttctcagttaccttttagatgacagtgaacttctgcagaatataatgcccctttattttctagaactttacgcggtggcactccactatatcatgcatctcctacatgttaaccaagctcgctcacatgtcaacttaagttacatgacatatgtaaaatatgtgcatcatttacaacgatcatagtccattttctactggtaaatctttgagtgcatttctcatcatgttctggatgttcccaaattgttcaagaatgagtccgctgcctcaacttcttcgccaccggataggaacttcatgcacatcggtggttgcaccttgaacatgttgagcaacgctgatggcagtgtgaacagcccttctccacatatcaagcctgccgcaacggccgatgacagcatctctgcactttttgcattcattcttgtccaggcaagcagcaaaaggctccccacgcacatatcgatggtgaagtaggagccagcgaaaaacggcagcgcaatcaccgtcatgctggggatgtacctgtggatgctccaacccctcttctgagagaccagcacgacagcgtcaatgatgaccgtcacgcagaaggcaacgacacagaatgtcatgcagtgctttggcagctctttcacccctccagtgccgatcaccccgatggcgcggtatagacccgcgaaagggcatgggtaatcggactgctttgaacccaccggtgcgttgggcttcgttgtggactggaaggcaaggaagacgcatgggcagaggatggagccaacggccacgccgaagatctgtccggtgaccatggcgcgtggcgacgttagcgtcatgtggcccgacttgaggtcctgcatcgcttgcgacgagatgtggagtgccgccacgatcaccccgctcgcaaggaggctggccacgacagcgccaggcttggcgatccatgctgcaaagacgaaggtggtaaacttagcataggttggtgccaccgaccagtcggtgagccctgtcgcataggtgttgcagaaggtcacgactgggatgaccatgtaaagcacggccagatggtagaatttgatctggttgaacatggctgggattgcaatcgtgctgatggctgcacatgtgatataggctgccactggcacagggattgggatccggttagccaagaacacctcaatcctcttgcgatcatcatagttgaggcttgggtgtttcttgaaatagttggcaagccctaaatcatgctctttccttaattgatagaagttaattgatgctgtagtgatgagtgttagaaagtttatcatcccatcagtaatgatcagtgtcacactgatgaacacctgttatataagttatatccatagaaaaaaaaaagcttagaagagtatgtctcactagtgaaaaagtagctagcaaattgatcaagacagcaatatagcctacatcatcaaaagtgctgcaatgactatgcacatgtttggtagtagcaacagatacagctcatggtgaaattaaatttaaaggtgaaaagcttgattggaatctcaaaattcttagtcaagtgtaatatactaaacgaaatatatgatatgaagtatgtgctcagattgttaatgaatgcaatacctccctgatctgtattacatgaaagtgtatgtatgaattttctcctttcttctgcaatgatgccaacttttgaatttatgtattcttgatttttgatgcaataacactagttactataacataccatcaacaacaacatttgaatttatgtattcttgatttttgatgcaatgacactagttactataacataccatcaacaacaacaacaagaatgtacagtaccatgaaatttgcattggtagaatgataatgtgtaattttaaccccagtaaggtggtaagatacatatacttggtccaacttatagcaattacctagttttcatgcatgtcttttttccccttgtttgcaggtttgcaaccaactcacagatagaagagtggaagttgttgcatattaaaagaaagagcaattacacatatgttcgtatcatcgtacggtttgttcaacttaattggttattatgggtgtgagatgttggcatgcttggacaccttcagatgcattttagtagagtagctaaaataattggtgggaaaaatatgtctttgcattgattagtagcagaaaaggactgataaattttagacaacccttcagtagtatgcttcattttaatttttttcgtacataccttgtatccattttgtccattcaaacttgtagggctgtcagtttgataccattgcccacgtttagtttcaaggaaaggatatagaaatccccaagagatgatggccccaaaaaataatccaaaatttactatatgtggacaaatcattcccagaccaatatatgtcgcagagaaatcaaagtagaacctgtaggtacagcatatatatatatatatatgtgtgtgttagtacctcacttcgactgatatgcttatcctgtaaaatatattcaaacctgtacatggattgactaatcattgtcaaactcaattcctacaaatggcatcaattcaatgattccgtaatgcataagattcctatgaaccatcaatgaaatttggactgagttatttattccctaccctagcctatagtaaataaatcacattgatcaattcaatgttgccatttcataggacgtgtatgatctaattgtcattagccattttcatatttagtgtcatgtcttttatgaacatgacgatcttagacttatatatgtcaaataattctttttttatagaaatacatgacttgcatacacactattgagataattgtgtaataaactatttacacagttttctctataaccattcagatcttttgtgtatgataaattgataatatgttgatactcaaaaacattgattaatatatagtctataaaatgtcatctttctgtgaaggtgaggaggacacaactgtaacgcatgtaacatcgttctttagcagaattgaatatatttatcacctgtgtttgtataatcctagtccaaatgttggaaagtgctgaaatccacaatcatcgcctgcagtatagaaccactggaacatagaccaagaaaaactgccaaaaaatactttgaaaatggtcgcaacctgcattctggattacatgcaaatattagtgcacaaaatcatgaatatagttaaatgaaattcaatctgtcaattttttactaagaaaacaagacttcattactttgctacgtaagctccttcaggggtatgaaagctattaataagctgagctataactgttcctgttggaaatagtaatttgtagtcaataatcatgacctgcagtataaggaaatcaacttatgaattatgtttaaggatgagaataatgcaaaacaatcttagaaatgttaagtagaaacttctaaaattaaaaaaaaatgatcaatcagtgaaagaagaaacctggttaaatggcacatttattaacactcccgtcataccaacaaggaataggtatactatccattttccgattggtacatggtccataatatctcttggatctggatcatcagcaagtgatctggccaccgtagaagtcattccaatgatattggtcgcaaaaccacctaaaaaatgtaacaagaaaataggccagttaaactagaaagagatacaaaatgtaaaaaaaaaaaactggctacaaattatttgagtattttgttttgaaaaaagtattccaattttgggctcttaaataccttgtgtccaaaaggtttacttttaaatataagttatggaaggatttaattcgaagttaataaaaatggtttcaaaagataaaaacaattcttgataattcaatctctcctcccccttccaaaacctattttttaggcgcacaacttccccaaaagtttggttttataggtatgctactttctctactgaatgttttgttttttgatatatcaatattttttatttcaaaaggtattgtctgtataaatggatggacccaggtgaatatgcatttacaataaccacaataatcaatttcatatctcatatgacaaatctccaagttcaaatcacatcttttatgtctctttactaccttaattataaaatttctcttggttttagaggcatgaaattatcctgtggcagtaatcgaggaaatacagttactactggagattttaactacgtgagtgtgatcgtatggtaatagtcctctaaattttctccgtcttttctggcagcacccatgatattcaaaatagatggttaattatgactggaacttgctgatataataagcctagattaaatttcatactacctccgtcccataataattgtatttctaggattcaaatttgtcccaaaatagttgtgacaatagagtaataattgtcctaccaatcacttttcattctaccctcaaccatccttctagttttatctatatactatttaatgaggggtatcatagtcttttttctcaaaacttaatatatactaaacaatctagaattacaattattttgggatagtggtagtagttgtttccactgggctcctatgtggagtttagagtgagactagtactaactactaactgggtaaaaggttcatttatgtatggaacctttgtttaaaacataatatattatatatctacttcatatttactgttcttcattatttttgttggcaatagtgtttacgttttgtttatgtcattatttcctacggaaagttaaatctaactacctatagattcacttatcttctggccttcttatcaagctttttagtaatttccaaagttttgatttatgttgcccctccaggttattcaaataacttcttaagaaaagaatatttcacgtacttctgaggaatttattaatttatcttgtcattactcatgcatagataattgtattattgatgagaacaaagtcccaatacatttaaaaggagaaaaaagaaaatttttggttgcattttaatttgcacattttttgcaaatccaagttttgttagacaaacatcattcagaacagtttcatggaatattttaggaccaaaattttgttttgttgtccttagaccagagaagttttgattatccgatattttgaactctgtttttttaatctttctggcttttgcaacaagattttcatgttgggatggctgcttgagaacctggcagaagataaataatttcgatgaaccatgtaactcttgacaccctgaagaactactatggctaacactaatacttttaagctagattttcaaaactgcaactcaactagcagaatttaaagtagttaatacttaatagtcctgattgaactgccagaaaataaaatagtttctgttcttgtttcacatatcacaaagccacaactggttgaaggataactgtaaagaaacctactgttttgtcacctccccagtttagttgactgataacttgtaagatgaggtgatttgtatgaggtcgcatgctcaggtgctagttttatgtgccctttcagctgtacgctgtaagggagagagccacctgaggctggtgattgagtcagtctatctagtttttttttctttttctttcacaagtagtagcacagttgtaggcttttccatctaaatatataacatgtagtatttcctatacttgtgggagaagtatgttttcgcaatatttacccaggcatataatgctgatgcttacttgtgagggccaggttgaggcaggtgatgatgcaagtcaggaggaacatattttcctggcgtgtgaatggcagcatgggaaagccacaactctgtagcagcctgatgagccacttgaggaggaagaagctgaggatgctggcaggcatgttgagtgccggcactatcccggccgtcatctggatcctcatgccgacgaagcagatgacgacgctgagcaccaccgccacggccatggcccgtggcgtcaccagctccctgaattccggcgatggctgcttctcgaacaccgcctccaccgatgtcgctgacatgggatcgccgatcatcgcatccatggcgattaaagctccaggtcaatggaggcaacctcctggagggtttttgggttgtgttgtgatggcacaagtgggtggtctcctgggttggctctcctaggaacaatgcatgggttggtctgaattgggaggtggtgagggaatgtagtgtcgctgtggagcaaaaatagcgtctgtttgttgaaccgatttctctgattctgttccttatttctatattgatgaaacagatgctgctgagggcaacatacctaatgtttacagggtggaaacggttacaatgagtgtccagaaagtagttttaaccatttgctttaagatttgtacgaggtctatcaaaactatgctaggggttaaaatagaatagaaatttgaattagaattagaattgatggatgtgacatgtagaataccaataatttcgcactcttttgcacacacttcaaccattgatcaactcatatatgcttaagaacacatttgttaacgaggtttatagccaaagcataaatcttgacactctaattatggatgctactcctcaatcaatagtacacctaactgctataggcctatgacaatgctgccatcctcctcgtgagtgcctacattgcattttcgtcaccatgcatagttacattgtggtgtcctctatatttaaagagttgatacgttacaagagtcaaaagctaaccctaccctatcacctgtattaatacaacactttgcatagaaaaatatgctgagaaactcctgttgagtaccacaagcttttaagattttgtactgcattatgttagaaaacagtgaacatttgtggaatagtagtataattcatatttcaactacaactttattctgtggcacttaactataacaagcatctcttacatgttgcaaccaaagctggctcacatgtctacttatgtcaattacatgacatatatatatgtaaaatacgatacgtgcatcattatttacaatgatcaataatgattcatagaccacttaatttccaccgagatgtggtaaccaattaaggagtactaacagtcaatcttaatttgatgagtgcatatattaacttgatctcaacatcgatcggtcatgtcttgggtactgttcctcccgagctgttcaggaatgagtccaccacctcaacctcttgtccactgggcaagaacttcatgcacatcggcggtagcaccttgaacatgttgagcaacgccgatggcagcgtgaagagcccctcgccgcagatcaagcccgctgcgacggcggccgacaggatctcggcgctcatggtgtcgatcttcttccagaggagcagcagcaggccgcccaggcacatgtcgagggtgaagtacgacccggcgaagaacggcagcgcgatcaccgtcatgctcgggatgtagaggtggagcctccaccccttgagctgcgagaccagcaccagggcgtcgatggcgatggtcaccaggacggcgatgacgcagagctcgacgcagtactttgggaggcccttcacccctcccatgccgatgatgcagatggcgcggtacagcccggcgtaggggcacgggtagacggagtccttggaccccagcggcgccccgggcttcgccgccttctcgaacgcgcggaagatgcaggggctgaccacggagctgagcgccacgccgaacacctgcccggcgatcatggcgcgcggcgacgtcagcgtcatgtgcgccgacttgaggtcctgcatcgcctgcgacgagacgtgcagcgacgccatggtgatcccgctgacgaggaggctggcgacgatggcgcccggcctggcgatccacgccgcgaagatgaagggggagaacttggcgtaggtgttcgacaccgaccagtcggtgagccccgtcgcgtaggtgttgcagaagccgaccacgggtatggcgaggtagagcacgccgacgtggtagtacttgatctggtcgaacatggccggcatcgcgaccatgctgatggccgtccatgcgacgtaggccgccaccggcacgaacattgggatcttgctggacaagaacatctcgatccttttgcgttcgtcgtagttcatgctagggttcttgctgatgtagctggccagccctgacgtttgctgttgctgttgccttatatggtagaagttaattgcagctgaagtcacgagtatcagaaagtttatcaggccgtcagtgacgatcagtgtcacgctgatgaacacctgccatgtaagtttatatccattggagaaaaaaaaacaagaagtttagaatagttcgtgtcactagtgaaaaactaccaaaattaatatggctttcatccaccgcatgcatatatctggaaattatatcagaaggtttgttcaagttataaattggatacatggatcatgacaaaaattctaatatactaggtattactatacttgataccttcatatgcatttcaattagtactactcccccgtttcataatgtaagtttttctagcattgcgcatattcatatagatatgagcaatgctagaaagacttacattatgaaacggaggaagtagctattaatttgggggacaaaattctttccgtgcattggttagtacgtaccacaaaatgagtgagataaaatcttattagatgatccaacaattgatatgatcttattatttacgtatatatatctttattgtttctctgagttcctcagttttgaggcttggagtttaagaactctcgtaactttcggctatctgtggataaagaggtaggtcggatttttatccattatattaagaaaagaaatgtaccttgtatccattgagtccgtctaagtttgaagggctatcagtttgataccactccccatgtttagtttcaaggtaaggatatagaaatccccaagagatgatggccccgaaaagtaacccaaaattgactatatgtgggcacatcattcctacaccaatatatgttgcagagaaatcaatgtagaatctgtaggcacacacaatacaatatgttagtaattcagacgcttatatcctttaaaatatatttaaatttgtacatggatttactgagatctgcatcaattcctacaattagcagcaattcgatggttccataatccgtaagaccatcttccatcgatgaaatcaggactacattttttattgtctacccccctaaatctgcagaccagattgagcaatatattcagtctcacagtttcacatgacatgtatggcccaattgtctagctagctattctgaaaactccttgccacttttctctagttatcagcataataactatattggcattaaatattgtgaaattactaattgtttcttacatatttaatcatttctgttttggaaatggatacacaacttatatacaaattgttaagagaatttcgtgatacgctatatgtatagatatataattttctgtgtgaccgttctagatcatctgttgatgatactatgttgatactcaatcattgactaataccattattttaaaaaaggaatatagctatcacctgcgtttatatagttccagtccaaacgttggaaagcttgaaaatccacaaccactgcctgaagaatagaaccattggaatatagaccaagaaaaactaccaaaaaatactttgaaaatagtcataacctgcattctgttgacataaaaatattagtgcaaaaaatatgaatatgtagttaaatgaaattcagtgttttaattttcactaaaaagacaagacttcattactttgctatataagcaccttcaggagtgtgaaagctattaataaggtgtcctatgaccgatcctgttgggaatagtaattggtagtcgataatcatgatctacagtagaacgaaacaactcataaattatatttaagaatgagaataatgcaaaactattaagaatgataatatataaatacaaaactatactattagaaatggatatccctctcattgcattaagaatttagacatgcttgtaacatcactttacaggcctacatattaattaagtactaaatgagtaaaaatatagcaattaatagggaatgctaacttcatgtaacgtattgatgggtgtactgaccaaacaggactaaatgcatgttgaattttatagaaataactaagttaagttgattcagggggtgtttagatatatgggtgtaaagttttggcgtgtcacatcggatatacgaacacacatttgaagtattaaacgtagactaataacaaaacaaattacagattcctcctgtaaactacgagacgaatttattaagtctaattaatccgtcattagcaaatgtttactgtagcaccacattgtcaaatcatggagcaattaggcttaaaagatccgtctcgcaatttacacgcaatctgtgtaattagttatttttttcgtttatatttaatactccatgcatgtgtctaaacattcgatgtgacagtgaaaaattttgccagtggatcgccctcactaatatagcatataggatggaatacatagttgtaggcttgtaggatgtaactttgaccactaaaatatgtacatattttagttgttccaaactagatcagtaacgcacgaaaaacggagcagtccattagcatgtgattaattaagtattagcttttttttcaaaaatggattaatttgattttttttaagcaactttcatatagaaactttttgcaaaaaacgaaccgtttaatagtttgaaaagtgtgtgcgtggaaaacgagggagagaggttgggaaaaggggtgccgaacccaacctaacttccgtatagcttctcatactaagggggtatttgggaactatatttgggaactagagactaaatttagtccctctcacgaaagtacaagtccctatggtagggacttatgtttttgtgagagggactaaagtttagccccactttagtccctccaaccaaacaccacctaatgcatacatgaaaaaaaatatttacaccatgaaagaacatcagcaccactttttgattcttgccctgcttttacatgaaggctaagggtgtgtttgacaaggaggggattgaggagattgggaagataaacaaaacgaggtgagccattagcacatgattaattgagtattaattattttaaacttcaaaaatgcattaatatgattttttaaagcaactttcctatagaaattttttgcaaaaaacacaccgtttagtagttcgggaaacgtgcgcccggaaaacaaaactatctttctctcttcctcatgcgctcgaacgaagcctaagccatcatgtcagtaaatgcaactcgatgacaaaga

SEQ ID NO: 67358 - DNA, 120651 bp, Oryza sativa
gcatggaccaaaaaatttagggatccttctaaacgccgtcttacgggctccatggtcggaattgctctatccaagccgtggtaggttctcggacctcccctttaattatggataaattgaatatccaagtcatcgcacaagaaaatgaaatatccccgcctccagagagaaatatggagacattacgggcccttaagcctcccagtcaactcaagcatgatatgtgccggtcaatccactcgaagccggtgaccagatgtgttacccattcagaagacgtgacaaacatggctaaagatctacaacatctcaaatattgttaactcatactcatgtgaatctagttcccaggatgggcgttaggttcacactttcatctctagatgattatcacataccaacccataatatgataaaggcgtttatagcttacattcctattagttcacccgccggactggccaaataatcatatagagcacggaagccttgtcttcccaatcatcaagcaccccggcatgccgttcacaacagtaattgcaagacaaataacggtctgtcgtgcgttcagaatctggcgacggtcatgtgtcagtctggtgagcgcgacgtgcactgcgcagcgatagtcagcacccgagtatgactaatgatgtccccagattgataccatacatatctccatgaggccagaacaactagccacaacagatacaagaacattcattcacaactttgcaactgaaatacctgcagattgtttcctacagatcaagagaagaatgcaatgatggtaagaagaatataatgatattctgataagtcaatttctgatcaagttagcatagttgcacctaatttcccgtccttacgtcggtcattcagtttgaaagcctacataaataatcacactccatcttttgaacttgattgagagatttgagattgaactcgattggaaaagacttgagatccacttacaagtcaatgatatatggcttgttttggttgcgttgagcaagtcgagcaagcctttgtaatatcgttgataaaaagtttgccatgtgtagagaaaatgctacctcgttttgttcttcttgaaactatttagagaaaaacacagtaccagtgaaagaataatgtagtaagaattatatgaaccatattttttgcatgcttcaaaaagttattagcaaaatgcagacaacctcttgcatcatcaatatgcaaggaattcaaccatgttgacggaaccctgttcggttggtaacgttattgagttctggacaactccttggatctacaagtatatccttccagagcaactacattagccgtatgatgtctagggtgttcatttagcaaattgtgtaaaatcatcagttgtttcatcctgtcaacatatgattcaatactaggatgatatgtaacaaacacaactattgcttaatctctagagttcaccccataaggacatgtccttaagaattcaaggagatattcgaaatgcagtaaatacattggcccaaaccttacaggaaatatagtgtaaagacttgtataatccctagcacatgggcttgcatcaaatgacactgtagggccatgaagaaaaatcttgttctggccaataaaagttgtattaaagctcaactcttcacgatgcagtctagtaacatgcatcaacaccttttgaatattgtagaagatgaaatccaagaaaaaccgcatcatggggtgcaatgattccaacatcttaaatatctggatgtaatggaatagtacagtacaataatccatcactaacattgcatttttgatcgattgtcattggcatgcagcaaaacacaatgttatagacatatataaataaaggaaattaacatcagttttaaatagataatattcactgtccggctctttctcgataacgaatctcaataattaagttcagtgtaaagggtactccgacagtgatttatcataatctaaaaccttgccataacattgtataggtgtcttaagcattgactcctatcttttgacatgcagaattaactagagaatcaatctttgtattaaatacatccacttatacagatacactaacaccgcatgccttgacaaatagtgattggcagagaaataacggtttgctcctggttgagaatgtggtgactgtcatggaggcagttgttgcgtgcggctggcaccgtgctttgctgttgtacctccgtgtttgactaacgatgtcagtgaagcggatagattggttaagtctcaaaactctttatgtgcaaaggagaatggacagattggataagtctcaaaactctttatgtgcacaacttttccaactaccatccataataaataagtacattccaaaaaatgccattcaaagtaaaatgagcacacataatttgggttctttcccacaaaaaagtgtttaggacaaaaaaaaataacaaacggtaacgatatgcgagagcgtgccagtgtaactaaggacacaaaataaacagaaaacatagggaacatgtgctttattaatctcaaggatcataaatacaaattcccaatgtaatatatatgtatatatgtatgtgcgctccatagcctgtcgttggacaaatctaaacttggataagtggtcttctaattcctggggtctcgaaagactcctagttaattactgccacaggtttaggcctacagagcacctccgattaagctgcatgtggtcgtctcgtcgtcttcgcttcacgttctccatgcacgatgaatgttggtgaagattgtggatatatatctaggcgccggcaacgcatccgcggcctcatcggtccgtgcgccggtgttggtgatgtagccttcatataggctccgcccaccctcgtcgctccgcctcatcagtcttgagcaacgtggtggagtagatggattgatcttcaacatgcatagatctcgtgtcgcttggatcagcaacgacatcaggatggtgttaaagggaagaggagttggtcaagtcagttggtgtacacaacagccgaatatccatggctgggcacctcctgacttgatgggatcaaagtaacaaagagttgacgatgacagttggtgtagatggcagccggatatccatggctaagcacctcctgactcgtcatgtcccttatacaacagggacttgtaacgaagatgttgatgaagaagttggtgcagacaataaccgaacaaacgtggctttggcacctccttcggatgatgaatctactattgatccggttgatatgatgacgagcctgcaaaaggggctctatgagtgtgccgatagtaacggcgaccttggaagaagtaaatgcctcatcggcggaatagccgaggacattggttggtgtagatctaacacgaacggtacattggcatcacagacggcactattctttcttcatgttgatatagacgagcgacgctccaatacacaaacaagcggcggcatattgatctcgatgaagagggagagaatcacggacggacaacatctcatcttggcgtgatgaagagagagtgcatcatggacggacagcatcgatctcgccatgacgaagtggaagcgttgtagacagatggcatctcatcatgttactatagataaaaggagacacggacggacggcacgatgactctggcttgacgaggtgaaagcatcgcagatgaacttgacgacggtgtgcgggcaccaagcgatggtgctccggtgtgatgaagggatggcttcacagcatcacgaacggcttagcaaccccagcgtgacgatgcgggcaccgagcagctagcggcgcttcgattggcattctcgtcacgcggctcaacgacgagtgtgaggaagatggtaacaccaccgaagatggccggcggacgtcggcgatgagatcacagcaacgagtagtgtcatcaccagcgactcgactggatgatgtcgatcagatgattggcacggcgactccgacgagggcagcaccatggctccgagggcagtgcgacaatctccatcgcccaatgatgtgtttggttgatgtagacgcgggagacttggcgacgtttccgacgactccgacgagacctcctcagtcgggcacgactcgacgacattcacgatgccgtgacaacatgctccggcgaggtagcgcgacgaggtcattcggccggtcatgacgacgtagaaaaacggcggcttgcctcctggtcccacaaatgacacttccatgagacttggcaaactcgacgacggcgtgcgggcgccaactagcagtgctccagcatctcatcaccatcgccatctcatgcatgcatgaactgaaaaagaaaaatcaataagaaagccacaggatcattacccatggtacagaggttgttgatgcccatgatctgatgctgcctcttgttgtcggtgaggtctcctcccgtcgagctggtcccgcctggctactccgatgaggctgcgtctgcgccgcttgtgcaaatcgatcagatgaggaatagaagagctgcttttgatatcgatctctgcatatgtgtgtgttgatggtgagtgaattgctcgatggctgtgtcgttgaatgtgtgaggaatgtgtgtgaatattgctatgaatgaatgcggatgaagggttgctcgtcaatggatggatgtgtgtttctccccttggcctggcttgctttcgatgggttttataggcatagggtggcctaacgggtagacgcgcattctctggcgccgctacgaccgcgcgtcagatcgattcgatgcctctgggttcaattgctgtggattgccttcatttgaatcatccagataagaatgagtcatccgacgttatccccacagcagtagctcactcccgttggcgtgaatatccggctgcacatacacacgagcagcgcaactactggcaccagcccatatgcagcccagagctagtcccagcttgctgcttctttaagtccatgaaagatcatctattatacgtatacgtatttgctaagtaaacgaccacaagcgcaagcacatgaatcgcacatatatatatatatatatatgcaactccactctcttgttggctggttcatgcatatgtatatatttagcacacatatatagttgagtacatgagtcatatggttggccagactgatacatccacacatttgcatggcccatgcatcaagctagcttcacatgtatttagtgatcatagataatcccttgtttcttgctttggccaacacaaatattccttgcatatgtataggataaccaaaatatcatcaaacaaaaagactagacaaaagttatgcgaaagttatcggataaattgaggaggtgggaggccagactaatccctaactgctttggagggagttgtctgaagtcggttgtcgccaaatgtgaattggctaacaggtaagtcatgatcttcctgtagatgttcatggtactgacgtactgtcatcaaaatagtccatctttgttccatcccaattgttcatgtatctcatgcagaaaaagccacaatcaaacctaggagaaaaaaataagtgatggcacaaggtgatgagataggaaaaacagtataatgaaaaaaaaggtgaaacaagtaatttaaaagcaatttacgcattggactgtagtgggtactgtggtggagtggttctgaaactttgttatatcttttattgcaattttggcatcaagcgcaaccttggagaagttaatcagctacattacataaggaaaatgttgaaacattagctcatggattgcgaacaagaatatatgttgtgttgaaaaagttgtagaaaacaagatggaacatgcatagttactatgctttgacaaatgcaggaacattagttaatgagttgcgagatacaaatgtatgttgtgctgaaacaattgaacataataaaatggaacgtgctgacatagttaccaggttctgagagtactggaaccattttgagtcattgcattttgggtcgaaataattgatctggtcatgaagaatattcatgcataacaacacctagtgcccgtcccaaacaattgggaagaagagctaggagatagaaaaaaatgaactaatgtcagagattctctgtgcatatgtactaaaacaataaatatgtatagtctaagacattttagtgtgagctaatgcaacaaaaacctaccaattcatgaaaagaaggaacaatatagagaaaaaaaaagaaacataccagatcttgttttgcgagtttttcctccttgttaatcgtctgaagctttaaacagctctgaggtgtgaacttctctggctcaacgatcaactcagtctgcaaaagaaaagcttaggaagcaaaaaaatcaagcacattaaaaaacagaaaatctacgcaacggtgtcctgtcctaacgggataaattaatgacgaaatccattcaacagatcagagtatcaggccaccacacacacattgccttatcctctggaccttcgtaaagctcatccccccctccccccaagtctatatctctctctcccttgttcccctcatgctcgtctgtcccccttccccctcatgctggtgaatgtccgtgcaaccaccatttatgtcgacctcccccacatcgccgtcgctctgggctcaatcccccatcttcttgccctctacttcttccacttcggtggcacgccctttgttttctttggagaaggaagaggatggagatgatgacgttgacaatggaggatggagagagcttgccatggactatataggtgatagggagtacaagcaagccgggttccttggcagcgacaatgcctttcagctctattgctatcggattttgatattgtctttgtgtcttctcttttgggatggatggatggtgcgaggcatagcatggctgttgccaaaaatgccgatcaggtagcatgttggtgtaacatacccgaattctaggattaaggaatttctatcaaaactagttgaaaggaaagttcttcaattttgtaaaccaaaaatttccattttaaacctaggtgaagttgatctaactcttgcatgataaaattttaaaacaaattaaaacctttgcatctctaacctaggacaaaaatataaatttatgtgtaagcatgcatactctcatagacatgtttgacttgagtccttcatatgcatttggatttggattgcatttggattttcgatttgcatttcataataggtctcatgaatattaactaagatctagataaacaactaaaccattagggcctagtgctagctagaggaagttaaaatagaaaccatacaccttaaaatatatcaacaaggccaatgtcaagccccacaaaactattttggtcatccatctgaagactagtcatgaacatggaagtgaccaaataaattatatcatatagggtatattctatcttaatcatctctataagcattctcttaatttaatactaaagtaaacttgtgcataataggtaaggagcttatgacctgtgtaatgtaaattgtaattctaacatatcaacatcacctcaggttaatgagagtccaaatataacttttataaacatttacatgcatttaggaaagggaaacatatataagacataagtcttgcgaattatctaaaataattcgtgcaagataaaaccatgggaaaattcatgtaggctctaatcaacacatgcaactcactgtaattttggtatgatttaataactaaatttggtacctcaaataaatcagtcaaactaataaaaactagattaactgtagttcttaatcggctaaaaccatactttgtctaaaagtgcatttaactgcataaaagtgtataagtaaaataatttattcaaatactaggtcatttataatgaataaaaataaattttccagaatttatcttctctatttaggtctcctaaaaattcgaactagtttccaaagaacccatattcctctaatttctgtgagtaatctatccataatttttgagtgcaaccaaagaaaatggaaactaggtacatacacctacctccagtaaaatcaacactagttaatctgatcaacacattaagtattgaagctacaaaattagaggagaaaataattccggaaattcgtccaaaaaccaagctcacccatgtctctgcctacacatctctcttccacctagtttacttcgacctgggcccccttgtcagtccctccggcttgcccttcctctgtgcaacttccctagccgaccgagaaacactgagagggagagatcgagcgccgaccggctctggacgccgcgcgacgcgtggccacgacgtgtcgacgccctaaaaacgccgagctccatttctgcctctcccagacgcgtcgccactcttcacccaccattccagtgccgatccatccgagggagagcatcctcgctgctcttctccactggttctccatcgccggccacgaagaagacaatggccgcaatcgttgatgagccgcggttgtttcctcttctcttgcgttccatactctcctcaccatgccgaatatttctccttttgatttcatcctctctggtgcagccaatcggcgggaacgctgccgtgcacaccggagctctggagcgcgctctgcgcaccgccgcagcgacatcgtcgccgttgccatcaatctagatcaagccggagcgagccaccacgccaccagcttcacctcaacctcctctccatttcccctcaagaatcttgaagaatggtgctacgagtgtggagatcgtccaccgtcttctccacctccggtcgccgtcgccattgtcgattccgcctcctccggtgagccattgtccgattcttcgcgtatacaccatccctgggacctcactaaccccatgaaaacacatgcatgtcaattcgatgagtggatcgagccgttgccgtcttcccggagctctacaccgtcgccggaccatcttcttctccgctgccgctgtccagactttccggcgcctcgttcaaggttcggtgagcacccttgagcccataggattgcattcatgcatttcattcacttagaattgagcaccaactcaacatgcagtagcagcctaagcacagccgccgctcggactcgccgccggcgttactccgatgtccactgaccaagaaaagaagaggaatggaatcgcaatagcatgatcttcattttgtcttttggtcgcaccctcaaacgagccaccgtttgccgctggcaagcttgagatcgagctcagccatggctgttctgcctctctgcgtgagaaaagaagtcagggaccttgtttcgagaatttaaacaactataaggtttaatgtgcaacttttcaattcactgacatatgagcctaggtctgcgggttgattcttagaaacctcagggatctttttgtatattgatctctcactgacagtggaccccttggaaacaaaatctggaattataaaagaacagtaactaaaacttgtaaaatccatataaaattaaatatagctcattttaagatgattcaaatttctgtgaactcaccaaattgggaaatttgatgttatggaataaaaacttgcactcacagtacaaatttagcctctaaaatttatccaagttaaatcacacataaagcacgcacaaatttataaaatgcatacaaaattcatttcaactcattttagagcaaacttagtttctacagatccaccaacatgttctctaaaaataaattaaaataaaacatataaacactttacatcaaatgcctctaaaactattatctttaaaataactagtttggcataagatgaactttagaagtttatataaaactcatcttagatcctttttgaataaacccaagttctgtataatcaccaaaacatatacttccaagttataaaataaaattatatacttacttatgtaagtaataaccatcatagagcaaccttaaaatgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggagctaatcacatagtatcgattgagcaatatgtatatatataaatgtacatagaaatacactctagctataatgaaacccaaataaaacttgttagaccagtgaatgcatagttccattcccatccaccaaaacttaaggcacttagcttatgtaataatttctaggttgatataataaattgctaacatggactagagctcccctagtttataaaatatgaaccatgataataaagaccataagcctatgaactaaggttagattagttaactaaaatactcattttatacatcactagctagatgaggcaagttctagacctaaacctctaaagccatgaacctatagaacactatacacctataacacgttataatttgtaaaatacataaagaattcatattaactctaaaaattatgaaaccaaatgtgttagtcttagaaaacacatatcttcaccccagcaaacataaacttaataagaatcaccttataacagcatttcacaatagtacctaagtaaatcctacgctataccgatgaaacttctaaaattcataattctcaaatgaaatgagataaaatagaaattctttcacctaaattcattttagaccagtacctattcgctgtgcacaaatcatccattttagagcattttggatttttcgcatatttcggtgtttaattgcataacgtgtactttgtatagatgattgcttaatcggtgaagaagtgatttaggtgctgatattttcctgattcaaggcaagtcccacctccctctctttgatcactttgaacctatgttttggaggttattgaaaatgtttgcaaatcttgcatgtcgattgtacactaataaattaaaattttgttaaacttgttggacaaactcctattgtttgcattcaccttgaccccacatatatccatatccctcactcctaaccttaggaacaatatgactataccactttatatatgacttttggtgacactaggttactatataaagcttagccatgcttagaattgtcttccttgtcattatgggctcattacaaacatgaaaataaatttttaattaatctggacagaactttaatacttgtgattttgataaataaaatggtggaaaaacatggattttaggtttgggcctcaagtggtgcacatatggtgattagttgtgtaccgatagggggagagtgtgcccaaaccgacctaaggacttcactcaatgtcagttcatttcgtatacagtgcaaccacatgtgctagtatgggatagcccaagcttagtaaattatttatggtttagccttacattctggtaggctggtgtgtatgagttcggataactcagaggaacttcctatttaccccgacgtggtagtttaggtgactaagtctgtccaatacaacggtattgtgccacgtgggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgtgggtaataaatcgggtacttatgtatcgcgtgacatgctcttgcatgattattatttcgcatcatgtgggtaaagtgtacaaactctgcagagttaaaactaatcgattagccgtgctcgcggtcatgagcggcgtgtggatatgtattgagtatagacttgtgtttactctcctaaatgctgaaatttaccttcaaattgtgatgagatttgagaatgatctccttgctgccatggatggcaataaggtgaatatttatacatgattaatgcctaccttgatgcccaatacgtcaaatactagcttgctgaaatttatttgaaagtaaacctgatttagaaatgttttatgcaaataaaacttgctttatgctaaaaagaaccatattatgccttccttgattatatgccttgcaagtagggtcttaggcttgtcttggtgcttgccagtacattatttctaataatgtactgactcttgctatggaattaaccttttgcttgcaggatttagacttagcctttgagtgatgcgggtgatcgactgcttcttctaggacttgaacttaatggggtaaacccctagtcggtgtgcttgtggattgggtagacaagcttccgctgttctatatatttatttggccagtcggccgatgtaactaaagtagatgtagtttataatcgctttcatcttatttgtgtttgctatgtataatcatgcttgagatgaaagtgtgaatctagtgcacatcctgggaactagattcacatgagtatgagttaagaatatttgagatgttgtagatctttagccatttttgtcaagtctcctgaatgtgtaacacatctggtcaccgccttcgagtggtttgacgggcacatctcaggctgaagttgactggcaggctaaaggcccggcaatgtctccaatatttctctctcgaggcgtcggatatttcattatacttgtttgatgacttgaattatacatttcatctctcaattataatggaaggtccggagagcctacgacagttggcaacaacatctctagctccatggttgctagacttcttttgtcttctctgttttttgttgttttggatggatggatggataaacagatagatgggttgcttggatcgtggctacttttggggtagggctggtaccagcctatacatgcacattaccagtgtgtatcaaatatgatacctaggtattaagcatgatacatctaagtatcaggtatgatacatataggtatcaggtatggtacctgagacttagatatggtgcatataggtatcgtgagtactaagcatggtacatctaagtatcaggtctggtacatataggtatcaggtatggtacctggtacccatatatggtacatataggtatcatgagtattaagcatggtacacctaagtatcaggtctggtacatataggtatcgggtatgatacctagtacctagatatgatacatattggtatcatgtttggtattcattgatactggacatgatacttggtacccggtctggtacatgtaggtatcatatatattgtgtatggggctaggtcggaccttgtactcacatcaaagacaacactggctaattttccagtgagtggtggctgcacgtggccttgcgataggagaccacatgcaatgtcttacgaaaaagaaaagaaggtagcgtggtaggagactaaagcttgatgtggacagattcatttaactatcccgtaactctctatccctcacgggatcccgtgcgctagcaattctcattaaaaaaatgtaacaaaagctagataaaaaaaaattaagaaaggagagaagacatattttttttatgtttgattgcatcttgctctcttctctacattcatcgttgaacatctgtatccaacaagccatgacttcattgttcgacctctagctttcattgcatcgcaaaaatacttagtgaaacatggaatccatccatctttaagaatggaggtggtagcatgatatggaaaatatggaagtaatcaaactaacatgttagtttgatgtaacaaaatgggattatgtgataaaacaagtatgaataatatagttctaaaccataaaaaaaacaaatgtgcattgcacatgtatgtgcagtgctgatgtaacataatcataaatgttgtgaaacaagtatatgtgacatactggagcatttaaacacagtagtatgaaaaaaactggaacatggaggtagtgtgttgaacaaaaaaaaacaaaaggtattgatgcagcaaacatgtacagtctactcaaacatatggataaaatgtcctgaaacaatcataaccattgtactgaaacataaaagaggggcagtatgcagtggtcatctatgtatgtgcatgcctgatgcaacataattgggaatgtgatgaaacaagtatgtaaaatgtggtgggacatataaaaacagtagtgtgaaacaaccatttgttgttcactgcaacatgtaagaattagcaaaaagagaaaagggaaatttgaaactcacacatcactggaggattccttgctcctcctgtttggcatggatgtaacacatctcgtgtaaacattccccacttcagctatggttctcattttcttctcatctccaccacatcatcaatatccttccccttccttgcccttttcttccttttttttgtcatgagtgcttaggccactacttgcatcacctggatgcagacaaaaaaaaagacaggtatttatagttagtgacaaaaaaaatgatcaacaagaaaataaaaaaaatatttgtggtaattgttatacctgcaggtaaagacaaaacaacaatggtagatgtatttgccgttgtcggagactgaggtactggagaaggagacctcattgctaccagggaatgatctgcaggagaagctgacgtagctgctactggagaagatggcctggaagctgacggagactgagcaactagagaaggcactctcacaataattgcagttgcatcattcatctcacaacaattcgctaaaatttatggtaatccatggaaggtagaacttctaatatcagacatggtgaacaccatgaacctatatttgctgtgaaggtaatgcacactttctggctgatgtgcagaagcatggaatgtttaggcttacctctgaaaattgctcgtgggccaatgatcttgagtgcccaaggtgaaaccaaagctccttagccatgtgtggtgcaaaagaagaaagcaacagaacaaaggattcaataaactgactttggttgggtgtcccaccgtaagaagaaagcattataagagaagtaaaagaaacacgtttactagagtacagatattgtggccaatgccatgttaaactgatcttgtcatccattcttttacagttcaatttgaatattcaaggcatcctattgggttttactaacatcaggtttataaattgcaaaaggttatgtgcgaatttagcaagtgctaagcagaaaataaagaagtacatgcataaaagttcttaagcacattttaagcctttactgcacgaaagcacatatataagcttgtttggatttgaataattgcagtacagacatgaaagatctatgtactagaattgccttgtaaggggagattggaatatctattatcctaagagtgcggtgattgttttggtgattaatgacaacccattgttggaactaactattttcatgagttggtgagattaggttaagttccggcatcaagttaaaagattgaagctagaagatggacattataccttgatgaggagcaagtgaagacattgatgatgcggggtatgaaatggctatctatggcaaaccggtgaagagaaagcaaggctcggctagaagatggacattataccttaatgaggcgtaagtgaacgcattgatgatgcggagtatgaggtggctattaatggcaaaacggtgaagggcaagcaaggctcggctacaatggaccatgtgtggggtgaagggcaagcaagaggcttggcgccgatggaccgaatccggtggtgaagggcgagtgaaggctttgtcatgatggtcatgatggaccgtgcgaggccatttgaagctatgagtaatccgtatcaattataagaagaccgcaagatggaatgtcgaggatcaagaggatgtggttcttcgatgaacatcaagtcaaaatccaaagtgggcattgatcaaagcaaaggtataattgatttgggactaatatgcttaatgagtgtaggtgagaatagtcccaatagcgaactggcgttgacgttgacaaccctcaaggtgaagcaagaagatgacattcttagtggtgtattagtcccaggttgcttaggagtgggctaggatgcttggagaccccccaaaacaaagcggcaagaagacttggagccgagttagactagtttaccttttcgctttgagtttaggaaaaaccgtactattaagaggggttccaagtgtggttctgagataacacaagtgctcttagtagtgtccaagtgttgaaatatttttaggagctatttttgaaaatggctctactcgggacagagagtcccacccgaaggttctgtccggaacttcctggcgccgaggtgaggttgaaaattttcctaagtgctgcccggaagttcctggcacttttacccggaacctcctggcaggtttccagttcaaacttgtgagtaacgtctagatgacgtcacctagccgttatatatattgatctcgtccccacgtcaccctttggccattccactttagttcttgtgttccctagcttgttctagcctctcccaatgtgattttgctttctccacccaaatcttgtgtatttcttgagtgagagagtgattttgagggtggtggtgaggattggagaaggttttaaaggctaggatgacttgagcacttggggtatctcgttgggctgttatttggagcttgttactcttggagggtgacctcctagatggttaggtgtcgcccgcgagtttccaacaaggttgtggattgacccgggcaagtttgtgagggcgttattccacctccgaaaggaaacggaatacacggtaagtgaattccgagctgaggtttaggatgtcgtcttggtagagcaggcctcacttgtggtgttctcttggtgttcaagttggggatcttagtggtcacttgaaaccaaagagaagtacctaggggtgttggcttgaataccggagacctcttcctaggcctttgcttggtaaggcaaggggttaattaagacccggctctttggagctcctcaacggagacgtaggattctcggtggagaatccgaacttcggaaaacaaatcttttgtctcctctcactctctttatctttgtgattgtgatgcttatctccttatttgcctagttgtgctatcatgtctcccattgtacgatcacttgtgatatcttgtgtattttcatgtgtattactcttgtttgagatatgttgtacctctctatggtttaggcttccttgtaatttaatttacttgttgtgaggtgcttgaaatagcaattcacaactgcccggaagttcctaggaagaactccggaagttccgggcagctttctctgcttgtgagaaaaagttgccaggaagttccggaccttttgccaggaagttccgggccctgattttaaccgctgcgatttgaagtaaattttaggaacgcctattcaccaccccccctctaggcgacatcaaggccctttcaagacaccagttccatattcctgtctgaacaactaatcaatgactagcgataatataacaatggagacatatagtaaaataatctgaacaaaatattttgcaaattcaaggcaaataacttgaattttaacaaagcagacacattttttaaacttatgttcatatgggaacagtgtataaaaaaataaaactatgtgtcttatttaatagcaagtcatctggcatggaacttaaatagataatgtgtaggcaactacaaaatggatatgcaacagaatttatagatgaaactatgcatgtaaacatagcttaaggttaccttgtatgcagcattcacaaattccatcattgctgaaattgcaatgttaaatcttatttcttgaatttcctctgtgacctataaaacctagaatagtacattatagtaaggagtggcatgaatcaccaatcacatcagcacaactacatgaaaaacatttatcactgcataatcatgtttagcagtaaggagaccctgagaattggctgatgatacaatcttgaaatagttagtacataggcaaaacttttcacaagataactgataggggcacagttgcgaagtaccattacaaataatccatctcaatattggaagcataaaagattcaaaaataattgaaatggtggcacatgccgtaaaattaattaataaaatttatattccccaagtgcatggcatgtataggaattatgtgcctggaacttggtagaactgttcaaatttccaaaccagactgctagtaaacctaaaattttgaatggctttcattcagagtgaattagtgaaaagatgttatttggtcatgctatcaactgtgacctactcttgcaatgcatttgtgaagaactcggagctaatacaaggttggttctttatcggtaaccgtagttctaactccatatgatccatctagtgtgaaactaaagcatttcttttttgactactgcaggaaaaaacaaacaatggagataccctaatactccctccgtccacctaagattgaaggcgatattccatagtagaactatttgtccagattttctgttctatgaaatatcacatccgattctagatacacttatattgggacgaagaaagtatttttgaataagatgagtggagctatgcacgccctaatgtctataagcaagaccagtggggttgtgcaattgaggtaggttgcatcttggcttagctgttcacgagaaactacccccagtcgagattggccacgccttgatttgagttgatggcgtcttcaggggtaagagccaaagatccacactggggatggcctaagggggagttttgatggtcaccatattttgccacaactttgataagctactttgatcaacttatcctagtgctactttgatcagcttatcctagtgtttatttggctgccatcttttttctgcgctatctttttcttttgtgtccccacctgtcatatatacatatctttgccaatacttgcctaacttgtggccaaagattttttagccacacaaattgtgtcatgccacaccttagctataaaaagtttgataaacaaaaacaagcatccaaatagccctaactcatgccgtgtttggaatgatatattgctatagtctaattagccacacataaaacgagacggataattagtgtataattaaattgaatattaacaattataattttgaaaataaataatttgtttcttaacaaaattttatagagtaaacaataaaaacgtgttaggaaaaaacaaggatttttcatttcaaggtgctaaaaaaaacttaggggatatacacgtggcaaacaatagggaaaaaagatactatctgtctagactatccagatgtcaccgagagcaaaagaaaaacacaaccctcttgttgtctagcaaacgatggcctactggtggcggcagtgttgggctctggtgcatcggtggcgcgaaaaactatagtgtactcactttgcctcaaactataacacaatattagatggaatgggattaaagttttggaacgcggtaatttccacaccctgccaagcaaatattttgtccaaaattttcatttttttcaaatatttgtgaatttggtaacaatttattcaaaattcaataaaatgtgtcaaaatttcattaaaaaaatcgttcgaaatatccgaaatttcagaatttcaacacccacagaaattttggtgccttccaaaagtgcaaaccctggatgggatataccttagttttattatgaatttaaaaaaagcatgtatccagattaatagtattaagatatatttaatctagtcttaggttgttatattttagaatataggggttatcaaacttgatgtcgacacaaagatattgctgatccgcatgcatcgagctctgtggcagcaccttggaagcaggaagcatgggatgataaggagtggacgacgggagatcggttcactgtgttgtccctgccgggcgacgtacgtcggccacagctacaccgacccacacctgatatgatcagacagacgaagctcgaaggagcgccgccatcatttctcttgtggacagccctgatcacccccttgtttcatccgcaagaccgcaacactggattctctaaccgcgtggacgtggatgtagtatggtcgattattgctactggtacatgtgaaatttatcgctggtgcgcgtcatccctgtccacacacccatccctgcagcaagaattttttggtggtacatgtgaaaattattgctggtccgcgtcatgacgccttctaagagcaagtataatagtaggctataagccggctaaatgctgaggtggaggagagaagatagaagagaaaggagaagcggactgtaacttacaaccggcttggacacaataaccaagaaactctgtgagaaagacaagtggaccctatattaattgtaaagaactaactattatatgagtaaactgagagaaggctaaaaaaaccttatagccaacagatcggttgtaatattagccttgctctaatgtttgagctcgtcgggcggcatttactgcctcgagctccactctgctttgctctcctccctgtcgcacctgtcttaccttgccaacatcgcgacttccgatgactggtgatgcacaaaggaggaggcgtatgtggtgcaccgaagtcacattggctcaaggcggcagctcctcggtggccatggcatgcgaaaaggcagagggagaatgtaccagcaggagagagagaaggggaagaagatgatgacatgtgggatttggccatttttgagattgagaaatggacacgttagaggttatgtacacatgatgctacgtgtcagatgagcatcatataggatgaaaccaccgtttaaaccgttgggatgaaaaataaacccaggtttgattcttaaatgagtttatgtatctagctttacagttgagagagtttaatcagacatcaggcttcggctatagatgagggagggaggcaaaatggtcgttttccttggtatgatatccatggccgagctatctccagtagacctcaagatccaatataacaaagcattttgcatgaatatcatacaaacttcattttgaaccgtggagtgcacatggatttcgtgctgtgtgagtgagtaaaacaatgagcctcggctcaatttttcttttccgaatgtcttataaacaccacctatgcaagcaaacactagtgtttgtacacattaaattaaaccactgagatatattcgaaggaattcctaaccttctgccacaaataatagaggtttttcttttcttttgcatatattacctaccagtaacaatagattggcacctggttgctgatgcatcataaccaggagacactaaattctgttaccatcagcaagctaatactgaccttgcaaaaaaagaagcaagctaatactgaattgtttgctagctgaaacaatgtgatcacaggtatctgacgagagagaagatgcctgaataagacgcacacggtatattcaacaactaggcctcctctttttcatgtgaaaagatgagcggattgtcctgcaactaacacaacatatagtcttgatgatagtaacacgcttgactgaactgggtcactttttactgcaatgtcctcaatgtgcttaccagcaaagcctccacaaaaatagaaacataaaacagttccagtttgtccgaaaaataagactgtacggtaaactgcgagggccaaaacactcaacttctccaagttttccaaaacgagaagcctcctattcattagaacgcatgccagttggtttctatgaaacctgaatcagacagaagattaggattcatctcaataattatacgaagagaacgacaactggtatataaaggaacaattacggtgttcaacataaatgcaagtatataggaaactatgacagtccatatgtagtccttttttactcatgaaaattgaaaaggtagtgttgtactatgttttgttcttgtcctcattcagcagaatatgacgcaacaaattattttttttaatattcatgtcttgattcggcagaagattacacccatgatcccttctctaaaatactcaagcttcatttcaggcttgacaagtgataatactttaggactaaagaatgatagtggttcatcatgatgacaatgctaggcatcctttaagctcttagtacttgtgtttgtgtgcacctaataatgtctgcttgttcacacacacaagccaacagaaataccatactcccctataaccgctttgtattttcattaaagcaatgaacatgatattattattactatctatcaattattggtcccaggaaaaatatcagaacaggatcactcatgaaaaaacagaaagctcttataattagtcgcccataatattatacgagacaaagacaataaattgtgatgatttgtttgatgaaactaaatcaagattacttcgttggtgttttattggcctgatttggagtatgttagtaagtcatgcaatgctgttcaagaaaaaaaagctataatttgcacactgatgcaaggtcaagatcaagagtagaacatgatcatgataatttttagtgtagtagtataccactaccctaaagacagcagaagacacaacagttgctcatctattattctcatattcgttctctcgaaagcacaggactgcgtttcatttcattaaggagaacggaagttaaaatattgacaagaacaggggagcaaaagaaaactccaaagaacccccctccccctcccccgacacacacacacacatcatcatcatccaaaggcataattgcccaggttaaggggtgcgttcagatgtcaaggtttggaacacactcccttcacacggaaaacgagatagttcattaggacatgattaattaagtattagctaaaaaaacttgaaagtggattattatgattttttaaaacaactttcctatagaaaactttaaaaaaaacacaccgtttagcagtttgggttgtgcgcgtggaaaacaaggaaggagaagttaggaaggtggacaatcgaacacagcctaagtcacctaaacaggaactcatggagcgcagatgttccagctaaacaccacaagccacattcattatctaccatattataaactggcctctcatgattcagagtaaacacttcaaaaaatgaggacacttcgtccatgttcttgagtcttgacaatggttatgtgccatcagaactgaattatcctactaaaaatgagtgtactagaagcaattaagtgaagtctaaagaagaagtgaattttcttggttaattaaaacaaggaaacagaaatgatggtattgtactatgtgcatgttccctttttttcttaaagcgcactgcattattgattttctgtatactgtttcgttagttcgacagaaattagcgacatgatcacttttcaagaaacactaagcaatatgttatatagacaataacaagactataggctttatttaggttttactacagaataagtgttactggaccaatgcaaactctgtatctactattgagtaataactaccatctggcaactatagtctatagatcttttgaaccatattcctgtttccatttctttaagtggactgtgtttattttctgtataccattcctctattgcagcaaaaccttgttaaggaatacaaaaccatagacaataacttcaggtgtaacatgacgacagactttatttcgatatactactaaataatttttactgggccagcgcaaactttatatagatatcagcatctggcaaatacaaatatgttcagatgatggaaagtcaactcattaaaatttggtaatacatactcctacgacatggcagaatagcatcattggttggcataaaacagacatagcaatttaataaacaggctttcattgtcagcaacaaattaacgcctgataattaattgttaacatggtttccttaacacagtatatgagggaatagacgatgaattaaacaacagtagcaaaggaaagcatacagtaacagaatcttcttcacctcaattcttcttgtccctgtctacacgaaccaatatgtctgataaggtcttgcttttggcatcacccttgttgctcgcagatgttccttcaattgaaggacatgaacaattatacagcaagaacaaaagtagaagctcacattttcatacattgcatgaaatagctgaactgccaaaggcaaactgaggcatcgagagtatggcattcgcatgtcaaatatacttgaaagagaccacgacaccacacttctattctgaattttagtttttcaggaaatattctgaaatttgttcatgtttacactgctaatatatattcacgtgctatgggtaagcgccttggtgtcttaggacaatcattcaccaaggcctaaccatgtacctgaattacaaacagctactccctccgtttcacaatgtaagactttctagcattgtccatatacatatagatgttaatgaatctaaacacatacatatgtctagattcattaacatctaaatgaatgtgagcaatactagaaagtcttacattgtgaaacagaggaagtagcaaattatcccaccactaagagtttgaggtttgtattttgtaaacgctaatcataagaagtggtccatctgctattcacaagctgcctataaccatgcaattattttagagaacatggaaaaatataaaagttgctatggatctaacaattctagcatccttacccacacatatcacaaaagcatcatcttaaacaaaacatgaacgcgtgaaagatgattaccagcagcggggattttgcttgatgcaagccacggtgggagcacacatgatttaaggatagaggtgataaaccagggtgagccttcaccttcttctatcggcgaagacccaagcaccttccccatctccatgtctacagaaagaacatgtttgccaacgatgacacaaatgacgctcgagtttagtgggtcaatgacggcaattcgcggggtgtcctctggtcctcctcccttcacctcgcagattcgaccaagcgccacacggtgctccagcgtccagctgccgccatcgtcgtcaagcgcgaaggagctgagcacgaaaggatccttgtcggacacctcgacatagcgcagcctcccctcactgacccccacgcgccgatgaatactctgcacttctactagtagatcttcgctgggcattggccacacactgcccctcgggagctcgacgaagtggagctccggccggtcgctgaacgggtcggcggagatgacgccccatgtcagatcgacccaccacagccgtccggcgaacgccaccgcctcggtgtcgatgtccagccgccgcacaagcgggagcggggacggcaagccgtcaatcttgtcccacttcccggttcgcgagaggaaccgccacatgtggaaggtcccgctgttgctgtgctcccggagcatggcgacggcgtagctgtcgggcggcccatggccggcggcggagcgggtgaggaggccggtgtggcgccagaagaaggtcttcttggtgccgtcgatgtccgggaggcggaacagctcgccggtgatggggttgcagacgaagcgcgtgaggtcctgatcctgcgggttgaggccgtcgaggtcgagctcgccttcccgagtaggggtagcgccggcggcgaaggccttggagacgacggagagcggggcgtgggagtccacgtaggcgaagaggaggaggccgtcgccgctcgtggcgtagatcacggcgctcagcaaccccacgacgtcgatgccggtgccgggtttggggccgggccgccggtcgacgaggtggtcaggcaggaggaggtaggaggaacacggtggctcggcgagaagaagggacgcgcgcggcgacggagttctggcctccgtcgcgtggtggatgctgtggatcatcacccacccaggatggcgcgaggcgtcggcgtcggccgcggcggcggaaagggcgcgccgaacgggcgcggcggcggcggccgcggcagagagggcgcgccggacaggcgcggacgcggaagcagcggcggagagcgcgcggcggagcgggagttgcatcctgcgccggtggagccgtggaggaggccggcgaactgcgaaagcgagagagaaagggacccgcgtggcgtcgaggagaagccgaggaggaggtgctggttcacggtggaccaggttcacggaggtgagctcagactctgacagcggcagaggggagccgcgcgagcgtggacctgttccaccgagcgcccggtgttctgcagcagggggtcgtgacactgacacccggtgtacgtggactaggtgcacctattcagttttgtacttgctttgccgtgttgttgtagcttctcttcttttgggtccacatgtcaggcgaaaggccgtattgagagtttgaaactcggaggggaaaagtgctcttactggttttcccgccaaaattctacgctatgtgggccgacagatgggcccaagctatgggctatcgatcaactaaacctcaaggcccagttatgaccatccttttgcacccccagcacgtaagaccgaattattaaccaaaatttctccttcaatttgaaccgtgacattgagtttgtgctgtgtgcagggtttacgattccgacatgcccttccgtttcgggcactggcggaattcgaaatttcgcgaaatctggtggaaaaccggtaaatttcaaacaaatttcataaaccaaaatttgaatacaaattctctgagtttgctgacaagttctcgaaaaccggtcggttttagcgaaattccgatcaaaatcatcgaaatgaccagtaatatgtaatttggaccaactactagctgggcctagtacatacaatttggcccatataagtgttttcctttttttttaattctttattcttttctttcctgatgtaagtttcagtaaataaaacacaatacatcattttttttgaatatttatatcccaataggttctatgaatatcatagtatttataagattttatttgttttttctttttttatcaattcaaatttgaatttggatgaaactcctcgaaatctcagacggtttctactttcgagcctcgtcagaatatcgaaatttcacgaaattcgatcggatttcgtcggaatcgtaaaccctggctgtgtgagtgaaaaataacaggccggctcaatttctcttccaaaccagacaaaatatacaccacctatgcaagcaaaacaattgtgtttgcacacagagacatgttcaaatgaatttcgaattcctaaccatccgcctcaaataatagagactttttcatactatcttcctacaagagcaccagtaacactagattggcacacaatggcacctagtagtacctgatgcttcctaaccaagcatagagatactttttaagttcttttaccatcagcaagctaacactgaccttgcaggaaaaaaatatcaagctaatagtgaattgtttgctagctgaaacaatgtgatcacaggtatgaagagaatgaataagcagagaactgagatatcatgatttacagaattatgcatcatctttttcaatgacaaaaaatgagctcattgtctttcaattaacacaccatgtatagtcttatgtgatggcagtgacatgctgactgaactgggtcacttttactgcaatgctctcaatgtgctcgtaagcaaagcctctaccaaagaaaacataaaatagttccagtttctcccaaaatacgacagctaactgcgaggatcaaaacactcaactttccaggtttctcaaaaagtcaaaacgagagttctccatgctaccattcatcagcttcctaattcattaaaactcatgtcagtaggtttttatgaaacctgaatcgaatagaaaacattagaatgtatatagaaaataatttagtgatcgacataaaagcaagtaaacagaaaactgacagtggctcatcatgatgacaatgctgggcaagattttgtacagtcctagtgtgcacctagtaatgtctgcttgttcagtataccacacaagccaaaagaaataccaccgtagccccctataactgctttttattgtctttaaaccaatgaacatgatattcttattactttctagattattggtcccagcctcccaggacaaaatagtagaacaggatcacttgtgacaaacagaaagctcttaattagttgcccataattttatatgggacaataaatcatattgatttgtttactgaaaacaaatcatgatgttgactatcatttttatacttggtattttattggcctaatttggtatatgtttataggccgtgcaatgcttgttcagagaaaagctataatctgcacactgatccaaggctcaagagtagaacatgattgtgataattttgaatgtagtctactactacactaaagactgcagaagaagcgaaagttgctgaagtattattctcatctgaaatatcgatcttataaactggactctcatgattcagagtaaacacttgaaaacatgaggacactgcatctatattcttgagtcttgacaatggttacatgccaacagatctgaactatcctattaaaaaatattgtattagagcaattaagtgaagcacaactctttgtgataccatgtgaagatcataactgtgtcagtcttctgttaacatttcccccaaaatgagttcattgttgcagaatcattgacatcctaatacgtaatatccaaaaagaaagagcttcctactccaccaagaacatctttcacctgttaaatttcagacattagggacatctaattgatcatatgcagagaatgagctgaggaagaagcgaacaaaaatgatggtattgtactatatgcctgtccttttttttttaataaaagcacactgcatattgattttcgttgattttctgatcaaaatcaatatgctacaaaaattagagacatgatcacttgttaactaacactaagcaatataaacaataataagactatagtctttatttacgtttgactactaaataagttttactggaccaatgcgaacattgtattaactagtgactaccatcaggcaactacagatcttacagctgatgcaaggtcaagacattaatgtttggcatactctttttttttaaaaaaaaaaggtagaaatgaattccggcctatacatcaacaaaggatgcaaacaaccatttttaattcagaagtgatattacaatttacaagatggtagatagcatcgttgattttcttaaagcagaagtaccaattttgtaagctacgctatcatgatcagcagcaaattaacactaattaataagttgttaacacagtttctttaacaggggagataaggaaatggatggtaaatattaaacaagagtatcaaatgagagaacacaaggacagaattttttttcacctcaattattcttgtcgctgtgtacacgaaccaacatgtctgataaagtcttgcctttggcatcacctttgttgcacgaaaaagttccttcaatcgcaggacatgaacaattataccacaaaacgaaaagtagaagctcacatttttgtacattgcatataatagatgaacatccaaataggtaaactgaggcaacaagagcatagcattctcatatcaaatgaactattaagacaaaggggagttactaataccaactttctattctgaaatttcagtttttcaggatatattcagaaatgttattcaaaattactctgctaatatccataagtatcttatcttaaacaaaacatgaaggtgtgaaatttggttacctacctgcattagggatttggcttgatccaagccatggtgggagcacgcacggcttaaggcaagtggtgatagcccatggcgagccttcactttcatcagtgagcgaacaccctagcaccttgcccatatccatgtcgaccgcaagaacatgtttgccaattaggacacaaatgcagcttgagtttagtgggtcaataacgccaatccgcggggtggaagtgtaatcctttgaggggaggcctcctccattaacatggtccctgcagagtggagcaagctccacctggtgctccatcgtccagctgccgccgtggtcgtcgagggcaaatgagctgagcacgaaaggatcctggttggacaactcgacgtagcgcagcctcccctcgctgactcctaggcgccggaacatacccaacgcttgtactggatgggtgctgggcattggccacacactgcccctcgggagctcgacgaagcggagctccggccggtggctgaacgggtcggcggagatggcgccccaagtcggatcgacccacaacaactgtccggcgaacgccaccgcctcgaggtatagctccatccgccgcgggagcgggagcggggacggcaacggcaagcccaccagcttctcccacttcccggtttgcgagaggaaacgccgcatgacgaaggctcgttcatccccgttgcggctgcggtcctcgttgagcagagcgacggcgtacctgtcaggcgggccgtgcccggcggcggaggcggaccgggtgaggaggccggcgttggggccgtaggacaaggtcttcttggtgccgtcgatgtccgggaggcggaacagctcgccggtgatggggttgcagacgaagcgcgtgatgtccgggtccatgtcgacgccgatcagcttaggctcccgagtgccgctgtgcgtggagacgacgggggcgtgggcatccgagtagcagaggaggaggaggccgtcgccgctggtggtgcacaccatgccgccgaggagggccatgacgtcgccgttgtcggggccggggccgggccggcggtcgaagaggtggtcgggcacgtagaggttggaggcgcccggggggtcggcgaggatgaagaaggcgcgcggcgcggtggatctgaccgccgggatgtggtagatcatcgcccacggcggcgtgcgcgagggcgaggcggccgcggtggagagggcgcgccggccggccacggacgcggcggcggagagggcgcgccggagcgggagccgctgcattttgggagtagtcggcttgccagcgaaggagaagccgaagaggcgtggtgggtggagctctgacaagccgcggcaggttggattttgcagttgtgtgagctggtgcactagacctggcgcacgcagtgggcacctgctgtgggtccttctacccgttgccgtggggttcgcatcctctgccattagggggtaaatggcagaggggaacagtaaaatgtgagtagcgctacagtgttttgccattgctacagttgcggtgggggttctcttctataggcccacatgtccagatgagcgaccggacgagacacggagggggaaagtgcgtagccctttgacgttgggtgtgtttagtttctgcgtgtaaattttttttaaagtatgcggacaaatatttggtattaaataaagattaataataaaataaattataaattttatcaaatttattaagtctaattgatccgtagcatcacattgttaaatcatggcgtaattagactcaaaagattcgtctcgcgatttacatgcaaactgtgcaattgatttttttttcatttatatttaatactccacgcatgtatttaaatatttgatgtgacgcttttggtcaaattgttttggaatatgaacaaggctgttttcgatattgcatttttggcctcccctgatttctcgaactattagatgatgatgcagttttataaaaataaattaatagaaaaataattttgaaattatattaatgcacttttaaaagtttttttaagctgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttacaccaggcttcatcctaaccattacaggcaaggtgttacacgaaaaagggcaaacatgcacgttgttaagctgacgcgtggtgaacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggacgggacttttttcccttttggaaggctgaggggaaagggagttaatcctttgtgactcgtccatacacaaatccacaaaaacacaggagtagggtattacgcttcgcagcggcccgaacctgtatacatcactgtgtctcgtgtgtcttgcgggcgggtgatctttccagatacagagagagagagcttgagatctcaccctaagcccccggccgaaccggcaaaggggggcctgcgcggtctcccggtgaggagccacgagctccgtcatctggcgcgccaggtagggggctcagtgtgtgttttctgagctctcatactcttccgtgtgcgccaagtttttcttgttctgcctaatggccgagcaagcgaaggcgcacgacctctcaccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctgcggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcgtcaaggcggagggcgcggcgagcggcggctgctgcgcgccattcggccgccactccctcgtcgacacctccaactcgggaggatcagcatggagagccggatgcccgcatcgacatcgagcgccggcgtaataaccggcgtactccccgcgcaacggagggcgcctcttcgtccagagtgtcacctcgacatggacgagaggatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtacggcacaaccgcatgctcgaaaagatcgcttccaaagagccccagactaccgcggagctttttcagctcgcggaccgagtggctcgtaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccactcgaaaggggaggcctgcgagcgacaaaaagaaagaggctggtactcccagcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcaccttcgaccagaccgaccacccaccgtgcattgcccggggagggcaggttgcgatggtagtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccattaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgtgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctcgaggccggattcatccgtgaagtcatccatccggagtggctggcgaacccggtggtcgttcccaaggcgaacggcaagcttcggatgtgcatcgactacaccgaccttaacaaggcatgtcctaaagatccttaccccctgcctcgcatagatcagatcgtcgactccactgcggggtgcgaccttttgcgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtgtacctgcgggcaagcttctcgggttcttggtctctgcccgaggcattgaggctaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgacccctcaagtagttagtgcagcgttggttgtggagcgcgatgaaaataatcctcatttcgtgcacccccattctgtgctaacttggcccgggagcgagcggggaggagaggcccccgagtcggacggtggcctacggcccctgacgaccggagtcggccctctgcccgcttgtcagacggtgctaagtgcccccgaccctcaggagggccccaaggccactgcgggaaggccgcacttaacgccctttgaccccgaggctaaccctgtgctgactcgacccgggaaagagcagggagaagaggcccccgagccgaacggaggcctgaggcccctgacgaccggagtaggacctttgcccgcttgtccgacgatgccaggagcccccgacccccaggacggccccgaggccactgagggaaggccgcccctttcatcctccgaccccgaggtcatcggcacagaagacaagtgcgccccgaaaggccacttgaatgaagaacgccccggggatacggcccccagcaaagaggatcggccccaccgaagggtgcagcggcctgtctactttgttagtgaggccctccgggatgccaagacccgataccctcaggcccagaaaatgctttacgctattctgatggcctcgaggaaactgcgccattatttccaggcgcatcgggtcactgtggttacgtcttaccccctcgggcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatacccgaggccagcacggacccctctcagctgcctcgcaccacccactgggtgatgcagttcgacggttctctgtctctccagggcgctggtgcgggggtcacgttgacctctccaaacggagacgtcctcagatacctggtccgcctcgactttcgagcgaccaataatatggcagagtacgagggactccttgccggactcagagtggcggccgggctggggctccgccgcctcctggtgttaggcgactctcagttggttgttaaccaagtctgtaaggagtaccggtgctctgacccacagatggacgcctacgtacgccaagtacggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagccctcaatgatgcagtcgatctggtccggcgatgcagagcgtgtcagttccacgccaagcaaatccatcagccggcccaggccctgcagatcataccactgtcatggccatttgctgtctgggggtttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaatgccttaaaaccaagaccttcaatattctcaagaagcacggcgattcatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccacgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccgggcgggctccgtacggctggccacgggcgacggcactgagctgccaaacccgtggaacatcgaacaccttcgtcgcttctacccctgaggaggggggtcgggtgtcaggttttgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttaccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacataagaaatttttcatcatttttgattgcagattaagttgatctatacaaaaagaagaaagaaaaagaaaaaattggagattggcgggggcctgggggctcattccaatgtgcccgggtcgccggcctcgtcgccaccgtcgtcctcaccgctggcgtcgccctcctcgtcggagctgggggcgaacgcgagccgaggggccgacccctcgaagctttggacgatgtggttggcggcatcccggacccgcgcgcgcgcatcgtcctcggtcccgggggggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgtcgggcccaatctcgcccgccaagcgaagggcctcggcctccccggtggagaagtccagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagcctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagataaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcggcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagtaagaaaaaacttccttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgctgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgaccgaagcggcgttaccgtatctccgggcgagaccaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaatttgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcaccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggaactagggtgttatctcttagagatggcacgttagccctggtcagatttacaccaggcttcatcctaaccattacaggcaaggtgttacacgaaaaagggcaaacatgcacgttgttaagctgacgcgtggtgaacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggacgggacttttttcccttttggaaggctgaggggaaagggagttaatcctttgtgactcgtccatacacaaatccacaaaaacacaggagtagggtattacgcttcgcagcggcccgaacctgtatacatcactgtgtctcgtgtgtcttgcgggcgggtgatctttccagatacagagagagagagagcttgagatctcaccctaagcccccggccgaaccggcaaaggggggcctgcgcggtctcccggtgaggagccacgagctccgtcataagcgcactccctccatccaaatatatactcccttcgtactccgacatgattttcgagatgctactttgaccaacaatatctataaaaataaaatgttttaaataaaaagagttgcatattatgatagtttgtttaatgataaatctagtaacatcaattttacgtgattaatcttttttatttttttgctattaatagtcaaagttaaaaatgtttgacttatccctattctaaaaatgtttatattttcggacggagggaataagatattaggactagatgtgatacatcataatactaccaatctattcagattcatagtactatgatttgtctcatccggttctaatatctaatgttttggaagagagagagtaattattcatgtgttaattagcaactccattttatgtgtcgacggggaatggttcctaacccattcaaaaaaacaacctgatgcctagttctaaacttctttaattcacagttttcgtaagcacacttctcgaaccgttaaatgttaaatggtacatggagtgaaaaattctatgtagaagtttttcttaaaatcaaataaatatatttttaaaatttataatagctaatacttaattaattatgtgctaatgagttatcccattatatatgtgccactaatattctccttcattttggagtttcgaacgagcctttagaagccgtatttttacagatagacaaccttgcgttgtgacacctagtttcatatagataagttaaaaaatagagatatattttgtaaaagaatttgtaacatatggtggtgttcgtttctaataaaggtgaaggtgaagctagggcacaaatcaagaaagccattagcacatgattgattaagtattaattattacaaattagaaatttggatttatttaatattttaaagcaacttctatatagtatctaatattttaaagcaacttttatatagaaaatttatcggatgaaacacatcattcactggtttgaaaaacatgctaataaaaatcgaggtagaatttgtatcttagataggaaagaacgggtggtactttggaacaaagttccttaaattcctttaaaattgtttgctctcatgcagtacaagcgtgatcaatcatccttcccatcccacacacaacttctgtccaataataaatggatctaacatgagatttgatattatctatgacaatgaatcgggataggtgactaaacagatgtatattcattatagtaggtagcattacatcttatattagattgatttattttaggacggagtgactaggcaagtattattcatgctcctacattatacatataagtattttgaatgcaccaacaggttattactaaacaatgtctttttttagattggaaatggattacatctccggtctctgctcgtgggcatacagcaaaaaagtctcagaagtaaacataaaagaaattaaaaaaaatacatgataggataaacccccaacttctgccaataagatgatctaataaaataatgtttccaaaatcaaatagattgtatgacaaaattctgtaggtactacaccatctaaactgtaataaaagttccttggctataaattccaaacgtgtagcatcattgtacatagtatcttatcttgttgttcttgtgaaagtatcatacaccaagagtgaagccagttggaacacatgaagataacatgcatgatgctagacatttttttatggttaaaaattacaacattacggcaacgacagattgaccaacatagagcactaactccaaataaaatcattttttagtctaggcactccccttagccagttaccaaaaatatcttttacattttggaaaagggaatattaatgtcaaagaagacatatcatcaagaaaaacgtgcaacatgacagtaagagaaaagatattggatggtcttttgtatatttaaaaaaaaaacagattagattgcttgttttccctccattctctctttgtgaggttatctttcattaagataacccaactatacatctcaaatagtgaatcgcatggatttccattttgtaggttaaacaatggtgtatgtcaaatgggctaggaaatccaaacgtggcttaaccatcaaagtactgtgtccacaatgctagcttgcatgtagcctttttttttttaccatatggtcaaatagattaaggctgtatttagatccgggggtgaaaagttttagcgtgttacatcagatatacggacactaaattgaagtattaaacgtagactaataacaaaacaaattacagattctgcctataaactacgaaatgaatttattaagcttaattaatccatcattagcaaatgtttactgtagcaccatattatcaaatcatggactaattaggcttaaaaaattcgtctcgcaatttacacgcaaactgtgtaattagttttttttttctctacatttaatattctatacatgtgttcaaacgttcgatgtgatagggtgaaaaaatttgccagaggatctaaacaggccctaatccatcataactaatgaggcaaacattatatccctatacgttattgacactgtttaatgctaatgctatacaaatataagtatcatgtacatatatatcgactccatgtaaaatattcgtcctatgtttttttttaagaaatattcgctctatgttattgttgtgtacttgtgttctgtgttctcttttatgtaaaaatgtttatgccttttatcttcatcgtcattttgtccaccgctgaataataagcagcctcctctctttacatccttcttatttatcttagggaggaaaatttattataagaacagtgagaaacttttttatatatgcactgaaatatgctgaatacataaatcattaggtcccttcaccaaagcttgataaaaccacgcggcgtaacgtacaagtgaaaatgtgaaaccaaggtggtttttgtcttaaagcggggtgaagcaaatggcattgaaagttcagagattgaccatcatgtttgccatgctagctgctactccctccgtcctataaagcaacctagtaccagataaaacacttcataaccatgtctggattcgttgtacttcatagtagtgcaatggttctatcaaatgaaagcaaaacactgttttctgcgtataaatcatgaaatcactgcgatatattcgaatgattccctgctcttctgcctcaaataagtaacagagagatattttacatatcttgcctaccagtaacaatagattggcacttaggtgctgatgcacacgtataaccaagcatgaagatacaacccgagatttagtattgaattttttaccagctgaaacaatgtgatgacaggtatccgatatgaataagcaagcacagaagatgcctaaacaagaatcctggaaagttacattaacatccatcgatctatttttcaagtgcaaagatgaccatattgtccagcaacaaacacagcatgtatattcttatgtgatggtcatgacatgctggctgaattgagtcactctactgcaatgttctcaatatgctcacaagcaaagcctccacccaaaaaaaggaaaaaaaaaagggttcctgtttctccaaaaatatgtagataaactgtgaggtcaaaacacttggaacttccattgggtttccgaaacgggacttctacaactaccatccatcagcttcctcattcgttaaaacacctcttcagttggtttttaagaaatctgaatcaaacaggaaacattaggatatgtttgaatagaatgagcggtataaaaaaaatgaaaacataaacaagtaaatggaaaactatgatagtccatctagccatttctacttaagaaattgaaaagagagcatgttatcttttattcaagtcctgattcagtactatattacacaacaattttattttatattcatgtctttattcagcagaatacctaattatgatttttactatcaaatcgtagtagcaagcttcatcatcttagactcttaggcttgataagagataatattttaggaccaaagaatgacagtgactcagcatgattacaatgcagggaatcctttcagctcttacacaatactattatgttttataggcaaaagtttctagtttgcacttaatcacatctactgcttaccttccatcaattttttttatcccagcaaaaatattacatgaagcttttaagtggttgctcataatattatacacaatgcaacaaactataattaactcttatgaaaatagatacttataatgatgacaagaccaaacacctttaaggcttttatacttagtgacttggttacctacttcatattttattggccaaatttggagtttgctttatgcaatgctgtttaaacaacagctataatctgcttttttatgcaaagtcaatactgaagagtaaaacatgactgataatttttagtgtactttaccctaggatgcaccttgtattagggatggatccaggagaaaatatcatctaggtcactaatcaaatttctttaaaaaataatcgtgccattgcagattataagagaaatttcttaatctaaagaggacttatacagtgattggcaaagagtaaccggtgtcaaatgacagtgatgaatgtgtgctggatctgccccttcgtctaaagtgctaccacaagacggaagaaaaagcaatatttgctcaaatgttatgctaattcaactaaaatatccatcttatcttataaaatggcctttcatgattcggagcacacacttcaagaaaataaggaatacaagcagtgaaaagtggtaatcgaacggcatccatgtatggtgaaaagaattaacaagacgactgattgaataatagttagcttaatgaagtacctgctgacccatttgctgtttggtctcaagtcatcttcttcctatctacacgaaccaacatgtctgataaactcttgcttttcgcatccgccttgttccttgaaagagtttcttcaatcacaaacagaaggattttcaaaattttacaagagaaaacaataatgtaagtagatacacgtttccaacattgcatattgaagtgacaaaacaaatgatactaccagtaccactatgcacaagctaagcctcccactaacattataccgtttcaagtttcaacagagatgtaaaacgaacaaagtcctggatctatctaattaacacttaataagcaaatctggtgtgtcaagcatgcatgtacacgggagaaatcacatgaaagatgatcacctgcacgggggatccggcacgatgcaagccacggagggagcaaacatggtgtaagtgtatccacggatggatcacttccacctcccagcgtgcacccaagcaaatccccattgtccatgtctatggagacaacctgcctgccaactacgaggtgcatgcagccagcgttcagtgggtcaatggctgcgatctgcggcgtgttcttgcagaggttttggtcatgcggccagagccggctaagagccacgcggtgctccagcgtccacccgccgccgtcgtcgtcgagggcgaacgaactgagcacgtatggctcctcctgggacacctcggcgtagcgcagcctcccctcgctgacgccgacgcggcggaacctgcgcagctcccggcgctccttctccatgggctgtgtcacgctgcctctcggcagctcgacgaagcggagctccgggcgatcgctgaaagggtcggcggagagggcgccccagctcaggtcgacccaccacagccggccggcgaaggccaccacctcctgcgtggatgtgttcatgcgacgccggtggagcgggagcgaggacggcaagcccaccagcttgtcccacttgcccgtttgtgagagaaaccggcgcatggcgaaccgttcgtccccgccgcggtagcccaccgagtcctccctgaacaaagcgacggcatacctgtccggcggcccgtgcgggcgttcggattgggtgaggatgccgatgtcggagaaccacgcggtcttcttggtgccgtcgatgtccgggaggccgaacagctcgccggagatggggttgcacacgaaccgcgtcatgtcggggtcgatgctgatgccagtcagcgcgcgccacccaccgccgccggggacgaggggggccgtgccggtgacttccatgaaggtgaggaggaggaggccgtcgccgctcgcggccttgacgaagccggcgaagaaggcgttcagctcgtccgtgtcggggtcgggcacgcgcggcgcgtagccgacgaggtgggcgggggcgatgagcctggagccgcacgggggctccgcgagccggagggatacgcgccgctcgggagatccgaccgccacgtacttctccaccatcgcccacggagggcgccgcgacgccgtggagagggcgcggcgtacgggcgcggacgcggcggcggacagggcgcgccggagcgggaggcgctgcatctttgggcggaggcggcgcgcgtatcgtggcgagcgtagcctagcctagcctaccctaccctaccggagaaggcgaggcggcggggtcggttgttcacggtgggtgaggtccatggaaagaagtggagctctgacacgagcagcagaggggcagggagccgtgacgtccggccgtgggctcggtccaccgtgagccagggcatttggagccgagagggtttcgcaacggtgtggcccggtgcgcatagactcggtgcagcattttgcgttgttctacttggtgacgttacctgtctctatccatctgctcctgcctctgtacttgttcatcctttttgaacgatccgttgacagctggcctacaaaaagcatggcaacggtttcccgccaaaatgctcaggttgtgtcggcctgggagccacagacggtgttggcccaatgggctgtgatcctcaaggtccaacgtaacaatatgaagataattcttcagttagaattagccttttgatttgtgtactactctctccgtctaacgaagactttttttttgtctgcgtccaacgccaacatttggttgtttatcttatttaaaaattttataaaaaaattagtcacgcataaaagtactattcttgttttatcatgtaataacaacaaaaatattaatcatagaaaaattttaaataagacgaagagtatattcaaaaactggaaaatgaaatcttcgtgggatgaagcctgaagggagtacaacgtatctcgtttttcataaccacgatgtattttttataaaaagctttttatatctttttataaaaaatcaaattatagttaacaattaattaatcatgtgctaataattttgcattccaaaaaatcccacccgttcagccagatcgaacaaagccccccccccctccccacgtcggtgtgttttgctcaaaagagagttcagagcaacttttgcattcgtctcatgaaaacactactacattaaggattttcccgtatggatgaattcaattttcgcgtgtagagaatttgaccgtctggaaggaagtatctgcgaaaatcgcgactttttcgtgcaggcgacgcacccgcgcgtgcaggcgcttaagccacccgcacgggaaaatgaaaaatcgaaaaaaaaaccaaagcctaaccctaatccagccgccgccaccgccaccctagctgaggtccgccgctgtcgccgctgcaagcgctggcgacggatccgccgcccgctcccatcgccgccggggaagggaggggaggagccgcgggctgccgtcgttgtcgtcgccgccaccccctcccccatgcctcccctccgccggatctgcaaggggaggggccacgcgccaccgtccgccgccaccgctgtcgccaccgcctacgcccgtcgccaggaggagatcgaggagagaggagtgagagagagagagggaggatagagagagtcagatcggccggataaataaaagagagagagagggggggacttaggcgcgcacggataggggaaaggagagaaaaagggaattttttgaagtgggtaggagggaaactattttcccctgcggttctcttaatatattgcacgggaaatttggctcattttcacgtgcagcctatttaagaggaccgcacggaaaaatcgattttcccatgcagtcctcttaaatggatcacatgcgaaaatgagctgatttttccgtggggtgtgagttaccgcccgcacgcaatgatcatttcaatagtagtgaaaaatcaacgtttgagaatatattcgtctcataaaaaatcaacttatgaaaatgaacgggtcaaatgcttccaacttatgaaaatgaacgggtcaaatgcttccagattccttcattgaagtttctttttatatactcctgtcaaaaaaaaaaagccaacctaggattagggtagccaacctcctaatcctaggttgacttttttttggacagagccaacctaggacccctaggtttagctcctaggtttagcttttttttttggacggaggaaatatgtagagagtaatatcttagtatacgcaggtactaccaaccttggttacagacttacagtaaaagcagactgtttacttaccatcagcagattggcagttaagttcagcatgcatcaatagattggcagtgcatccaacattgatgcatttccaacttaaaccaaattatactaagcacgatctcgcgttgtaaaaagcagactgtttatttttctggcaagcagggttaacgatgactaatattttgggggctacagaagtctaatggtagaaacaaaataaataaacaatgcgatattcgcttcaattgagcatgccgaaggacaaagaatgcaataaaaatggcaaaaaaaatttccaaacatcacattcgaattgcatgaatcagacaaccaaatgtctcaaaaacttcagcaagttaccaatttactaccatcagtaatcagactgccagtcatcgattgtgttaacacacaaagctgccaatcttccaacagattaacatcaaatagttgctcatcttccagcagatcaacatcaaatcaaagagttgctagaaaacgagtatctaagatgacatacacaatgttttccctacgtccaaaaacgaagactcgtaatctgctgccaacatgaacctacagttcaaagcaaactcacttagggaacctttgctcagctaattttaagttcgcatgcataagtgaaactcgaaattcagctgtcagccaacatttccaaaaaaaaaaaaggaagtttatgtagcactaattgcatcgtagtgcatcacttcgtaagaaagaaaagcttcctaatctatcagaagttcagaacaacttcaacaaaagacttcctaatctatcataatggctttcactttcacctgttaaatttcagaaatctggagataacaagttaaacgttagatacatcttattgatcataacaagggagtgacatgagaaattaaccatttcttcttgctactataaaaacacgtattaacagaaataatagtgtactcccatatacctctttgcagtttcatatagagaaaagtataattgcatgtttattttccatgtgcatttttttgttgcatcaaaaccttaaggcaggatagcttgataaagaaacattaatcattgtagacagtaactcaagatgccaacaaaactaaaggtttcatttaggtttacaggacgaatttgaagcttgtgtacctccctatcatgagaaaaaaaatacgaaggttgagatgtatacgaagaaattatagtcatctatcacaagaaggatgattttatgatgtatataggggtatttatatctctcgttgcaacaaaaaataactacttattacacaaagataaaatacgtccttatgtctcacaaggatgggaaatactcccatcaagtcatacgaggtagtttaaatcatactgtaacaagtatgtacagctaatagaaggtcttgagtaaaatgcaatatcaatattttttagcatactcctgcatagtgaatctaaactgcaactacaagagcactgtagataggaatattttactgtttgaaacctactccctccgtcccataaaaaacgaatctaggaccgcacatccggtattaggttggttttttatgggatggagtgagtaagtagtagtcattttgtaaacaagcctgtctcaaatgacaacagggacatataggcagagaaagtagccagccataaatgcaatttccttaacacaataaagaatgaaatagttggtggttcaaaaaaggataactagagaaagtaccagatatatattccacaaaccatttccacagggtagaaaaacttacaatatgatcacttgacaagaaacaggaagcaatttacttagtagctcataatgacaacaagactaccgactttatttaggcttgcatcctagattcctagactaccgactcataatttactgtttgaagtttgtattcagtgataactggcagataaaaccacagctacaacctgtacagctccaaggtctatagtatgacatagtagccatagttatttgtgtactgttttatggtgaggtgaatttaatttaaagtgcaccacagtaatggtcagcaaaagtaactagtcaggactcatgtttccttaacataggaaaggatcaaatatatcatctatactttgttaaaagggaatagtggtggtggttctgccaccacccccatcaaactcccaaccttttttgagaggaaaaagaacaggtgaggctagagggctcacatgtcaaccacccccaccaactctctacattttggaaagaaaaatgacaatgtagggtcaaagggtccatatatcagtaacaaaatatatgtggcaactaagagatgatatgtgcaaagaatgttagtaataacgggttgtctatactcctttaaaagagtgtagtactcctttaaaagagagttgtcatggtggtgattctgccaccacccccaccaccaactcctaccttttctggagaagaaaaaggagaggtggggctagagggtccacatgtcaaccacccccaccaactctctactttttggaaagaaaaaggataatgtggggccaaagggtccacatatccgtagcaaatatatgcagcaattaaaagattatatatgtagaaaatgatggtaataacgggttaatgataattttctttaattaaaattttgttgcaatgcacgggccatatgctagttagacaagaatagcagaataaagtatcaagcgaacttggttctttacctcaattcttcgtgtccttatctgcacgaaccaatatgtctgacaaggttttgcttttgatgttgctcttggtatttggagttcctacagtgagggagttaaacaatacaacataagaaatggaactgtacttttgtgtacattcgtatacagtatgcaagagcatagcatcttgtctctgacacattcaacagataaaccatgtttatacactgaaacatgttcagctcagttggctgtaaatgcataattttccatcaccatttagctccacattgggctagtgcagatcaataacgtactcatcaacaaacagaataaaatggctatgcatgttgacagaaatttaggtaagtttcaagcaatttgcaatgggtatttctgtttttttttggatgtttcaacatgcctacctaaattcccagattacagcaactaattccaccattcaatgaacaactgaaattggaaatgacttatgacacaatactaatatcaaaaaacatccaactatatggtttattttcgaatgacatgtaagacagccttttcccagattgctcccaaaaggagtctaacaatctgatgccaacttatgggttcatgtttggaatctctactcggctaattttaagttcaatatgcatcagtaaacccaaagttgaggactcggccattgttttccataatgagaaattggaatcacagctccaattgcataataatacatcacctcaccgaaaagagaaaaatcctaatccatcagaacagcttacacttgttaaattttagaaacctagaaagcgaaagttaagcagtgggaacgtgcgaggggagtaagtgatatgaaatgaaccaatatttatttattcatcaggaacacaagcaaacaaaaacaatattatagtcccatatacatgtttgttttttactcttctaatagaaaaaataatgtgattatatttttcttctacatgccacttacatcattacatcaaaaccgtatgacaggatcattgtcaagaagcaggaagcaacatagacaatgtctcaagataataacaaggcaatttattttggttccagtctagataagttttcctggaccaatgtgaaattttgcattaagccactcctggcagttcgtaccgtccgtacaataattctaaagtaaatgcatgtaagttctagagtaaaatgtgaaagtgataacttatagagttttagtatagtctattagtcttgcatagtgaattctaaactgcaacaaaaaagactgcgaaatataattgcattaagatatctctcctgacctacaataaatcttcacaaatgatgatacagaatttatgcatgaatcattaacataggaaaaaaaaaacagattcaaaagagcataggttagttgactggacatacataatttttttcatctatcaccccattgaattaccaatccgcacaacacactcatctagaaacagaatcagatagctagcaggcacatcgattgaaatttaagtggctttcagacgcttgacaattagcatttgcaaaaatcccatagattattcatgaaacaaatcatcctactataaacaggcctccaaccacacggttaaatttcaaggacaaatcagaacatatgagcgtaacaataaaaatctgcatattcacatcgtatggaaaacatgcatctcaaagaaagcatgagaaagaacctgcagaaggtatccggtatgatggaagccacggtgggagaacacacggagttaggagagcggtgagacatgagcgagtataactctcatcacctaacagagaacgcccaagcaccttacccctctccatgtcaacggagatacattgcacgccgattttgaggtacattatgctagcattcagtgggtcaatgacaccaatctgtggcgtgtcctcctgctgcaatgggagtcccccatccacccggagccggctgagcgccacccggtgctccagcgtccagctgctgccattgtcgtcaagggcaaaggagctgagcacgaatggctccttctgggacgcctcagcgtagcgcagcctcccctcgctgacgcccaagcggcggtacctgactaggcccctccgcttctcatccttcacgggctccatcacactgccccctggcagctcgacaaagcgcagctccggttggtcgctgagcggatcgacggaaatggcgccccagctcacgtcgacccaccaaatacggccggcgaaggtcaccggatcgtgatccacgaacaatggccgctcgagcgggagcggggacgggaaaaccaccggctcgtcccattcccccttttgcgagagaaaccgccgaacggcgaaggaccactcatcgttgtcggcggcggcggcgtttgagctgaacgaagcgagagcgtacctatccggcggcccgttggggcggtcagattgggtgaggatgccgacgagttgccacttcaaggtcttcttcgtcccgtcgatgtccgggacgcggaacagctcgccgctgagagggttgcagacgaagcgcgtgacgtcgggcttcagttgcttgccgtcgagcggtatcgggccgcgcgcaccggcggcgggggccgcggtgaggccgtccgtgaagtcgaggacgaggaggccgtcgccgctggaggcgcgggcgtgggaactgcaggcgcgcatcatgccgggggggcagggctgcggttcgacgaggtgctcggggacgaggatgtgggaggcgcacggtggctcggcgagctggaacgcggcgcgcggcgacgacgggggcatgagcaggcccgtgtggtggatcatcccccaccgagggcgcgaggccgaggcgccggcgccggcggccgtggagagggcgcgcgccacgggcgccgcggcggagcgggtgctgcatttcggagtcggaggcggcggagcgaagcagaggggggaatcgaggagagggttttgctgcctttgcgttgcggcgtggagggagagtcttttaaccccctgtaccattaagtaagttgaagcttacgcgtgtgccgtaaaaaaattgagagttacctgtccatgacacaaactttcgtttacccgtgtaccattccatccatgttagagaatgagctctgacatgtgggactcacgtatgaaaatgactaaattgcccctgaagcattttcatctctactcctcctctcccgtgcgcctcactcgaaccctagcctagccgccgcctctatagccgccgccgccgccgccgccggtcgtcgccgtcgccggcacgccgccgcctttgcctcgcctcgccggcatgccgccgccgccgccgccgcctcgcctcgtctcgcgtcgcctcgccagatccagcctgctcggcgccggcagcgtggtgacggcggcggcgggcatcggcgccgccatcagggggctcgacgacggcgttctggacggtgccgacgggtggttccagaagatcgtgtcgctgatgccgcaccggccgatgtccatcggcggctcgccgctgtacgccgtgtacgacaccgacttcgggctgggccagccgacgaaggtggagctcctgtccatcgacaagacgcccggcacggtgtccatggcgcggcatcgagatcggcgtggcgctgccggagtccgacatggcgcggttcagctcatgcttcgccgacggactgaagcagctgtgaggacgaacagcttgttgcatttcttgctttcttgctgctacatattgttgcagagttcagagtttgttcagtttgggtgtgattctgtaatgctagcagttggtgatctttttatgtgtggacttagtgtgttgaattactactttaaatgttggtgatatgaacttgttgctatggatgcaagttatgtcatgaatgttgatgctatgaccaagtttagttgcttgaacgttgatcctataaccaagtattattcctgctttttctaattttttttgcattttttcttatttatccacgcatttttttccttatccttttacgaattttccttatgttttcatatgtttgtatttatttatgatttttaaaatttatttacgaattttttttcttatttattccctgttttctatttatttccatcattttaaaatttatttacgaatttttccatatttatttcctgttttaactttattttcattttttaaaaatgttcactttatttcattttcttcaatctacatttcagcctctatgtggtgtgtgagccgatttctcttccaaatgtttcatccaaagtggctgaaatagagcaagggcaaaatagaccttttaaacctccgttagtctccgttagtgctgattccatccaaagtggcgcacaggtaaacgaaaatttgtgtcatggcatataaatgactcaaaacttttttatggcacatgcgtacctccaactttcttaatggcataggggtaaaacactcgaggaaggaagtggagaagccgaggcggtcggtgaggtccacgagagctcggttcacgcggggggagcggtgccgtgttttgaggtaatgaggtagggcccgcatgtcatgtcagggtggtgacggtgtcttgctcctcttccggcttccgcactgcttgggaaaaaaattgaaaaaatatattttttatcgcatttgtaagaaaatactggtttataaactttcatcacacagttcaagacattcgatttaaatttgaaaactttcatcttaaaatttaaaacattttttaaaaattttcaacttaaattggatgtgaaaattttaatttataaaacaaaaaaaaaatcgtgaagaaaatcacgcttgcggcgagaaaaaggtaactaatcacgggagaaaaaaagagcaacagagaaaaaaagataaaaagggaattagtgtttgcgccgccaacgcctacgcgctaattagcgtttcggtaataagcagccttatggcagatgctcattggtctccgtgcctgatgcagcaacgggggttcccgatctttcgatgagaggaggataaacttcgatttggggaaggatacgacgttggctgtccgactacaactaccacaggggtgctgcgccgtagcaactggtacaccgactccacgttgttgctgttcttgtcgtgccaagaacaaccttgaacctgcaagcaatcgaagaacaagcaagaaacaagttgacaaggaaacagctcacggcacttgtcaaatgatgaaacttaaacaaaccaaaatggggttctaaatacaagtatccgggtggtctagccgacacacgcgagtacaaggaagtagctgcagctaaacttacatcaaaacaaaacccaaagtgcaaaatggtggctgctaggagtgtatataggtggaggaatgaccaggagaggaggtgggagcaaaccctaggttttgtggacccctaatgggctgtaatgatacaaggcccaagcccaagtttctgatgtaaagaactattttcgtcattctgagtagcctgggtcaaagttgatggtgaggccacacatagctgacagtagacgacgagatctttccaacaagtactcatttgccccgtttgccctccggagtgaagagcattgacttcatcaaatcagcgctgctagtgctgcttgcgatttggttcctctcccatattcctaacaacaagtagatcacaacaaccatttagtagcacctaattctgagaagaacttgtatgattagctaggaatgactttacctgataattaagttcacgagctcgagctctagtcattggtccttgctgtgcaataggcgtggttgtatcgttggaagggatgtcctcatcagtgcctaatcccatcatatgctcccgccaaaacggtgtttatgtgcttagttattttatgaaaaaaaataaaattatgcgctagagttaggatcgttttttacggatcctttagtcatatgactttgtcattaacatataacctaataaattctgaactaatatggagaaactcaatccgatggttttgtgcattttcagtaatggaatccgaagaaattgagcgagcatagaagattacgatttaatacaatttaccgtcgcatcgacctgtttcatgtgaaaggatgagcgtgttatcttgcaataaacacatcattataaacaaaaaatggcgccgagaactcctgccccgtggttggcacttggcacttggcaagaaagaaaggaacacgaaccaagagagaggccaagaaaggaacacgaacacagtgccggggagctcggttgccgaaggtaatggcgtcggttcgccggagatgaagaggcgatgattcaaggcgattaaaggcatgattgatggggaaaacatgggggaatttatgaggaggtgaagggtaatcgattttcgtaatcaatcggaatggaaaacaagcggggaggcggatcgaatcggtggcagcgctagggttttgtggccggggagaggaacgggcagcgtctggaggtggaagacgacgaccgcttgcggcggggacgggatgggccggctgggctgtaccccgctgcagccaccaccctcctcctctctcccgcctcatctgccggcctctgcacccgcctctcgcctcgcccagaatgatagaagaggagaaagaggaagggtgatgacgtggatcactcttacatatagtgcctacgtgggtcccacgctgactcagtcaccacgtcgaacaaaacctgttgcaatactgatctaggacctattgtgatcggttttaattagttaagggataccagatatctggttttgtggtttgagggcgttttttaagtcgatgacaagtcgagtgacctttggtgtactttttccaactgaaagatacttccagctgacagatgggttcacatcgataaattacagggaaggctcatacatcaatcgattcataggcccaaggcccaagaaggaccaagttgggagtggattctttcctgccaatgggaagagggttgggcgggaacctctcgcaccttttctcttccctcaattccgacgaaacccccccatttccccaaccccaactccatctcccttggagaaggaaccaaccaacgctaactctcgcctactgccgctgatgcctcctaagcgcaagtctccggcggccgggtcaccgaggaagacacggagcatggccgtcgggaagcagtgggccgaggctccggcaaaggcggccaaaaaggaggcggcagcacccgagtagaaggggaggaagagggccaggaaagaagatgcagaggtggcggctgcggattacagcgctgtggccagcaacgggaagcgcatcgtcgtggagtcatggtaagtgcccccacgctcggggtgaggggattacttgttcatccttgggatttaatggcgttctgctggggctaacaggctaatggttggttgataacctaaaaggtgaagcccccttttacatacatactatggatggtcttctgtgcattcttcagattttgatacccgccgaagccataaggaaatcattttctaacgatgtcagttcagaagaaaaagaaaaagaacaatgttctctctgtacctaagttcaaatagttgctaggggattatagtattttggctgtagtaggtttacttacttcttcttgcggcttctagttttggtgtatatatgaagccattttttgtgattatctgtcaagtgctttgctatctataggtttccatttctttttggggggtcatatactctgcttccttccttgataattgagtgttttctgctgttttctgtacgttcaattaatactagttacttaaacttcaataacggactttagtttttgtgaattatcactggaagtgttaacaatggttttgtcaatagataccatcgacatagaacccaaacccagaattccttactgtatctctaatcagtatgtaagaccaccttcttttgtattttacatataagaatgatgattgaccatacgcgcaatagatctgttatcgaacagacttataatttgcttttgcacattggacaaaatgttctccttgcttagctgaataattctagataactcgtacatcattcctttatcttgacatatctaaaaaagtcctattgcattaaatgaattattggtagcaattcttattgaattttcttttatccttgcttctttgtacgattctctagcactcaatgcagacagttcaagatcagagctgtgaaggtaaaggaggatctggaaagttttgttcctggggtatctgtggtaatcaaccctgaaaaagtatctacatggtgttaaaccgaagtaattgtttttttttgcaacaatcaaccctaaaataacttttcggttatctcactggcttccttcgttgtcatcattgttttcctcctaattctcagccacgacgtggttgcctggagattcgtgaggaaggtggtgaagtgttcatatcactgctggtaatcttgtttactacttggtacctgaatcataagggacttttcttagctttctacatctgttgtttgctagctagttattcttttggttttcttttaacttgcattggcagttcttttcagtgatgatatattaactcacctatgtacttaaatcacttgcattccaattagaacatcgaatctaagagaccattctatataatcattactatatttgctaggaattagggtgcatcatgatttgtgtctgattgagcacactccaatttgtgtgcagaacatgccaagacctttcacagcgatgaagaagctcgacatggatgaggtcatcaaggacatagcaaaataaaatctcctgaatcaaatcaacaactcatggggtgaaaatctttaggtggcttataactagtagtaagcctccaatcccacctttctgttggatcttcatcttgaaatgttattggatggcactccgtgttgcatacccatggtgtgttgattcactggcacttcctgtgttaaatgtatctaaagattcctgcatactactcgtaatatctaatattcagttacctagtgatttgatgtcatatgttctgttctagccacaagtttgaatttatgtacagttcccccctcacttaatataaaaccagcaagagctggcttaggtttcaaaaaaaaaagtttgaattgcagctgtttttgataggcaatgaggctaccttcttaggtctttcctaacttttctcaatataatagtcaatattcaggggagaggctaagtacaaaattaacaatgtgttaagtcactgcagtcctcaaatcaaataatgttggctcaaatagtaatatatttgtttctttcagtacattgcaggaagtagtagcatatgtcaacaatacaaatcacaaattcacagtcccatctcatgtacagagctgtagagccttccttatgaatgatagactaggcattatctaaaaaatgaatgttagactagagcaattttacagtctttaagaagataccatgaggtaccactttttctattgtaaattaaatactatgaggcaccaaattttacattaaattttttttacctcatggtatctcttcaaggactgtaaaattgctcgttaggctaggagatttgctgacagttgtggaccgcaacaatttgtagcatgcattgactgttgtctctagcaatgtcttcgacaatggatggctgccagataccacttgggtgccttgagctatcgaagtatttgtttcctactcctcatcctctgaagctgtccattaagtgaaacggagacagtagaaaggctcatcatgcagttgaaagatggaacgaatatgggtaaaaagaaagaaaaaatatggacagaaatcagaagaagaataagcagccgagctaatttactccagtactggaagaagagttgtcaccgatgtttgtctcaaaactgtagggttctcttgtgtacaacatgtgccacttcctttcatcgtctctttgatcagcataggccttgatatgctggacatggctcaatttgccccactcaggaccagattctccaagggctatggatgtgagcagctctaagttgcagtccagcaccaggtgcataggactcacatcctgcaagcctgcaggtatcttgggagttgttccatgtcgtagtcctccagctccagcccccgtagctcaggcaccccctccaatgccctcatcttcgggcagccgacaatgatgagcttctacaatttggggagagatgtgaccctctccaggtcagggttatcttgcagctcaagcttgacaagagaagcaaagctctctatagagctgagttgctggatttatataggtccatgcttgttaaagctatcgcttccgaggaaaggccaggaggaaggcttctcaatttgcagttttcgagcgtaagctcttccaatgcaggcattgtctgcacattatttggttgctgatcccactcccactcccactcctactcctccatgcctattagattcatctccttcaaactagggtatacttgggcaccatggtggtgttggctggatgatggtcgtatagtaatgaatttagggccaacacgcttgattgcaggggcatgcatgacctgaaaaaatttcaggcatgggaggtggcagaggctgttaggcagttgggtgcagcaggctaggtcctgcatcatcacaatcatcagtctctcaaatgcacttgctcctctagacatcatccaccttggtagccgttgtccaaaatagccattgatctcaatactctcaatgcaccatggtggggcaagctcatccaacacctcctcgatttgtcaaggttcttcctcggagacacttttctcatcttttactaacccatcttcaccaagtctactgctacagtctaatctcaagctaagtacataagatgcaacttcaccaagcctagcctctgtagccaaggagggagcaggtacattatctagctttcttagtgaaagtctccgtagctgagcgagaggccccagctcttgtaaactacaccactcaccatctgcttgtgcaggaaacccgcataaatacctcaaatttgtcaatccacagaactgtcggggtatgccatttatgcttacacctaaaaggtcaagatgcctaagccgccctagctttacaaggcttggatgcctaagccgccctagctttacaaggctattaggaagcctgactaagttttcaaactcaatctcaaggtactgcaataatttgagtttgttgatgttccgtagtagtctagctaggtcgctgcattttagaaagatatacctcaaatgtttgagatggtgcaaggattcagccaaggaagcagtacagttggcgtcttctatgtgcataattcttaggcttgaaaaattaatcaacaaatccccatggttaatcttgagctcaccaattactattagtgttctaagtgatccctggccttgtataagtctccagtcaaattcatcatttggttgcaaatcattggtttctatagacagcctaagaaacttttgtgtttgaagtgcacctttgcctctttcatctaaagttgaaactacaaatgcttcatctctagatagatgttgagaaaatgagcgaacaacatcatgcatgctgctaacactgattagcatattcttcatctggctctattaggtttctgtaaattaactcttgatattacccttctcctaatttttctaaatcatcggtgtccccgtgaagaaatcattcgcttatccacatgccaagactgtgacattgtagaatactacattttttgggaggagggagcagtgcagaaagcattgcttcaaacaaggatgcaaatcttgatagttcaggtacaccgcatcgtctaataaagcaggaggtattgaccacataaaatcttgcagaacttgctcccaatcagatctccgtttctccctcctacgcaacagccctcccattacttttacagcaagtggtaatccgccacatttctttattatttccattccgatgtcctttagtgtgtcatcaatttcaacctcctccatatcatcacttgatgctacctgaacatgcatgcatgcatgaattcagattaattttgagcttactagctagcaattagtacaagattacatatatatgctggtaataattaatatgggtagagctatgacctgtttcttgagcagtaaccatgcatattgagggtacagtttgtcgacgtggtggaaaggttgcatggcttccatccgttgggtgacttcgtcatggcgggtggtgatgaggaggtggctgccggcggcgccatggctgaagggtgccttgagtaaattgtcccaagatctttcactccacacgtcatcgagcaccaagaagaacctcttgtccctgatggcgtcgacgagcgctagcacgagcagtgacttgttgctctctcgaccatcgctggcgccgccgacagacttgatggccgtcctcaggaggttcacctcgttcacgtcttgtgtcacgctgagccatatcttcttgtcggacgcttccttgatggcctcgtcgttgaacaccttctttcgccagttttgtcttgctgatcccgccggtgcccaccatggcaaccaccatcaccgcgtcctgcttcttgtgcttgccatcggtgagtctcctcaccagcgccctggtgtcctccttgatcttctctccgaccacggccgactgctccaacaccgggtccgtcctgcggttggcgacgctgaaccgtcgaggcgccaccatgtcttcgtaggactccagcttgaggaagctgaaggtggctgcgctcttgcagatggcgtcgagcctggcattgagcgccttgatgcggctgccaatgtcgtgggcgaagagtggattacggaggcagaagagcagcggtagcccacagggtcggaggaggatgagctaccacccccgcgctgcatggccttgaggtggcagaggtcaaggatgtcggtggcgtcgtacatggtgtgcttgagcttcgtaacccagccctggacactcaggtcggtgatgcgtcggcgatcggcgtcggcgagatagtccttgaggatgcgcagcttgtcgtggagggtggcgatctcgagggagacgccgaagaggaggttgagctcgtccttggccacctgcttgagcaggttgccaacgtaggacgcgaacacatccagaacaatggccatatgtgaatgtgaatgatcgacacaaacacacattgacactaacggagggcagattggttgatgaggcagtcagtacccgcacggacgtgtatatagctaccaacatacattttttcctttttttttttgaaataaagtttatccctgccttgccttgctcttcatcctatgcttagcttgatgcttctgcttcaatctttaatttgttgttagctcttttttcttttatttttttggtgagattgtgatgcaaggaagggcttattacggggtctatctttttccttgtcatcatttccttcatttgcttttttctaccctcttcttgagggtacataaatattggtcgttgggtgtgattgagtacaagataatgaaacctgagtatgccggtattaaaaccttgttagtgggtgcatttttaagtttagaaaaaagagtcacttaggatatttctgcacatcagcttgccaccccagcaaaatgataagtgcgtaaataacctcctaagatcttcctacatgcgtaaaattatgcatatctttgaaccatgcaaatcttcatacacatcaatattgtcgaatcacctatcccgttggattaacaaactactactcatcatgtcagattcaacggcttactgatccacaggctatagtggtgtgtttggcactacttgtttgtaactcattctcaaaacgaggtagtagctcattagcgcataattaattatatatatatgattaattaagtaaatataaaagaattgaaaaatgtagtaatacgatcttttaaaacaactttaatttagaaaaaatttcaagttcaggaagtatgcacatggaaaacaatataacagaggtcagcaaagtgtcctgaacacaccctaaccagaggtttggaaagcactactctttaacatcctccaattctaacaacacatgatttgttgttgaaaaaagtctttctgactctcatggcttaataattgagtttatctgtagctagcacattcgacaatatttaggagaaaaactttttcactttaattacatgtgtaactagggtgtagatttgttttgaacgtaaaacccacacttgcccagtggtggagagggctcgccaaagaggcagagcttgcgcgattgaatcccacgctgtcgattttattcccaatctccacccgcacgaattttatacatagcccaaactttaagtaccttcgcactggtaccttctatcttaatccgttggatttagagcaatcaatggctctaatatatcacatgcactgtagaaagtctttaatttttttaaacaaagtttatccttgccttgctcttcattctgcgcttagcttgatggttttgtttcaatctttaattgttggcttttcttttctttttttttgcgtgattgcgaggcaaggaagggattattgagggatctttatcattattttcttcatttgttttcttcttgcctcttcttttcctactctatgggcattcagctatgcatcctagtttacatcctccctcagttatcaaaacgagatcaattttcatttagtgactaacgtggcatccatgttagtaccaacatgaacataataataataataataataataataataataataataataataataataataataataataataagtggatccacatgtcatcccttctctctctcgtcccctcttctttctatctctttttcctagttggcggaccttcgacaatggctcctagctttggtggagccatgggagccctgagttgttctcctctccacctaccacacgtctgtcaccaatgctgatggccgtcttgcctccattgaaggagatcctcgccatggttgtcctcgcggctggagccacctcctcgctacctcttctctgtgggaagagcaagtgttgtggcattgggggacgtgggctattgtcgggccaccgttggggagtagggagaggggttgaggagctctcctcctcgacctccctcttctccctctatttctttggcaacctcacatgtttctcctcttcttctatctctctttctctcttccctatagctctctctagggcatgtgcctgtgcacaggtcatctgtgcatatgtaccaatgtggtgatgcctccacatgcaaacctaattcgtctctcacgctgctactagtttctcaaccaccttgacggtggggctgtcactatccctaatttcagcagtctgcgttgcttcagtttcacatcaacaagaaagatgtggaggcggcgtcatgctctccttcgctgctcaattcttcggtggcatggtctgctagtgggattggatgctactgggccaccacgtctgatggcaagaaagcaaagacgatgactctgtaggtattgtagatttctggaatctgttgtgtctaggctagtctctaagtgctttcatcatgtagtatatgccaaatcgctgtcttttttgaggaattagtttaggtctgttgtgttcatctccatttatagatactatgtgtctgaaatattttagcatatgctgcatttaaatcaatttgaacaacaatacatatttgcaaccggactaaattgacacttacggcaatagctaaacaacatccaaggcaacaacataatagaaaaccatcactagcacattttggcagaaaaccatcactagcacattttggccctcaataatttaggtaataaaaaagttgtattttcctctaattacaacattcttctaactagacttgtcggaaataaccaatttgccttacaacgaatctagtactccacaataatgtttatttggacaatttctttgagataccattctatgtaatgattacaatacttctaggaattagggcacatcatgattttgtttttgattgaacacactccaatttgtgtgcagaacatgccatgacctttcaaggtgatgaagaagcttgacatggatgaggtcttcaaggagatagcaaaaaaaatctcttgaatccaatcagtgactcatggatgtgtgactccattatgaaaatcttcagttggaagcctgaaaaacccacctttttgttggagcattattatctcgaattattgaatgacactctatgtcacatgcccatggcttgttaatttactaccctttcctatgttcaatgtagttaattaaagacattccaaattgatgacagtataacaatgaaaaagctttggtatctgatgagcccctttgtgttacctgcgtacttctctcaagatttggttgacctctgatcttttgatatagttttgttttgcccacaagtttgaactacaattgttcttgataggtagtgaggctagctccttgtcgttgtgagctctcaaagtatttttgtactattcctcatcatcccctgattctgtgaatgaagcaacccaaatgagaaaatgaaatgaacatgttgaaaggtggacagaacatgggcaaagaaattaatgcaaaagaatatatagatataaattagaaagaagcatatgtgttaaagtgttgatttacctccagaactagaagaagagctgatcccaatatttgtctcgaatctatagggatctctcgtgtacaacacatgccacctccgttcattgtctccttggtcagcataggccttcacatgctggacacggctcaacttgctccactcaggaccggattctcctgttgatatggctgtgagcatctccaagctgcagtctagcaccagatgcctaggactcacactctgcagcaggtatcctggaagctcttccatatctaagtccttgagctctagcctcagcagctcaggaaccccctccaatatcctcatcttcaggcagccgtcaatgacgagcttctgtaacttgttgagggaagtgatactctccaggttggggttatcatacacctcaagcttgacaagagaagcaaagctctccacagaattgagttgttggatgttacgtaggtacaagcttgtcaaggccgttgcttgtgaggaaaggccaggaggaaggcgtctcagcttgcagttttcgatcacaagctcctccaatgcaggcattgcatgcacactatttagttgttgatcccactcccactcctcccactccaccatgcctatcagattcatcctcttcagcctcgggaaggcatgagcttggcggagttggctcgatgatggtagtatagttaggaattcagggccaacacgcttggttgcaggggcatgggtgagctgaaagtaatacagagacggaagtcggcagaggccatctgggagttggttgcagcaagcgaggtcatccatgatcaccatcgacaacctctcatatgcacctgctactcttgacatcatccaccttggtagctgctctccaaaatggccactaatctcaatgctctctatgcacagtggcggggtaagcgcattgaacacctcctcgatttgccgctgctcttccgtggggacaccattctcgtcttgtacaaaaccatcttcaccaagtctactactacattctaacatcaagtagctaaggtgggccttctcaccaagcctagcctttgcagcgaacgagatagcaggtacattctctaggttacttagtccaagaacccagagctgagcaagaggccccagctcttgcaagctacactaatcaccatctacttgggttggaaaaccatataaagtcctcaagcttgttaggccacaaaaccctcgaggtatactagttatacttgtgccactaaggtcaagatacctcaattgtcctagctttacaatgctattaggaagcctgtccaaattctcacatacaaggccaaggtactgcaagaatctcatcttgccaatgttttctggcaatctagttatgtcaccacattttagggagatgtacctcaagtgtttgagttgatgcaatgattcaaccaatgtggaagtacagttggcattttctatgtgtagagtccttaggcttgaaagagtaatcaatgaatcccctgggttaatcttaagctcaccaactagtattagtgttctaagtgatttttgcccttgtataattttccacccaaattcatcattcggttgcaaatcatctgtttctatagacaacctgagaaatttatgtgatttaagtgcacccctgcctatttcatctctagatgaaattacaagtgcttcatctctagccagatgttgagcaaatgagcgaacaacatcatgcatggtgctaacccattctccagcgtactccgcatttggctctattaagtttctgtaaattaactctttatagcactcttctcctaattgttctaaatcatcagtttccccatgaagaaatccttcacttatccacatgctagtaactgtgtcaatgaagaaatccacatttttggggaggagggagtagtgcagaaagcactgcttcagacaagggtgcaaatcttgatagctcaagtatatagtatagtttagctcatcaggcatttgaggtactgaccatatagaatcatgcaaaattttctcccaatctgctcgccgtctctccttttggcacaagagtccccccattactttgacagcaagaggcaatccaccacatttgtctattatctccattccgatgtccttgagcgtctcatcaatctcaacgtcctccatctcacttgaaactacctgaaaattatttcatatacatgcatgcatttagaacaattagtttagcaaatggtactctattctagtctatatacatacaagttaatatgttggcaatgtctttttgttgttagattattttttttcggggatttttgttgttagaattaattattatggccaagaagataggtgtcacagtgtttcttatggcagagatagatgagggagggatgtaaaacatttagtatattgtgtaaatctgacctgtttcttgagcagtgaccatgcatctggagggcacagtttgtcgacgtggtggaaggggtgcatggcttgcataccccgggcgacggcgtcatggcgggtggtgacgaggacacgactgccggcggcgccatggctgaagggcaccttgagcaggccgctccatgctctgtcgctccacacgtcgtcgagcaccaggaagaacctcttgtccctgatggcgtccacgagtgtgggcaccagcagtgacttgttgctctctcgaccatcgctggcaccgccgacagagacggacctaatggccatcctaaggagctccacctcgttcacgtcttgtgtcacgctcaaccatatctttttgtcgaacgcttccttgatggcctcgtcattgaacacctttttcgccagcgtcgtcttgccgatcccgccggtgcccaccacggcgaccaccaccactgcattctgcttcttgttcttgccgttggtgagcatcttcaccagtgtcctggtatcctcctcgatcttctctccgaccacagccgaccgctccagcaccgggtccgtcttgcggtcggcggcactaggtcggcgaggcgccgccatgtcctcgtaggcctccagcttgaggaagctgaaggcggcggcgctcttgcagatggcgtcgagcctggcgttgagcgccttgatgcggctaccaatgtcgtgggcgaagagcggattgcggagacagaagagcagcgagtccaggcagctgatgttgacgggaggtgcggatgagccgacgccgccacgctgcatggccttgaggtggcaaaggtcgaggatgtcggtgacgtcgtacatgacgtccttgagcttcctgacccagccctggacgctctggtcggtgatgcggcggcgctcggcgtcggcgaggtagtccttgaggctgttgagcctttcgtggaggctggcgatctcgctggagacgccgagcaggagggtgagctcgtcctgggccacctgcttgagcaggtcgccgacgtaggacgcgaaggcatccaggacgatggccatagctagctagttgatgaactgggaggcctgatcgatcagcacggcagtgtgggtgtagatagctagcctcacgcgcgtacgtgtatttatcttctaacggccatttagtttttagttttttttttaagaaagatttatcccttccttaccttgctgtgagtgctatgcctagcttgatgcttctgcttcaatagcttttcctttattttcttttcacttttttatgtgggattgcgtgggaaggaaaggattactgagggatctttttccttgtcatcattttcatcatttgctttcttttccccttttattttcctagcatctgtgggctcccggtttacaattctgtcctccctcaattattaaaacaagatcaatttatctccctcaattcgatgatttgccggtcggtagctgaacgggtcgacagagaccacgccccagcttgtattgacccaccatagccggccggcgaaggccagcaccgcgttatgcggcttattcccagccgaatcagcagcggatctatcataggggctagaggatctcgagccttcactaccagcaatataaccataagaaccctggtaaaaccatcactaaaattttacgtcatatatatttattcgattttgctatatatttgtcgataaattttctcctaaaaatttgacagatgtaattacagtacaatcgtagtgtaattacactgtaactatagtgtaacttgtatgtaactttcaaaaatctctccgtaatatgttatttcgataaaatagaggttgtggaaacaaatccttacatatgtatgtgctgtgattttatttttcttcctcaccaaaacaaatcttgtaatagatctaaagattcaaaattacatgaaacttatatacaagttacattgtagttacatgcaagttatagtgtaattacatataagttacagtgtaattacactacgattgtactataattacatctgtcaaatttttagtagaaaatttgttgacaaatgtataggtggtcccaatgaatatagagagaggcttgggcctacatgtcactgggatagaggaaaagaagggaggtgggcagcatggatatgtgcgagtcatgtggatcgatccatatcttgcgccctggttgttaatttctgatcaaaggagcagcacatcttcttatagtatttccttggtgtgacagcggagagcctattctctctaacctaatctcctccataattttgagtgattagcagcagcagcagctggtgatctgcgatcttctcgtccttcgtcatccccgtgctgatctttctaggtctcaacttcgttgtctcggctcgccacgaacagcggacttcgtcgtgcttcactatacgtctctcaacggttttgagtaccgttgatttgtgagaaaatcggtccatctttctacgtgatattattgtttgagacttactaattgctagtagtaaattaattcttgctagttgttagcctgcatatgtggagtaaattgagagccatagctaatagcttgacgtgtttgacgttgccatgtcaaattacgttgcatcttttgtgatcatgctactagcatatatttccatgtgggagttcttaattcttgtttctacctttccatttagtttaggaattaatctcatggttaaaatatgtctcctagcactatgctttcaacattgggcgagctcgattgacgcgcgctgtgccgaagaaagcgaagattcgcctatcttggtgtattgtatcatcgcccacggaggctgcgatgcggccgtacagaggccgcggcggaggcggccagagatgcgacactgaagcacaatcttggtgagggtggggttctcactctctttcctcggtccttccaacagagaggtgcacctagcgtcgtggcatgctctattgggattggttcacgcagtgaagtatgtacggtgtcacacagttaataataactactaatactttcaccttttatttaacttttccttaaaaacctactagtactactggtttaactaccggaagttttctttgaaaatcttacttactactttcctataaattattttaccaaggcacttcctccgaaaattctttgcctcaggcgaccgtccgagggatcaaaatcgggcgctccccccgacgccccacatgtccccctaggccccatcatgtgtcttgctcacacctgccacgtttctcaaaaaaatatttcacctaatatactcacaatgtttcactatgtatagatctaatgttgcagtgaattaaaatattcttttgcaacaaatcacccacatattttggaaaccctctattaagctaattcgttccattttttgttccaccaaaaatattttacctagtgcacttataatgtttcactatgtatggatcaaatgttgcagtgaactgaaatattctttcgttatttgctgaaacattgtttttatataaggtgaaacaacgtccgatttaaatgattgaaacattttcgatctacttagtgaaacaattccgatatacctggtggaacatcgtgcaacatttaaaaataattcaataataagctaaaaaaattttatcgaaatatatccatatgtggtcttgttttgaagatttaattgcaacaaatttaatggtgcaatcatatcatgatttggataaataatttaagagaaaaaatagtttaaagtgtttttgcacgcatgcgtggcactgacgtcagcgcccgattttaccccctccgcatcgggcgcccgaccgggagtcgcctcccacttcctccatctcaaaataaacaaatctaaagtagaattagacgttatcaagaatgaatctggataggggttgtctaaatttgttgtttaaggcaaagtcacatcatgtcccagattggtttattttgggatggaggaagcagcaattaaacttccatgaatatttttttcggaaaaagtacgaattacccccccccccccgaactatcgcggtcagccgaattcccccctgaacccgaaaaccagacatgactcaccatgaactttcaataccggatgaattaccctccttatccaatccaaagcggttttatcctacttggcgtacgcgtggcaacccagtcaacattttctttttctaaaacatagtggggcccacctgtcatatacacacagtctcttccctcttccctctcactctctctctctctccctctctcggcgagaacggcagcccgcggtgactccagcgtcgtcgtcgtcgtggtcctacgcggtggagccatccaaggtcacatcacctccccttctccaccaccatcccgggcctcaggtgcagcgatggcggtctcgggagccacggcgtccgccatcggcaactcctcgttggcaggccagagacgacgatggtgagctcccggaggccgggcgcatccacctccgttgctgtcatgtcgtaggaatgatgaagccagagctcctcaagcgtagtggcggcggcgtcgagccacaggttggtgaggccggtgatgtggcagcctccacagctgcgggcagtaggcggaggtcatcaccatcgttgacgctggtatagctgagcaggacatcggtgagagcgcggaaggcgctgccggtggcattcaggattccgaggaccgcgctgccaagccagaggcgcatcgtgtgaaaccccccaagcaagggaggacggcggggcacgccggcaagcccctcagactcctcatctccatgggaagttcgagcgtgaacgtccccgtgacgcagccaccgccgcctctgcatccagcgccgctgcggcctccgcatccagcaccgccgcatcccactccaccggctctctatcccacgacaacgacgacgacgctggagccgccgcgggctgccgtgctcgctgggagagggagagagagagagtgagagaggggaagaggagagagatagagtatgtgacaggtgggccccaccatgttttaaaaaaagaaaatgctgactgggttgccacgcgtatgccacgtaggataaaaccactccggattggatcgaggtgggtaattcgtcccgtattgaaagttcagggtgagtcatgtctcttttcgggtttaggggggaattcagccgaccgcgatagttcgggggggggggagggtgggtaattcgtgcctttttctcttttttttctctcattatcggtgctggagtttgttccaagatgtcatctaaactccgtaaacttgcaaaactcacacccatctaaatctaaaatcttgatttaatataccaaggttcaaagtgtaattggcaagcaatagtgcataggaatcttttccttcactggtccattctagagatttattagtcaatgttgttcttttcccctctttccctactcagttcactcgtttttcgcgtgcacgcttttcaaactgctaaaggtgtatttttgtataagttttcgatatgaaagttgcttaataatgatacttaataatataaacaccacgcttacattactaaataccactctacatccatgcatccgacatagagcaaccgaatactaggacattaaacccacactaatgcacctctctggtaaactagctacacaactatatcgatgcaaatataaaataatctcggtactcagatgatataaagggaataaaataacgaagatgtataaataagaatattctattaattcagtaagtcttacaaaagaagagagaaaaactgctagagctatacccgaaatctcatgaagacttgaggactaagaaaactattctaattcctactccactagcactagaacactactaaacttaagagagctctttgatcttcttcttgagtgtgtgttggagtggagaataagctcctcattaaataagctgctaatgatagttgtgatagatggaaatgtcctaactgctcagcaaccatcattgaggagtgatctggagcgtccactccaaacccagcctgaacggctgggatgggggttcgaccgaaccatgggctggcccaatcggcccaaaatttggcaggtcgtctccctgtagactcctcactttagtgacgtggtgtcttgggctttttgaggttgtttcactggaattgtaagcccatttacccgcaagtatatttctcgacggcgttcgattgattgttcagttattttccgtcgattctcctccattttatgtagcaatctctgcaagcaaataatatccaagtacaagtggaaatagattattctaaaacaaatatgcattgcaagcatagctaggtctataacgaccgtcaataataatatgcattgcaagcatagccattgacggtcgaaattggtatataacgaccgtcaataatactctaatgattactaaattttacaaccttgtaacttaagggagtttgtatttatctacttattacaacaactaatgtttggcatacaatagaatatcaatatattgtcttacacacgctaagattaaagtagcagtttcatgtccaagtgggacgcactgagattacagtaaatctatgtttcaaaaaaaaagattacagtaaatctcctagtggatccgttgagcaatatacgatgagcatgtcgtccatcgcagaaagtgaagcaatatcctctgagagaagatcgagattgttctcaggttaaataggagcatgctgagaacttccaactttaggtcttgcctcatttgtaagattgaaatgagcttcatatcttggttagaagactttttctccttgaaatatttctgatataggagaacaaggtgttttggtatacggcaatcttaagcaacatgataattagatccacaaatgttggaatgcttgttgctgttgtcacgaggttgtggtgccttaccctttccttttcatttctttcgactattggatttacgcctgttgttgtgtttgctttttccaataagattatgttgattcagtatcatgtcctccagaaggatagtatatagagttatttctatcttctctgcccatgttgactctttttttacaaaacttcaacttagagcgaatgttatgtattttgccacaattttgaaatcttgtaggcttaagtgcttccactcataactagcattaggccagatgagttccttttgatgatcataatgttctttgagagctttccataagttgagtgggctcatctccaacatatactcatgtttgagatctttatggatatagagcctaagaaggaaaaggacagtgtttttcttccggccctcaattggatggatccccactgttgggtttctcaattgcattagaaatcccgcaagaagcaaaatttattttgatatccgaaacccaaattgggtacttactccaatcaagggcaagttcatcgaactcgttagttgccatgtccctacaatcatgactaacattactaatttacatagataaattaataaaacattatatcgaagttgtaatctcgatgcgaattgtaagacctcataatttggcatgtttcgaaaattgtaggtaataaaccttacaatctaagttagaattcgaaattaggtggcacaatgtggataatctccaagtaattagacagtggagcacatatcttaatagtgagcaagatgaacttgctgcctaaaatatggtctctaggcaaatatattttgataaacaaccgcagccaatataggactccactaccttgtgcgcatctagatttcaaataatctcatattttcaaaacatattatcagaataacacatgtggttaattattgtaagatgtagatctctttatgatgggtgagatactcgttgcctagattttgaccattgtagccaatgtgtaggactccatctgggtaatcatcttcagatgtaaaacacttaatgatgggcgagatactcgatgcctaggttatggtcgttataaccaaactagggctccatcaacatgtggtttaacgttatgaccaaactagggctccatcaacatgtggtttaattacaagtcaaaatatgtagttgaacatgcattaaattctccattaatcatgttatacataattaagagaatttgctaaattaaaataaaaaattaaaagaattttgcaaattaacagagcgagtaagtagagtgtgtctttaaataatatgcaaaaggcattttattaaaacaacaagtaaaggagggaattaataaacacatatgtcaaataacatataacattaggggtctgaacgaccattagataattgttttacaactgatgatctgcttacctaaattaactaaaatgatagggactaaaagttaaatttgctaatttaattaaaactaacattaaaagaaaagaaaagaaaacaattataggggtggtgggtcaaaatcaataggattcagcccaccatcgcagcggcgctagcccgacccaccaggctgaacaaaagaagcatggggcatgggggttgccccgcggtttatctgccaccgccgagtccaccgtcgccaccgcccgtatccatcatcgctaccccttcgagtctgggcaccccttctcccgaagttatggggctagtttaatagaagcccaaagaggtgcatatggtacccaaataaggataggatagatatgtcaaaagcaggtctgatgcccctgaccctatcttgattaaaaccgaaaaccctctctaaggtggagccaagttgaaggtgtcattcaaagaaaaaatgggaataaaaatccagaacccctttttgactctgtacccttgattccaccgccgctgtccgcacccaccatcactccagtgttcgccgctgccacgtccctcctatgtccatcggcggcttgccagccggagtttggccaacggcccccactcctcatcggagtcggagtctggtcgaacccgtatgtcattccccactctgttcgggagtgtgaggctcgaagaaccgtgaggaacgacggggaaggtgctgtggaggccgagggcaacgtgctgcaaaggctctggtgtgacagcgagacgatgacggagtgaagagtggtggctcccccgtgtgtgtggctagggttctgatccgaccgaaacattgtggcgtgggagttggggagcggcgtcggattggtggctgcatggtcggtcgaggtgatggaggtgcgatcaatggtggtagggcgatgaagagcagagccgacggcgattccatgtacagcgggagggagcactgctcaccggcgaccgtcaccactgcagtccatccatggtgagtacaaaactatacccctggacatggatgcggtgggcgccccgacgatcggcgaggtaggggctagcggaggaggaggaggaggaggaggagcgactggagttgcggcgacaacaatgcagcgccgagggtggtggcggcggccaccaaccctagtccggcgcccatcatggtgatggtggcgactcctcatcgagcgacagatgagatggcaaagacggtgagcacgatcgtggcgaggaaggccgagaacggcatcgatcattgaattgaaggtaggcataccttctttccttgttcttctcgtcaagagcaaagtgctaataaccttctgattcggcaaggataatcttagtcagacccgtaccctttttcaacatgttatcaacactttgctcttcacgagaagaggaggaaagaaagtatcccaactttcaattcgatgatcgacgccattctcagcctttctcgccactatcgcacttgctgccttcaccatctcatctgtcaatcgacgaggaggccatcaccatgacgggcgccgaactagggttggtggccgccgccaccactctcagcgtcgcattgttttcgccgcaactctggtcgctcctcctcttccactaccagcccctgccttgccggccgtcagggcaccctgccgcgtccaagtccaaggggtacagttttgtacccaccatggatggatcgcagagatgatgcccaccagtgagcaatgctccctccttctagagatggaatcgctgctggctccgctcgtctccctaccaccaccgattgcacctgcaacacctccaccaaccacgcagccgccaatttgacaccgctccccaactcccacaccaccgggtttcggtaaaccggaaccctagccgcacgcacgggggagccgccactcttcacttcatcatcatctcaccatcatgccagagccgctgcagcgcgccaccccggccttcgcgccaccattcgcgccgttcctcatggttctccgagccacacactcccgaacggagtggggaacatcgtacgggtccaaccagactccgactccgatgaggagtgggggccgtcggcctaactctggtcggcaagccgccggtgaacaagggggggacccggcggacagtggagcaacggtggatgcggacggcggcggcggtggacacgaaggggaagcagcgatgggtgcaggtggtggcggcagaggactttgccacgcctcttttgttcagcctggtgggccgggccgacgccgatgcggtggtgggccttgttgatttcggcccaacacccctttacatgtttttttttcttttctattattttcttttagtgttagttttaattaaattatcaaatttaaattttagtccctatcattttagttaattagttaagcagatcatcacttgtaaaaacaattatgcaatggtcctttagacccctgatgttatatgttatttgacatgtgtttattaataccctactttactaaatttacttgttgtcttaataaaatgccttttgtatattatttaaagacacactatacttactcgctctgttaattggcaaaattcttttaattttgtatttttaatttagcaaattctcttaattatgtataacatgattaatggagaatttaatgcattttgactacatattttgacttggaattaaaccacatgttgacattggtcacaacaatcatagcctaagcagcgagtatctcgcccatcattaattagtctacatcttaagatgattacccagatggagtcctacacattggccacaatggtcataatctaggtagcgagtatctcgcccatcacgaagtggtctacatcttacgatgattacccacatgtgccattcagtgaatatatgttttgaaaatataagattatttgaaatatggctgtgcacaaggaagttgggtcctaaacaatggttgtggtatatttatcagtatatatttgcctggagatcatgttttaggcggcaagtatatcttgcccactattaagcgatctactccacagtctaattactttgagattatccacattgtgccacctagtttcaaattctaacttagattgtaaggtctattacctacagttttcgaaacatgaaaaattatgaggtcttacattttgcattgagattacaacatcaatatcatgttttattaattaatctctataaattaataatattaatcatgattgtatggacataacaactaaagagttcgatgaactggccattgatgggagtaactggcttcggatatcaaaataaactttgcttcgcgtgggatttctaattcaattgaggaacccaacaatggggatccaccaatcgaggataccaagaaaaatactgcccttttccttcttaggctctatatccataaagatctcaaatatgagtatatgttggagacgagcccactcaacttatggaaagctctcaaagggtaaggcaccacaacctcgtggcaacagcaacaagcattccaataggtctggatctaactataatgttgcttaagattgtcgtatcccaaaacaccttgttctcctgtatcagaaatctttcaaggagaaaaagtcttctgaggaaccaagatatgaagcacatttcaatcttacaaatgaagcaagacctgaggttggaagttctcagtaggctcctattaaaccagagaacaatctcgatcttctcctagaggatattgctccactttctgcgatggacggcatgctcatcgaatattactcaatgtacccacttgcagatttactgtaatctcagtgtgtcccacttggagatgaaactactttagtctaagtgtgtgtgagacaatatattgatatcctatagtttgtcaaatattagttgaaataataagtagataaatacaaactcccttaagttgcaagtttgtaagatttactagtcattagagtttgtactattaaatctatgtaaacgtcatactatgtatttgatgttttaaattattgtacgtatgtatatatattaaataaagaattcttcactaagcaagtattctttcactatagatgtctaaggatattgctccgattggagatgaattatgtcttgtggacagtggtaccacaaattctatatacttagggagatcaaatactttcaaactcttaaaaagagagaaggcaaagttttgaccatcgctgaacgcgatactgtgatagttggctctggacgagcaactattacactcctaatgggtacaccaattacaatcgaggatgccttactgtatcctgattcaacccgtaccctactaaattatagagatatccatcaaaatgggttccacattgaaacccatatgtataaccgagaagaatttcttctcttaactaaacaaaatggatatggcaaacgcatttgcgagaaaattccatcttgcacatcgggattgtactatacgtacattaagcccgttgccatgttgcgtataaagtaatttttacaaaaatgttgatgcattccacacttggaatgatcgacttgggcaccccgatatcgggatgatgagaaaaattattggcaactctattagtcatcatttgatcactggaaaatttcccaatcctccataggattttgcattatctagatatatgccgttgatcttacatcattggtaatacacaagatattaatgaagcacgtcatcatttaaagacagaatttgagatgaagtattgggtcaaaccaaattttgcttagatctacaacttgagaatttacctactggaatccttagcaccaaggtgcatatacccataaaatattggagaaattcaatatggataagtcatatccttccaaaactgctatggtggttcaatctctagacatagagaaagatccatttagaccaaaagaacatggagagaatgttgtaggacctgattatccttatctcgctgctatcagtgcacttatgtatcctgcaaatagtacgagactggatttctattagcaagatacagcgctgctcctaccaaccgccattggacttgagttaagaatatctttcgatatcttaacggcgcaagagatctaggacttttctttaaaagaactaggattcgactttaggattcatatttttacaaggtggaactactatttcatggaagtgttctaaacagacctggtagccacatccacaaatcattctgaaataattgcattatatatgagacattacgtgaatgtgtatggcttcgcagagtgattaacaacatattaacatcttgtggtattggttcattagaatcacctacaattatccatgaagataatgccgcttgtgttgttaaaatggaaactgattatattaagagcaacatcactaagcatattgctcctaattatttttttctcatgagcttaagcaacatggagagataaacatcttgcaaactaagtcatgtgataatcttgctgatttattcacaaaatcacaaccatactccacattctttaaatgtgttgaaggaattggtatgacatgacttaaaattttgcaggattcagggggagtacctctctctgggaaataacttattttcgttatattacactctttttcctttgtatgagttttaccctttaggttttctcattcaaagtttttaacaaggtaatatcaaaataagttatatgtcttatcatttcgctttccaccacttgggtttttactaaatgataaatgtagacattatactattttggacaatattacgagttttactcataaaagtctaaaaatagataataatatatcatggtttttctccttatttttcccactaggtttttgaggagtttacatgatgtatctaatatactaattataattatttctaagattgtctttacagatatctggaacaatgaaagagcaatgatcaaaggctggattcgatcaagggggagtattatgaaataaatagatgatctcatccatataaatgatgggatcggcaaccgaaggtttggcacggcggttgtgccaagccacgtgccttctcgccctctcggcgctcctcagcaacgggcttgatggttcccaaccatcgcgcctacggttgctgccccttcctcatctatatattgtaatcgcattgatcaataaaggtacaacgattgtctcgctctcacaatctcaattgccttttcaatggattcgagtaatttttgtctctcactctatatatcatattaatatccccaaggagcagccgtcactcatcgaagctggcttttaatcttatgtgttgcgtagtaaaacctctttgtctataagcctggtttgtccgtagactccttaataggatgaactccgtttggcagtgtaggagcgtcatctttgcagtgctagacaagcaaaggaaaagatccctatgggcaggaaccggagatctcacaagtggaaaatgcaaagttaattgggtgaggacatgttcacagaccacaaatatgggccttgcccctacacctcgagaaattcgtaagagcgttacgaatgagatggctatggcattagttgaaatagctgggaaaagcttcgttaggaatggagactccatgtgacgacactaacaaaatcctctttgcggtggcaacacaaatcaaggtgggagacagaaccaccgtgcgattctgggactcagcttggttcaatggcttgcggcctaaggatgtggcaccaaaagtgtatgcaatctcaaaaaagaaaataaaacactaaagcaggccataaccaacaatcagtgggtgtaggatcttgacttgccgattgtacaaggtatgacaacagacctcctggactagttggtcaacctttggaatgggtccagctggtcgagctgtcccctagtgaagcggatgacatcatttggaagatcacaaataatgagacatactcagcagcctcaacatacgaagcacaattcttcggctcgaccaaaacaaacttcgacatgctgatctggaagccttgggccctagttggtcatgtagaacagagtcctgacgtccaacagactgtattgatctactgtaatagttttcttttcttttcaggctcttgccaagttttgtacatactctttgttctttaatgtatactgtgggggcctccctcactgtgctttgataaaaaaacagactatatgtgagaggttgacgaaacaacacatactgcccactttgcaaacataccttggagacagctttatacctcctggcagaaagcagatacactagaagaatatggaacatgattgcaacgtagacagcgcaagaacaattcaaattggcatcatgagaggcgatgaccacagtacatgattggtgggaagcattggctacatgtaaaggactgcccaagaaaaggatgagaaccctcctgctgctgacaacttgggaaatttggaagaagcgggctacagatctgtagccagctgcagcacggactttaagacgtaatatgtgtatgataggtaggaccatgtattaatagtatagtaagtaactattgtataaactaggaaggtagcccgcgcagatgcgcgggcaccttatttagtgatgtttgaaattttgtaacgaatgtttatgtataggattttttaaaaaatatttttttactcttctaaatctatgtttatcaatatttttttggattgttttgaaagttggtttcgatcactggatgcacggacacgcgttaagaaggtacatgctcctggacatttgtctgcttatgtgactatgcaagtaaggtggaccaacagggacgtcgggtcctttgagggggtttctgtgacatcctagtgcaattaggatgtggtctatgttttttttttatttaaaggatatgatatgtgatgtccataagcattgtgtgcacttgtccataagaatgaaagtgtaagtgatgtgatagcgtaagtgagcgtgccagttggagttggatgcatgctgagctaccttgttctgaaggacgggttgttataaattgtaaacaaaattacttagatttataagaaaaatatgtctcaacaatagagttggttcatatgaaactatcattttatactacatgcgtttttttaatttaaacttttaagtaatattttttccttgtatactaaacatgtccttgtagattttaagatataataatttaagaaattttctattaaaaatatgataatatgacttctttatctaattaaagacatactcacgtacttctatttacttctactacctccatccataaatcaaaggattcaaattttatcctaaaatatatgagatttttaatactactcatttcatccaaccattcttcatttaatttttatccaacattactctaaccatcttctaactctttacataccccttatttaatgatggatatcttagtatttttttcattcctccttaattcctataaaattttaggatccattatagaatggagatatatagtaataaaaaagagcttcattcatagacatatttatcgggaatgctaggggacgggataccattgccccaacgggatagcttcccctccacctccatcagctgcaagagcataaggcacgagggccgagccagcagtggggggagagcggcggcagtggccggagctagagagccggggggagggggcggcagtgatggccggagccgagggagagagcgacggcggtggccagagtcggggagccggcggttggagccagagagcggagggatggggtggcggcggtggccggagccagagagccgagggagggggcggcggcggtggccggagccggcgggggacggggcggggacggtggccggagccgggggagggagcggcggcggtggtcggagccgatgggggagggagcggcgacgggggccggagccggatccaggggatgggagggggtggcggtggtgcgtcgctggagccggaggagggagcggcggcggtggccggagctagggaggaaggggcgctggggcggcagtggttggcggcgtcaatgtcgggtgtgtatcgcgtgatacctggtaggtatcgcgtgatacctggctggtatcgcatgattcctgataggtatcacccgatacctcgcaagtatcaccttatatgtggcaagaatcgcatgatacctgataggtatcacctgatacgtcgcgagtattacctgaaaacgtggtagaatcgcctgatacctgatatgtatcaaccgataccggacctgatacctaaccagtatcatcccgttcaaaaatgggattccgttatatagcagccccccatatttatttgtacctttgagattgatttagctttacatatttgtataggtaaatagacctcgtatacaagttgagaaatataattaagttggtagaaagtcgttagatatctaatggtataaagtaagtaaaaattaaggtggatttttttggggggtaatttttaggatcttttggttaacttaattgttgtaaggaaaacaaagagatgagagctagtggattcgtctcgtccatgaggagggaaccggatacatgtgttgtacatacgcactctgacgacctgatcatttggtagggtttttttaagatatagatctaatagtttataacggtttaaaataagatccatcggtttgggtaaaatgatttttttccttagaatttcttacactttaatttattagagcgtcgtgtggtagcatagaaatgtttataggaatgtatagcagcttaagaacatttgtaagatatctaatggacttttagtatataataatagataattcatgtcatattaattaatatatcacttaataattaaatattttttataattttttatgggttcgccactgaaaggaaatggtatatatcaaagtgatatccggataattttttctaacttcgtcactgaagggtatattcatccaagtgacatataataatttctatatagaaacatatgtacctagagattatttttatatttggttgctagcttaagaaataggaaagaactcggagagacacagaaggggagagtcagagggggtgggacggagtacctatatacatgtgaacgcattatgttttcttttccgaacatataatacgtattgaaaggggaacgtgcagatttttttcttgaagataagatttaatggtaaaataaattaattgtttaaaatattgggtccaccggtttgaatgaaagtggcacgaagcgatgtaggagcttttaccggagtgccaccggacataaattatacaatgagatagataatcatacatatgatgcttataatgtctatccacttaccataattatcaccgttttcactctatattagttagaaactatagttaataaatagctaatttttatcggtttaagtcattggattatttatagtttatagttaaagaaatatgttattttgaattttattgtgactttttagtatcatttaaaaaaaattaaaaaatatgaaacaaatgatatatattttaccggctgaaaaactacatatcaaatattatggaggagtccggtacctgtgtacggacgtgtgaggttcacgtacacgcgagagagagaggagagggtgggattaaattctctttttaatctaattaaatctaatggtctaatagacccaccaatttaaatgaaaatcgggctagatattcctaatatattagaacgccacatggcgatttaggagcgtttataggaatgccacatgacggtatgagagcgtttgtagtatgtttaatggatttttagtatataataatagataatagataaatggcaaattttgctacatgacacttgttatgtgtggttttagctctaggacactgcccaaactcacttttaggggaaaacactccataaacgtggtaatttgctagtggacaccgcgccgattaaaataatattttccggttggggaggagagagaaatcgcgtggaatgtcaaaaatgcccttgggcccacatgtcagctctatctcctatctctctcctcatctctcttttctctctcggagcgcctccacgccgccttcaaggagcacagcggccacccacgatgccgccctcccctccctcctccccgtcgtcgtcggagttcgactctcagtcggagtcccagtcggagtcggagtcgtcgccctcacccttccacgccgtccgcagccaccatctgccgtcctaccggaagacaaagcagagcagcgaggcgcgcgcgcgggcgggtcccctctcctcctcatctggaacggcgagcgcggcggcggttgtcagatccgcgtccgacgcgtcggcgttggcgtccgccaccggcttgggcggaagaagcggctccgcggcggcctcgcggtagtcaacgggctcgggcagcagcagcaccgcctgcggcgggaggtcggcggggcggcgcgccgaggccggggccacgaggaggaagcagacggcggcggcgagggcgagggcgaccccagcgggggccatgctttgctcttgtgattagtagtaatactagtatttgtggatttgctcttgtgattagtactctcaggccggcgctgccgctccgccggccgccgtcctcgccaccccgtgcgagcgcgctctgagagataaaagagagagatgaggagagagataggagatagagctaacatgtgggcccaagggcttttttgacatttcacgcgatttctctctcctccccaaccggaaagtattattttaatcggcgcggtgtccactggcaaattaccacgtttatggagtgttttcccccaaaagtgagtttgggcagtgtcctagggctaaaaccacacataacaagtatcatgtagcaaaatttgcctagatagattggctattacattggctctagatgacttggggctggtatttggctatactattgaacttgtgctaaagaactcccgacaatagctcttctcaccaagattaaagaggagggggaggacttgggtgcgtgctagagcaaagcatccagcagagattgtttcttaagcttgtatagccctttttaggttttaccctctaaagacttttactcattctctattcaaggaaattggcaccgtcttgtgtctgttcattaagaaaaagcagtaacagtcatgctctcatgctctgaagaaaagcagaaaccaacatcagcaaggctcttcgtgggtgcggcgtttcggttcggctgggctagagcaagaggctcatgtcatcatgtggatgcgcacccaaccatgggtagctaccagggctttggcccatttagagcgagtacaatagcaggctgagtgctgtaaactcatgtagaggagagaagagaaaaagagaaggaaagcagaccggctgccgcacggactccaatacattgtgtgtatatgagaggtgggatcatatattaatggtgtagtatatagttataggtaactattacatgaataagctattagattgtagtatattattatatgaataaactattagattgtagtatatgtttataggtaactattacatgaataagttattaaattgactattgatgtattgaagccttaaacttgctcttaaagatgaagtagagagagataaatgaagatagagaaagaaagagagagatcgtgagataccatgagttgggtgcgcatcgtctgctcaccgtgccgggtgccaatgagaagagaggaaggggagtatctaaaaaactgtcacaagtttgttgggtcaaaaacaaactgtcacaagtttgttgggtcaaaaacttatcattcagcagttcagcttgtgggtttgcaaatcctgatcgtccatgcaaagtaatggttgggattggccaatggcacggtgctgttgaaacagagaacggccgatgatgcgcaccgccgcacccccagtagccaacgggaggaagcaaaaaaaacaaaggaattaggaaggaaaaaagaaaaagaacaattgaagagaggaaaaaggaaaagagataggaagaaaaagaaaaggatatggatttttcttttcggaaaaattccaaatttggaggattttggaaaaaaaaaattagaaaattttatggattgggaatatttaggatttgagagaattcacggaattgagctccacttccaaaagccaaataaaaatcaaataacaaacaatagaaaaaaaaagagtggcataattaatttatttagtaaatttaacccttttttatttatgaaatttctattaagctattttaggcgaataaatattaatgtgaattttcgaaattaggcaaattcaaaaacgtgaaaagcgagacgtggcattagtcctccaccatccgatctctctttacgaactcttcttgattggttctttccttccccgtcacttatttgtcaaaatcgtaatagcttcctttggtttctacaccatcaccaccacctccatccctgctgccactattcctacaccgttgtcaccactatcacttcttccctactacaagcaaagccggcctccaaccaaaagaaaagaagaaaaaaggttccagtttctcccaaaagaagtactcccaaaaataggtaaactacgagaccaaagcattagaacttctctcgtgttccccaaaatgagacttctgcaagagctaccatccatcagcttcctaattcctgtcagttgtttttcatgaaacctgaatgaaatagagaacggttttgctagctagctgtcgacagttttggaggccaaaaactttcgattttctggccgtgcgatccgcgcgagatgattttccgccgtgcgatccgcgcgagatttggaaaaaaaaaatgtacgcgtgttgtgcttgcaggggctcgaacccagggtctccatcctggaagccgtgcgtgctagccacttgatctgctacatgtttttgtaaagtttaatgagttacattttagttatactccagttataccctagttacactatagttacatttgtaactacattgtaactacattgtaattactatgtaactgcactgtaactacattatcatctctatataatttagatataatgttacatatattattttaatacttatatacgagttacattatagttatagtgaaattatattgcaattatattatagttagatttgaaagttttctccttaaaaaactttcgacagttctctagatagtcccaatagagaaagcatttgaatgatcatatgaagagaacgagcagcatataagcataaacacaagtaaacaagaagctaagttagttcatctagtcctttttacttttacttatgaaaatcgagagatagcaatatgtgttttgttctatcctgattcagcagattacagaacacagatatattttatattcatgtcttgattcggcagatgattacaccatgatcttgttatgaaatggcaagcttcatttcaggcttgatacgttggtactccaatatttttaggactaaagaatgacaatggttcatcataatgacaaagctgggcatcctttaagatcttacaagacaccatgttttgtacgtagaacttctagtttgcacttaattatgtctgctagttcattatagacgcaagccaacagaaataccggcatactcccatataacctatctgtattttgtttaaagcaatgtacatggtatggttactttctatcaatttatttcatcccaacaaaaatataaaagcagggtcacttgtcataaacaggaaagcttcatctcagacttgatcgccagatgatataatgttttttttttcaacagttaacatgatgacaagactgggtgtcattcagtttcttaaatattatgtttactgacaaattgtagtttgcactcagtgatgattgctggctcggagaataataatacggaacagaagtaagaattttcattggcatcaacctaatacttggtaggacacgacagcgaagggtgacaaagcaggtcgaagaagatgaggataactaggaagaaaacatatcttctttttcagaggaagaaaggtaccctacataaaaaagctgtgtttaggcttccactattgagttaacctcggttcttttgaagttggaactataaacagaatgcttcaacagaagtgatcagccacaatttgggtaccagcctaaccagtgacaacgtctggcacatatagtacaaacagacttactagttttagctaaacacatgaaaggttctattagaaacaaaatggcacacacgaggtgggtatttactgcataaaatgtctaagaggtgagtgcacgattatttctgtaggatggacaccttcagactagaagggatgacaaactggatatacgactaatagtggatgaaacaagaagcagtagtggagagagtacccaaagattgtttagatgagaacctggtacatcatctgttctaatcactgctcgaacgaaccaggacgtctgccaaagtcttgttttcagcaccttcctccttgcctgaagcggtacatttaatcatttgtacaagtaaaacatcacaatagtaacacagaacatactaaaacaatatggaattctctgtatttaaatataaggtttgagctagcaataaaactcttcttgtagggtaggtaatggaaaattcagcacagcgaatctataattggcttaattacatgaataaagttgttatgaataactttcaaatggacagtcttatgtgtgatacaaacaatagacatacctgatatatgcaaataagttagcttgctaatttttggtccagggttacactctttaactaatatagttcttgacaagttggagaagtaaagaagtaagagaaatacttgaaagaatgagttcatttgctaattttaggtccagagttacaccctatctgataaaatacttgactagttagacaaatgaagaaatccttaaatggacatatcatctgtattaaactattaattgtactctatgaacacaaaattatagaaagatggaaatagaatgtggatcatgtggtataaattcacaattcacaaacattagattattatgagttccaacaaatatatcctcaaacatacatggaagggtttgaacgattatacaacagaacagcaacagaaatatatgtatataagttgatagttgaactactaaattccacagcatgtgaggtcattgtcctattccataaccaagataacgagattaacagactataagatgtcagtttgacgaagaatactgaaaatgcatgtaaagcaatgctataatgtaaaaactagcaaatgaccagcacagagaacaaattgtaactagcaaataaagaggacaagttgaacatcacctgcagaagggatccgacttgacccaagccaaggtgggagcacacacggtaagaaggtgccaatgagaaatgttcgctcatggaactcacattcccccaaatcagaacaccccaccacctccctcctgtccatgtcgacggcgaggacatgatctccgacgacgacgcacacgacgctggcattcaccgggtcaattgcacagatccaagggattctatcctgccatggccgtccagctgccgcgttctacagtggccggccaagcgccacctgatgctcaagcgtccagcagccgtagtcgtcgtcgagggcgaaggagctgagcacgaatggcttcttctgggacacctcgacgtagcgcagcctcccctcgctgaccccaatgcggcggtacatcccctgagccagcactgacgccatgaactcctcccccgtggttggctctggcagcacgctgctccgcggcagctcgatgaagcggagctctggccggtcgctgaacgggtcggcggagaccacgccccagcccagatcgacccaccatattcgtccggcgaaggctaccacctcgtggtgcgagtgtacgttcagctgccgcgcgagcgggagcggcgacggcaagctctccagcttgtcccactcgcctgtttgcgacaggaaccgccacatcgcgaagccccgatccttcccgtcgcggccgttcccctcgctgagagatgcgacggcgtactcgtcgggcggcccgtgaccgtgcccctgcgcggaccgggtgaggaggcccgggaggtggcagaacatggtcttcttggtgccgttgatgtccgggaggcggaacagctcgccgctgatggggttgcagacgaggcgcgtgatgtcagggttcgtgttgacgccggcgagctcgcgttcctgggtgtcgccgcgtgagttgtggaggttaaagctgaggccggtcaacttcttgccttgctgctgagcctgagcctgcgcgccggcgcggcggttggcgacgacgcgggccgtggcgcggatatcggtgaagtcgaggaggaggaggccgtcgctggtggctccggcgtccccgacgacggtgcggaggatgtcgctgttgggatcgaccgggggctcggggtcgaggccgacgaggtgctcggggacgacgaggtgggagacggccgggggctgggcgagctcgatcgacgcgcgctccgccgtggacgcgcgtatcctggtgtactgtatcatcgcccacggaggctgcgatgcggccgaggagaggccgcggcggagacggccggaggcggcggcggcggcggcggagaggtggcggggcagcagcatctcggtgaaaaagtgggggttaatttgataatttctctcgtctccttcgaacagagagaaggtgaaaggaattttcgcgtgaggaattacggagttgatgagtagtactagtagttgggtgcagctggcctggtctactgggctcggtccagggatttgaacgacattttacggcaagggctgtgtttatttccacgcaaagtttagattttggttaaaattgaagatgatgtgactgaaaagttacgtatatgacaggttgatatgatggaaaagaactgaagtttggatctaaattttagatctaaacacagctaaggtttgctgcacccctccctgttggtgcggcaaaataaattttcggaaaagtaaaacaatatgtaccacaaaattttaaaaaagggcaaatgcacaaaaaattttaagctacgcatcagagcatcgttttgtcatttttgaactttgcaggtcgagctttttctttctttggcaaagcgtctgtacaaaccgaaaacattatctgctattttcagggattagcaatgactaacattctcagggctactgaaattccgcaagaccctaaaatcttaacacatttgcacatactttctcagtcccaaagtaacgtaatcattttatttttctatgtttctatgtttcataatacaaggcacctctttcttaccacacctctttcttcccaaaatttgtttttctttaaatcatctaggttcaacatctctaatcctacccatgtattgtatttattgagatgattcaaacaagagtggtaataattcttttaagtctttgactatactaatggtggttatgtcgagaaaataattggaatggcacctctattgtactgccacgtactccctctgttccaaaatgaatcaaactcaagagatgaatctagacacacatcctagagtttgagattttttgggacggagggaacaaacaccaatttacgtacagtattcagacagtcacactcacacatgctgaattttgcattaacagacaagttgtgaatcaacatctaagacgtgctcaaacacatggcatttttgcccggattccaccttcaaaacggactcaaaatcttctgccaacgtcattagccgcagctcaaagccacaaactcattagtgtctagggaacgtctgcctagctgcttttaagtacaatattaatcagtgaaacccaaaattcagcgttcagccaacgtttagcaaacaaagaaaaagagggggggggggtggagtttgtgattgcagcacccaatgccattgtagcgttgcttcataagaaagaaagacttccaagttcatcataaattcagaacagctttcacaaaacaacttcagaaaccaacagaacagatatcgcctgttaaattccatagacctggagagaatgaattaagcattagcccatctcattaatgatgccaagagagcgagtgctatgagaaagaacctatttttctttgttacaatatggatgcatgcaaacagaaataatactataatcccacacacctttttctcaattttatataaaaataggcgtaatgtttattttctatataccatttctttgttccataacagcaaatatgtacatctgattggcagatctaaaataaaacacgatagccctaatttttaatatgctcaacatttaaatccgaagtgctactaaaagaccacagtataggaatcatggactatttgaaattgaagtagccatctggtaaattaggctgtcttgatctgaggtaacacttaacaaataatgatgggtagcaaaaagtaactaatcaggaatgcagtttccttaacacaggaaagaatgaaatagatgatggtttaaacaatgatagctaagtaccaaatatacattatatataccatttctatggtgcaacaaaaactaatgatttcagtcacttgtgaagaaacaggaagctatgaagttaataactcatgataacaaaaacagttatttagttttttaatacgcaagctttatttaggtttccatctagataagttttactggtacaacgcgaagttgattctcggttataatgggcagatcgaaccagacaaatctgtacagttgatgacaagagtagggcacggtaaccataattatttgtacactatttcacattgaaatttaaagtaccaatagcttaaaactgaagtagtatatcatatcatgttctacagtacacactacagaaggactcaattgacgctacaaacatatatggtcagcaaaagtaactagtcataattcttgtttcattaacaaaggaaaggatgaaatagattatggattaaacaagaatagcagaagaaagaaccatatgtatttgcttcttcacctcaactcttcatatccctgtctacacgaaccaatgtgtctgccatggttttgcttctgatgctggccttggtgcttgaaagtgttcctacagtgagggagttgaaccattataacacaagaaatggaaataaacacttccctacatttgtttacaatatgaaagagcataacatctctacactgaaagacatgcgctgtaaatgagtttgtcccatcataatttagctacattaggttggcacagaccacacaacatatgcatcaagaaacaaaatggaattgctaacttgctatacatgttgactgcaatttaagcaaatctcagcatttaacattgcacgtttccttttaatgacttcgtaaccaatttaacagcagaggtggctcatgaaacaataacattctcacaagcctccaaccacatcgtttagttttgacgggcgcatgcaagacagggcttttcccccgattcctcccaaatagaggagattccaacaatctgattccaatgaaaaccagcaacccaaactcgtctagggatctctgctcagccaattttaagttcggtatgcatcagcaaaacccaaatataaatgcacatccaatgtttccccaaaatgacagttcggagttgcagcaccaattggcaattgcatcataatacatcacctcatagaaaagggtaaaaaagtcctaatccatcagaacagttctcactgttaaatttcagaaaactggaaagcaaaagttatgatttgggaacatctcattgatcaggcaagggaagcgagtgacaagagaaagaatcaatatttattggttcatcatgaacacaagcaaacagagatgatattatagtcccatatagctggtcttgtggtgaatatgagacatccatgtggtagataaaatggatcaaaatcacccacggtagtatgaataggagtgagaagatagtattggaaaaagttgattggccatacaaatcaatagtttcttaatatactaccgatattgcaaaacatagtataaggcaccaaaccactcgccattgcattgccacagatcacacgcgatgcaatcatctagaaacataataagatggctaagcacattaactattgaaattcaagaggaattcaggcagttgacaattatcacttctgttttctgaaaaatcaacatgcctacctaaattcccagagattattcatgaaaacaaaccaaccgaccataacatatgcatactcatgtcgcaggtaaaacatgcatatcaaaataaagcatgagaaagaagagaacctgcagaagggatctggaattcctcaagccacggtgggagaatacatggtgtgaggaaaccggtgaaaggcgaaaatgggccagtgctgcaacctatctgcgaacgtccgagcacctcaccccgctccatgtccacggcaacacaagagtcaccaattgtgaggtacattgtgctcgcattgagtgggtcaatgacaccaatccgtggcgtgtcatcctcctccgggtctgggtggcatccatccaccccgagccggctgagcgctacccggtgttccagcgtccagctgctgccattgtcatcaagggcaaaggagctgagcacgaatggctccttctgggacacctcggcgtagcgcagcctcccctcgctgacgccgacgaggcggaacctgcctagcttccgtatcccctccacgggctccgtcacactgcccctcggcagctggacgaattgcagctccggtcggtcgctgaacgggtcgacggagacgacgccccagctcacgtcgacccaccacagccggccggcgaaggccaccacctcgtgggagacgtccatctgcctggcgagtgggagcggggacggcaaacccaccagcttgtcccattcccctttctgcgagagaaaccggcgcatggcgatgcgccggttgtcttccccgtccacgctgagccacgcgacggcgtacctgtccggcggcccgtcggggcggtcagattgggtgaggattccggtgaactggcaccacgaggtgtccttggtgccgtcgatgtccggcatgcggaacagctggccggtgacagggttgcagacgaagcgcgtgacgtcgaaccgcctgtcgaagccggtcatctggcgcgccaggccgttggggtggacgccgacgacggggcccgtggagaggccgtcggtgaagtcgaggaggaggaggccgtcgccgctcgcgccgcgcacgcagcccccgaggaggcgcatctggctcctggggtcggtgaggggccggaggtcgaggaggtgcgcggggacgtggacgtgcgaggcgcgcgggggctcggcgagctggaacgacgcgcgcagcgccgccagggagctcctggccgcttccacgtggaagatcatcgcccaccgcgggcgcgagggcggcgcggccgtggagagggtgcggccggcggcggcggcggcggataggatcgagcggcggaggcggagcaggtggtgcattttggcggtggccggcgacgaggtggaaggggggagaagagggagggggggttttgctgcttttgtttgcggcgagcggagaaggcgagaggggggcggtcggtgcacgagggcttggttcatggacgggggcggtgcctagatgtggacccaggtgggttcacatgttagtgaaaggacgtggcttacgactgcgggaggcggagaccggaggggaaaaggctcgccactttttgaacgcattaactgccagatggcagatccccactggttgctgtgtgtgcttaatcccgtcagtcactaatctcccgccaaaacgctctggtccttttgggcccatacggcccgtatggttgggggaagttggattgagagtttagagcgacgaggctattaactattttgtttggttggaagatatgtaaattttggtgggatggagataagttttgcctaaacaaatctcacccatccgttttcattagaaattgggaaaggattcttcttagttaggagcagctgactttagatgataactgttcggacaaactgtggtggactctgtccaaaaatgggaaattcactgtgaaatctttctatagagctctcaaaatgcaacaggtcaattgtccacataaaaagttttggaaattcaaaattcctctgaaaattaaaattttcatttggctttttaccagaaacaagattcttaccaaagacaatctttttaaaagaggttggagaaaaggtgataacaaatgtgcttttttgataaggaggagacaatccagcacctgttttttttttttgagtgtcctttggccagaatgttatggaatgtcattgctgtagctttgaatctcaaaccttgtctaaacagaataaatctttttggttcttggctcaataatatagagaaattcacaaaaaaaccttgttgttactgggatagctgctgttatctggactatttggaagtccaaaaacaaagtttgttttgagaataaatttcctcaagatcctactgatttagtgtatatggcttgtaatttggtggattcctagacttgtctacagaaacaagaagcaagtcgaagaagtttgcagctgggaaccatggtactaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagctttcatttatgtaattagttttgtaagtagtctatatttaatactctaaattagtgtctaaagacagggactaaagttaaaacaccacctaagacaggtggcaagtgaagtattcaattcaagtcatggctggcgaggaggcatcagaagaattggaccagcttagtctctccctggcagtttgatcttgtttgatactccttggaatgtctgtttaatccctagtactctgtatctaggatcgtcatcttggttaggcctgtaatggttaggctgatggtcttctgttcctgtcccactcagtggtcaggtttgtcgttagttatctgttttttactacttctcaagacttgttgtaatgactatcatttctacaaagagaaatgggggcgccatcgccctagttctaaaaaaaaaatctaatattaaactaaactccatatcaatttccaccacctctaccaaacaatatattgggactaaaaatcaaattcccattttaatctcactatccattctctcgtctaaactcccagtccccttccctccagttgccagagtatgagagaggaaatgggagtttagaatattgagcattttaatctctgctccctcagtttcacaatgtaagtcattctagcatttcccacattcatattgatgctaatgaagtcttcattagcatcaatatgaatgtgggaaatgctagaatgacttacactgtgaaacagaggaagtagtttggttggagggcttgggaatttcgaagggattgggattgggaattaatccgtccaactccccaccatcctaccttgttaattcacgagacttggtgagaattaaacacgagaagtctaaaacacccctcaacaatacccctgcaacctccaccgtccgctggtgcgagaaggcacaagatgcgcaaaacattcccattcaccgggtcgagaaggactgaaatgtgcgaaaaatcccctgccactagcacgaggagtaaaacgtgcacaaaatcccttgccactcgcacgagaagaagtaaacgcgcgcaaaatccccatctcaatagcacttctctcgccctctccgtcgggtggccatcatgagagggaataaatcctgcgaaatatcaccatcttagcagcacttctcccattcacccgagaaaactacaacctttctcacacaagtttgttgtgttctcgaaaactccccctctctctcctatacagatccagaccgtgctgctaggtccaccgctgtcatgccttgtcttcgagtcggtccaggggatggaacataggcaacgggatgtgggggcggcgatggagtagagaccggatgaagcctagcccccctcccctcgaaggaaggagagagaggggtgacccactgacatgtgtgtcccactttttaaaatcttttttcctgattgacatgtaggccccacatattttgtttgaacttttatttttcttttaaatcttgcttctatgccatgtcaacgtcatgtgggacgaaaccaaaacaaccgtccaaaccaaattgggaccttgtatgcactggtgatacgttaaagaatgttattcaaactcgatgttaagacgagagatctaaagtaaacttattacctttaacgtttctagtggaccagcccatcttcctacgtaaacccaacagccggcccactcagattcccatcggcacggcacgtctccccctcctccgcacaagtctcggattcctccgcacgcagcttcccctcccgaagctccccaagtttgaaatttcgaacggtcggcggcggaaggatggagagggctaccacctccggaggcggcggcggcggcagccagccgccgcggggggtagggctgccgttggtggaggtgcaggcggcggcggcgtcgctgcggcggtcggaggtgttctacgtcgtgaaggagctcctcggcttcgtcctctacatgcaccaccagatccccgcgtaatcccccctcgatccgctcccatcctatccccccgcccttctctctttcaatctctctccctctcccaaatgctggggaagtggtcggtatagggatggatttggtgggtctctatgtgagtttttagcatctaggttacagtctaaacaatttgttcgagttcgaatctaattttctagagcaattgaggtggtactgaacttcggatttggtcaccagattttgatgggttttgttctagcaaccttagtgcttgtggatctaattgggatacaagttgcattgcatcaatccatcaaataggcaatggcctgactgaatggctgttctgctgtagcagagttgagaattccattaattcaaaatggctctagaaatatgcgtggcgttctggaccatactgttggcaatgaattgggcaacttcatcgatgatgatttgaaggttcacttttgtaacaaattgcttgcatttcctttgcttcctgggagatgtttggtattgatatgtggccttaggttgtgcattctctgttagatgaatatgactgttgattgttatgttattataaactgttaatttgacgagatactttaatttaccttattgtagcgtgttatctactcctggtcctgattacatgtgttggtgcaggtgtggtgttcttgtgctttcgttcttatgttttatgcacataataaaatagacaaaaaaaaattctggaagaaatcaaagtgtgtgtatccgttcttgtagaaatttctgctgtacgacttttttcccccgcaaatatgccaaaaaacttgcatatatttgtattaagaagaataaatagtaagagaacaaagtagcaacaaatatacatacacacacagagcttcaaaagaacaaatggtcagagactttatgtatgactgtttagtttctgtgtatgttctgggctctggttcttcatttgcaatacctgagcacatactcatgaccaacctagtttgtccagtacaacagaataatgttgatgcattggtgtgacgctgttattctatgatgtagggctaattttctggggcttaagttaggcacacagcattgttgtgcattggtgcttgacttctaggatgcgtacatcactgaagatgaaacctttgaagatgaaatctcctgctattgtgttgtttaaatttgttatagcacacctgcactgcaatcaaagaaaaagaatataagtgaacagcatttagcttggattatgtaattatccattttgcagatggccagattatatactaagttagggcagttatacactgctgtatgtaaaattatcacatgaatttgaagtctaatttgtttttctacattttcagggtattgcagaatcttgaaaatgaatttgcaagtttaaaggaggaaatggtaagttttgttctcagaaagaatgtcaccattagcatctacgcagtatttctttatcgagcctattaataatttgtggctatttatagacagagatggcattgccaccaggagaaatgaaaccatctgatcagagaaagtacaatacacggaaaagggaagtaagacggaggatcaagaagcaggagaagttaatgaatggcctctccagcgtattttctgctcttcagaaagcactcgatgaagttcctagcattgaaggagttctcctgatcctcggtggtagccttgtcaggcctctgtttgtctatgacattacaatttctcatggtagatttgatgctggaagtgccaatgagcgtggtgcaagcaaattagcgcagtccgtttctcgaaaggtgagctactttctggcttaatgctccatgaataactatcacccattagatcctagggtgactacatttctttagaatttggtagtttttctgaagtaccatagagttgagatctgaacgttgatggaattcacaatgctgtaacttttagtacctactttggacaacaatatggcaatagcatatctgaaatgttctagtgttgtagttttgctctactgtttggcattttggcatatgaccaaacagtgtaaggagaatcttgctatgtttttgccccattgctaggcttaattctatttttttttacttatcattgtgcatgtttcatcttcatatggtggtcctctttaaataataacatgcatatgtatatgtataggccattcgtgctcttatatcaagtggtgcagggagtttatcttatacaggtactggttcttctgttttactatatactagctctgttccaaaatataagaatttttagtggtggacatgggtattaaggaagtaggtggaattaaatgggagaaggttgtgattgtttgagaagtgaaaatatgtgaagaaattaaatgtggggagattgtgattagttgataagagaatgtaagtagagaagttgtattttgggacaaaatttgaatgctgaaattgttatattttgggacagtgggggtatttgattgggaatgccatcatccttttaccttaacgttttccctccaattgttttgaaggccctaccaagctgtttgttctagtcagatgtccctgtacattgaacttaccactggacttcctgccgaaacgtgattttcgttacagcaaaaaggttttttttttttctgaagttagtttatgttttttgtcagcttccttttgcaaaaagatctaatgtctccctgattaatacatgagccttaatcttttcaacacaggttgtacccctccagatgtgtataaaatgcaatatagcaggcatccaaatagataatcaacaaataacatcaattgttgatgcttcaagatgcacttcagaatctactatttctgaggttatctgtaaataattctggtcatctgttcccagttacccatttatcactatttgctttctgctgctatttcccctcctgtgtaatggtaaccaatagttcagtattgtcttaagtacggcaaaccttccctagtactatgcaagatagagtgctcttcctgagtccatgccactttattttcttaaaatcaaggcaggagcactgctgaattctactagaagaggtgaaattatgattacaagaagcccattagtgtaatcttattaaactgcatatgaatcttttgtgttttgaaggataaaagaaatttaatttaccaacatttgaattatgtgcttttgtgttttgttggcatcaagtattgcaaagaattattttaaggttgatacggttaggattttttctcagaaatcttacccattttagtttgttatgtgtacactggtttccttctattttttcccctgaaaaacatgtatgtgttttgatgacccctgttctgtttttagacctttgaacttccccctttttcagtctattaggcagagctcctgccattttcgttaaaaaaagaaaagagtgatctccagcggatcttttcttttgaacttaagtaaattcagttaacgaatattcattaattttccaggttccagtgtaagcatacgataagaggcctaccttgcaaggcgtcattagaagagtgatatggcccaagcatgttgaagacgcccagaaaacagtggatgatgtagcgatataactcctgttctgactttgtaaatgcatacggcattccgcgaaggatcatcattctgtatgttcgttccatttgtacagtgctatgaagttcagttcgctccattgcctaacaaagaagaatgaaaaacaagagcacaattaaagtttagtgaacctgaagtattgaattgaatctccacaccattttacttatgctcagttttattgcgagtttgcaacactacatatttacttttgaaactatgattgtgtttagaaccaggggtgtaaagttttggcatgtcacatcggatatacggacatgcatttgaagtattaaacgtagactaataacaaaacaaattacagaatccacctgtgaactgctagatgaatttattaagactaattaatatgtcattagcaaatgtttactgtagcatcacattgtcagatcatggagcaattaggcttacaagatttgtctcgcaatttacacgcaatctgtgtaattagttatttttttcgtttatatttaatacttcatgtatatgttcaaatattcgatgtgacagagtgaaaatttttaccaggggtctaaatagggcctatatgtttataagtagcagcatcctataactacataattgccacggactatatcagaaaatattgattttaaaagtccttatagccaagaaaaatcattcatcacaagtgattaaaaagtttgaaaaatccatatagggatctagactctagagcactatgctaagatttggtagtaatataagatgttctatagttagacacggttattaagaaagtgggtagaataaaatagggagaggtatttaaaaaactagagttgattttgtactcaattcatttttgcacgtcttctccaaaaaaaaaaacacgatgtacttcatccaggcttcgtccaagtctgatccggtgcagttggttggctccgaagcgtgcacgtccgtgcgagagtagagtaagagagtaaacacgatcatttcgttcttgcaaaactcacctaaaggaaaattaatctctttttttagaacttttttatctcttcgctttcctactggagcttgagggatcaaaaaggagaacgactcaagaagcgggtgtgctctagtctctagacaagtcgcctatgctcgctaattctcacggtttcgtttgatctggttgtagattattattggcttcttgctgcgtatcgacgcatcagggtttcgtcgatcttgtcggcgcatcagggtttctttgctctgcttcggccatgtctttgtggatgcgggcagcctccatcggaggatatggccatgggattggtggatggtttggatgtttactcaattaaatgagtaaattttacaatgggccacatattttgaccaaggtttcatcatcggctagggttaaatcaatgttttcacttaacaccatacatctttacataagtcttcagtttggactagggtgagcaaaacaagggaatatgtgagacagcttcatatgatttacacagggataattataaaatgcaaaacatttcatgttttcttccttcttttcttttcagtgtgtggtagttaactagttctattttctattttatttttattcattgtgccccaatgtatatatcattttgtgccacttttgaacatgttcacgtcattattttagtgtgatctgctgaataaaaagttgttttccgatttgctaatttctttctaaagatatttgtcttaatactgtggcactaaaattgatgattttaactatcttttctctgacaactacctttgatgtgttcaaccctactccaaagtgccaactaatgcaaacatatatggtgttaaggcctggtttagttcccaactttttcttctaacttccaacttttccatcacatcaaaactttcctacacatacaaactttcaacttttccatcacattgttcaaatttcaatcaaacttctaattttggcgtgaactaaacataccctaagtgaaaaggttggtgtggaccttgcccattgtgaaactttggtcaaaatacatggtgcaatgtgaaatttactccaattaaattgatgtgcgtcaatttcaattttagatttgctcctcctttgatcatgtatgtttgttacttccctgcagcattgcttgattgggaagctgaatcacctacaagtcttccctggtctatagtatacaattttggataaccgactgccaacttttagttcatctaattttagtttccaagatttatcttgtcaaaaaaatgaatctcagtcatgtaatatttatcataattttagtttttcccgtgacaatgcacaagcattttgagttaattctaatgtctaaaattggatttcataaataaaggttgtttacttcttacatgaaactttttatttaacaattgagatataaaattatgtttcatgtatgtgggaatgtattctgcgtttgtattgattttgaacttcaactctatcttttacattatggcaatattaattaactggacaatcaacttaaaattcttaggcttctcatccattatcgaatcttgagaaatcatatccctcatccaaaattgagagttgtcaacatgtttatgcacaaagttgagcgagtttgttattttgagttaggatatatcatttgaacatttaactcttttggattttatttaaacggtgcccctcttttcaaccgaacccaaatttcccttttttttataaaaaaaaatactcagcacgtgataggagggttgtgtttttacccttttttttttcccctatacgcgtctcacccagtcgcccgaccggcctcctctcctggccacggcgacgcctcctcccccggccacgccgcgaataccttgggtctctgcaatagtccaataccgatctgcggcagctactctgctcgtggaggagagccgccgccggaagccggaaggccgggtagcgccatggtgagatcccgagaaccctaatcctctccgatgattggattcgatggatctggcgatctaattcgtgtttctttttcctttttttttggtggggggcggtggtttagtcggcgctattcaacttcaattcgttcctgaccgtggtgctgctggtgatctgcacctgtacctacatcaagatccagttccccgccatcctcaacgaccgcaccgggtatttttttcttcgtttcactgtgaacttcctgatctgcgcgatttgttcttctttttagtcgtggaggcaaataatctaacccggaaaactaaaacagcgagatgtatgagaaaaatctatgtctttacagtggaaattgtgtctttcaggcgctgtattaacatgagacggctgtgtgcgctgacaaaaataaagcttattatcgtggatgaattgcatatagtttgtttgtggaccggattctctactaatgtggtttatagtaccctgcacgcaattgaattattgttcttagatgttgttcagaatatatacagatgtgtttgttagtgctagttatgcagaaactgaaagtttgcctgtgcatgaatggttgtggacaataaagtaacttagctttggtgactccaacttgatttgggcatgattgatctgtgcaagaaaccagtcaaatcaatcaccaacttatatgccatgaatcatgataataccatgtgctaactgttgtttgaaacagttagtgacaactgtacttgtcactgtgtttacaatttgttcttaacccttatttgaaatgccaaatggccaatggatcttgttgctttaataaagcagaactgtggaaggatatctgttaccatgtaatgtaataagctgatatattcctttttgtacttgaatttctccacagattccgtggtttcttttggaaagcagccagaataggtacgagtccttttcttcttccagctcgaatagcaccacctatcttgtttccattttgctaatatctcctgcatgttgaacggtcatttcatttttcactctgcaccattgggcactagattttttgttggtatatatattatcgaacatagtttcgtctatcaacctcaactgtaaatgttcactcattcaaattgtcagcacctaagttcattatttggtgtttagctgagctcttaatttcagcataggcttattatattatctatagaataatggtatataatacttttctatttagataattttaaaacaaaacaagtaaacgaaaataaatctgaatcatctcaaatttctgtagaagaatgttcataaatacattgttttcttttattttgtcagatagctattatttaactatcatgaaagtcagtagtcttaatttctcaaagaaaagcagccctcctgtgattatgtttgagatcttcaattgccattttttttcagctgtggagttctcgtgaaaatttgctatcatggtatgcttaaactatttagcaaaaagatcctggttagatatgcgttgctttattgtcatggtcctcatggtcaattcaataatatctctgttaggcacataatggccactttaatcttaaaaaacatggtgtccttagagatctatatggaatgaaggatagtgaaagtttacaaaacatttagtgatgataattggaatttgaagtctgacggtgcagcatttctttcttcgttcaaagtctaatggacctgctcatggatgatatcacattaatactaaagatatgctgactatcagccttgatgatcagtagttattcaaccaatgtttttatcacctgctccttttggaactttacttgaaagcaaatagttcctatcagatttcttaccacttcctggttatttatcttgaatggttcttttcctatttgtattgaacttgattaacttggacaaatgaatttttataattctattaaggccaaagttactcagtgagaatcaactataacttattaactgcagctaaatatatattggtggaaacatttctgttttgtaactataattccattgtcactaagaaattcaggaactgctgctagttcatattgtgaatgtttttccacatctggatctcatttattgggttttcaactgtttatatgtaaaattgtaaacatggttgtccaaactgatagttatgtgctgtgggctgtggcgcaaggcccggtaaagctttgtgacagacatggctctgaagaccatgtggttattgtagacctcaagttaattaattgaaaagccagttctttagatatttcataatttggtacacaatcatgtcaattacattatttttgtacagtgataaagtttcttcatcagttcattgttaaaaatccacccatctttctatcatcccactatctactaagaaagaattctggccaaagagttctatttaatctatctctcgatcaacttgtcagccttgaagccttgtcattgccacagttgggcaagatctctactagcatcatgaccatagtgtgtgcataaaccctttgtctttgcctgcttgcccaactacacagcattttaccagagccacgttcatgagggattatttcatttgattgtctggttattaacatatatgttgtatgtgcaagtttttcaattactcaacagtgagataatgttgccaaataacatggtattatatatttatttaatgcatcatttgtttcctaggcatttggaattcatcttttgttggtttttctttatcaggtgaacgcttaagcccgtgggtagctcttgggtgctttgccatggggatatccactattttcttctgaggccttcatgattttaatccaggctgcagaagatttgtaggaagaacagtgtgattattattgcattgttttttgtgtttttggaggagcttttgtttcaattttagctgggatgtggagatacgactatggcaagtgccagttgttactctcagggtggtgcccttgtcaggaaagaagtgatactatggttgcaccatttaatggttatgttgtgtattgaactgtttatgtgcacatggcatgttcagaaaatgcttaaatgctcctaacaggatattgctatttctcagattctgcttaatgctatatggatgcgcaggtttgctgcactgtcagcataattgagcagttaaatgtactagataagatgtacttcaagctgatcgtttgtctatataccctaggcacaaccaatgtgcatgtgtgattttgtcaaggatgcaccattgagcatgtgtggttttttgtcaatgcgcacagccccgaccttggttatagggcaaggtcagagaagatatggtcatccatgtttcttagtgacaggctgggtggatggaatgagctgctccaatttttctttagggtggatggatgagaatggatagaataagaataatatactagtattaattaataataacacaatttattaattacttcctcgtttcataatgtaagttattctagcatttcctatattcatattggtgttaatgaatctatacctagattcattaaca

SEQ ID NO: 67359 - DNA, 2898 bp, Oryza sativa
accacaggaaaaacgatacagagatcaatcgaccaacgcgagcgacgactcatcatccaaaacgcgagaggttattcacatttcacagcgccctctgcaacaatgtcgccgcaaaggaaaaaaaagaaaaagctaaggcagcaaaagaaatcaagaaagcttaagctaacaccaaaacgatcgagaagtgaactaatagctagctaggaaatgataatatgtagtagtagcagtagtagactagtagtagtaatgtaggtaggaaatcagatgcctggcctgcccttgtatgccgcggaatggatacgttttaggccggtttaatccctcgaccgccgccgcattgccgtgtcaggtgtcaccaccaccaccagcagctgctgctcatcatctccgttctgcgagatggatcggagtaggaaggcggccatggcgaaggcgaggagctcctcgatgaagcgtcggtttgcatggagaagaagaaaggaggagatgtgtggtggtgttagagagagagagagagagagagagatagagggagggagctgtgggcgatggtgtccaggcaccggcagcaaggcagctgcgtcgtcttaagaaagagcagaaatggcatggagccctccaaagcatctgatggctggccctgtatgcgtatttatttatgtaggggctaaaggcatcttttcgcaagacgtacactgcacactgctctcattttttgcaagacgtacgctgcacactgctcttatttgagagagagataagagatagagagagcagcaacagcagcagcaattttttctttaaaaaaaataatcgaaaacgcagcaaattctaccactccctcagttctcagatgcataaggttcacaaaaccgtttgctgaccgaaaatcgctcagtgttggttttgtcagttttggcgaaaattgtttgaaaagagatggaattcagataaattgtcaaaattttaagattcaaattgatactccaacagtcaacagagtggtttgtcaactcaagccagctcaaaaccacgaaatgtcgtgaaaaccaagtggttttcgtcggttctatgaacctcaaacgtggaactggtgctcttcgttgcatgatgaggcagcatcgccaatgtgaaaagagaactgaaatattcatggttgatcactttcagcattctccaacggaacaaaggcattgtttagttccaaattttttcttcaaacttcaaaacttttccatcacatcaaaacttttctacccacataaacttttaacttttccatcacatcttccaatttcaactaaacttccaattttggcgtcaactaaacacacccaaagactgattaaaacaggtgtcatacccgaactgtgtttagttcacgctaaaattgaaagttttgttcaaattggaacaatgtgacggaaaagttggaagtttatgtatgtaggaaagttttgatgtgatgaaaaagttggtagtttgaagaaaaactttggatctaaacacggcccaaatctgctagtagagcatagagatagattggtgaaaagagtactgtaaacaatgaacagggattcttgggaaaccagatctctccacaatattatgttatatacagctcatgaatggtccagagcagcagcagattacaaacgatgccagtacattttgacaggtccgggaaacaaagtgaagacattgaaatcaaagtatactaagagtacaagaaatgcccaactagtgacctatgtatagttttttccctgtcgtatgtatagagcaaaattaaatgaacaaacggcaactctatctatctgtatctgtatctatcatgctacctcaaaagtaggcttggaacagaagcaggaaaaaaatcacttctggcagcaaacgttggacaccatgacggtactagttccaccataataaaaccgctatcaggacagaagaacagcccgtgtaatcatcatcatcctgccacaccatttccattttctgctggcggggcatttgaaatagcatcatatgtggtcaaattggacatactatcagatagcgaattcacctcttctccctcagatgcagctgttattgaagcagcgtcctccgaagcaatatcagaagctgcatccgaagccatactagatggctctgattgttctgacgtttcagattgtgactgtggttgcttctgtagactccaatacatgatgctagccgtaagcgttaggatcatcttctgatttacctgaaacagaaacataagagtacgattagtcaacagataataaccatcatttttcaagataaaagagaagaggatcacagacaacaaataatgtagacagtaaagcatttagcccagatgctagataaattgctgaaggtaaagcatttaattccatctgtgatggtaaaagttgcacgctcaatttcatgcttattagcatcccttacctcaatgatgtcctctggcagcagaaacacggaacatccgattttccttgcaacactaatggtatatgtagcatttagcttcttttcctcatctgcagaattgaaaggaaatagtgaatcagccaatgctacggttttccaaaaggatacatatataaacagtcagaaattatcatcaaatagtaattcaaacgtgcatatgaacagaccatcttccccctttgtaacaactttccagttgacaaccctcggttgtactgcactaagaagttcaaggaaaaaccgtccatttgataagctcttgtcctgagagaagataagaaaatttattaactggagttatctaacaacaaattaaaactaattaaacagaaattaataacaccttgaagctttccatttgagatgttcttcctgatgctttcactttgc

SEQ ID NO: 67360 - DNA, 6538 bp, Oryza sativa
aacgttgcaagtaaaaattcaaaatcccttatattgtgggacggagggagtagtacctaagaccaaatacaaacatattactcataatacaaggttagtataaccgttcgcaactctctcgtcttgcagtatatatgctccctctagtcatatagtagtaatactttagactatgttcggttagtcccgagagaaagattaaaagggatttatttcacacctattatggtgtggaattactccccctcaaacccctccaatccgctttaaccccctccaaaccaaacaaggccttatgttttgaaaataaaataatcaaactttataacttttgtttctaaaatacgaagaccatacgtaaaattagttttgtataaattagttttaagaagtacttcaacatccataaaatcatatatctattgttatttttatttatactatagtagaaaataaaggctattgattttttatatttatactgtagtagaaaataaaaagttacagttgttcttttaaggccgtttcgttatcaaccggagggagtagcacacatccaagcccaccgaaaaacgccccacgcagaaaccgggccctataaggttattgcaggcttgcagttatgacaattgacaagaacgatcactaaatcctgggctacaagagccttcggtgtgcgctgaaaaggtcagattaacactgaagcttcgcccaggttaatcgtgctcgaagttgcacaatgacgaggtgaaaggggccaaaacttcttttcccggttcgctggttttttaagtgccggcgggcgatgggaggtggacgactgtgctgtgtgcagagtagtatagagaaaattgattagcgtacaaaattgacccattgcatagttgtacaaaatcataaaagagaacagggtcgatgttgcaggaaagatctgaaatgtaaatgaacagagatagaggaaattagtgacgaatgagacgaagacacatcatccatctttattcatagaatccacagcaacaagagagatacaaacacacacagaccaatgtatgatacaaatgaataagaaataaacacaacatgcctcactcggaaacgcacccaacccaaccactgctactagtactactctatagccggaaacgactcgaaacgagccgtgtccaaatcggagatcatcaacgaaccaattccatccatcaccacctcgcgcgcctgcctagtgcatgatcccacccgcgacgaggatggacagcacggcagagcacgccacggccagcgccgccgacgccgcgccccccgcggccgcgcccgtgaccggcgccggcgccggtggcacgcccccgtccacctgcgccgacgccaccgacgcgaacatcacggccaccgccgcggccacggcgaccaacacggcgcctctagatgccatcgcaggaatgaccgagcacggcaagcgacgcagaagcacctggcagggagagagagagagatagagagagcggtgaaacggtagcggcatgggtagtggggtatatatcgaggtggcgcgcgatgacgcgatcggaggctgccgccccgggcgcgcggggcgcttggcgccgtaggcgcgacgcgtggtgggcctctccgcgacacgttgggctcgagggtggcgcaggtggcgcgacgcgaggcggtctcggcgcgggcacgcgactccccaccccaccactcgtcgggtctgacgactgacgcccacaacccaaccgaccggaggccctctgattggcgaggccccaaccgcaacgagtcccctgcacgactcgacgaccccggctaaaaccgacaccataccattcatcagccgccatgctacgccaagcacaaacacgtattaatcccggctaaaatttacagcaatactagtcgacgaacgatacgtttgtagtactatataccacttgtaatttgcgatgactagcagtagaatggtaatttaacgtcgagtacgaggcgtgtctcccacgcttttttgctcgggggtcaagggtcgttgtcgtacatgtacacgtacgttcgtgcgccacgcagtgacacacaccacaccatgacgcacacaaaaaaaaattaaaagctgtgcacatgatgtgtagggagacgtacaagcccggctacgggcgatgcacagggccacctgccgtatcgatcgatcgatcgatcgcacggtgtctacctccaaagtcgtcgcgcgcggatgcgtacgctgacgctttactgccacgattcctctcgttggctcgtagcgcgtgcgtccgcaacgaacgttccaacgagcagccgagccgactagtaaaaaacgtagcgtagtgtgtgttggggtcaatcacggtacatgcgcccctgtcccgcagaagatgtcacgtatttttttcgcgatagagacaggaggcgatcgaccggacgtgtgaggttgtgaccgtgaaatgtgcctagcacctgcatccatttcatcggtccttccttcgcaagagctgtacgctacattggctacaaagagaagataaaaaaaaaagtgttggtacacctaaaagtccattcagtttcgtgctgagttttctgaactgggtctgaataatgcaagagccgcaaaaaagaaaaaaaaactcgaagtgtctgaactgaacgtgcggcggaagccggtcggcgccgtcgtcgaatcgatcgatcggtcgcacggcggaagttgccagggcgaaagggagggctcagctgcaggtagagagcacgtccgtctcagtagtcggctcgcgattctcagcttgtggccgtggatgcgctccatcgattcgatcttgtaacacgatggcatgtctcgatcgacaatactggaacgatctttaggggatttttatcactcgggtatatatgcatatcatcgccaagccggccggtagatcaggagttagtaattggacttaagacattctgaatctgttctgtccctcgttttgccgtgatcgccagcgtcgatggatgggtcgttgatttttgcgtacacttgtcggtagcacaagacttcagccgaggtaaacagttaagatcgtctacagaattacagataacttgtcgccattgcaagttagcttgaaaagtagttgattcgtacaaatacacaccaaaccagcaagacgacagtgcgaataaccaggacaatacacgagtttctggtactgcccttgttacacgaaaaatattatttctggtagtgtacttataatgtttcactatatatagatctaatgttgcaatgaattaaaatattattttttaacaaatcacccatatattttggaaaccctctattaagataatttggtttattttttgttccacaaaaaatgtttcacctagtgtactcacaatatttctctatgtataaatctaatattgcagtaaactaaaatattctattgcaacaaaaaaaaaactcacatattttggaaactccctattaagagaattcgtttcattttttgttccaccaaaaaatgtttcacctagtgtacttataatgtttcactatatatggatcaaatgttgcagtgaactgaaacattctttagctatttgctgaaacattgttttatataaggtgaaacaatacccgatttaagcaagtgaaacattttcgatctacttagtgaaacaattccgatatacctggtggaatatcgtgcaatatttaaaaataattcaataataagctaatttttttcatcggaatatatccatgtgtagtcttattttgaagatttaattgcaacaaatttaatggtgtaatcggatcatgatttggataagtaatttaagagaaaaatcaatttaaaatagttttacacgtaaatcggataatgacgttagcaccgattttaacctcctcccatcatgcgcccgagccggagtcacgtcctactcctacttcagtgtgattgtgtgaaccaaatacgttgtataacggagaagaggcaacataactgaaccggagacaacgtctactatattgatactaaccagaaagttaaggtttatactgtccataaaaatttacttaccggactatactactcattctaaatactttagcatatattaagttttttttaaaaaaaaactataatactaatgatagtatattgttaggagggtacaaggacacatacaaaggtttctatttgctatctctcagttaccagcaaaacaaaatcgttgacgtggaaaagagaggagaggagatagatgtagttgttttccatgacatcggccaaacaacaactttggcgagcaaaaacaacgaaaaatcaagtgttctacatcgtggtatttaacaagaggcggccttggatcccatgggtgattggatttttggcaaggaatggattggtgtcgcataaaatcgacatcgatgcaagctaccatttaggagttgcacatatttggggaaagagggaggagtaaatccactatttatttatttatttatttattggggggagagggatttgaatggaaggtgatagatgagtgataagtattttgagagacactttaaatgagaaaatgggcatttggtcacgttccaaaaatggtttcgatggaatgccatcccgaaaacacgtttcgctaaaatgccaatatggagcgcgtgatcacagccactttgttattttctccatttttgtcattttcaattccattttcgttggaatatggcttgatgagaccaaattgccccctgctcaccgagaccagcggtcctttcctctaggtcatccacccaggcctcgtcgccggcggcggcggcgaccacgccgtcctcaatgcgcaggagcaggtcttgctccatgtcgtccaacctcttgacatcgtccatgtcctcgacgagcaggagtaggtgctccggcaccgcgttttcaagagtctggacctccttgacgccgcgttcctctccagcctctacggagacgcgaccgggagcgtgtcggtcctcgtccccaccacggccagcctcatggaggcgctggggagcgcgtccagcaggcgcatgcgtactctgccttatctcggacatcatcggcctacgcgagccgccgctcgtgccggattccttgctgggctagaggcgactgggtggatcaccgtgcgcgcgccggcatacgtcacgtgctgggcagggccgcgctacacggaggcgttggtggcctccccggacgccgccgcgctcgacaccgttgtgttcacctccaccgccgaggtggaagtcctgctcagggggctagacgctgcgtggttcttgacgctctcgcctcgatgaggagctccgccgcgagcaagtcgccgctcatgtcgatcccctttcagccggtgagcggcaatttggtctcatcaagctgcattccagcaaaaaaaatggaattgaaaatgaccaaaaaggagaaaatggcaaagtggttgtggtcaggcgttccatgttggcattttagcgaaacgcgttttcggaatggcattccaacgaaaccgttttttgaacgtggccaaatgtccatttttctcattttaaatactagaaaaataactatttttaagaggaaggtactccatccgtttcacaatgtaagtcattctagcatttcccacattcatattaatgttaatgaatctagacatatatatctatttagattcattaatattaatatgaatatgaaaaatattagaatgacttacattttggaaaggagcaagtagtacataactaatacaagattagtagattacacctcaatttgctagtttgctcacgagaggtcctgtcttcccgactgaactgtgaactcccagcacttcgaaattaacaatagacttgatttcaaatctgaacaaacgatgattagtgaccgggaggcagctgttggccgctgtcccggtgtcccctacattcattcacgcgcggccgtgcggcaccatgaatgcatgagaccatatgggcggagagtcgggttgatcgagctccgccccagggatcctcgcggatgattgatgattcttccaccgccgccgaagggtcacaggactcacaggtgctgtcgactgtcgtgctgatccgacggcttccagtaggattacccatacagaggaccacatgaatatgaattcgtgcaaacgaatccctaattcgaatcgctatcaatcgtacgcaaatagaacccctaggatcgggtaattcggtacaagcgggagcggtcctaacttatgcatttaaatctccgatatttatgcaaatcagtctcttccataccgattcgtcgcccttcttagacagaccctaacgtttcggtcggcagcatctcgccgccacgcatggatcgagctgcttcaacctgactgtggcggtgtgccccgccgatcgaccaataaccgcaaccattacctttctgtgttaaaataatctacaactaaattagatataacttgatactacgaaccataccgatattcg

SEQ ID NO: 67361 - DNA, 1730 bp, Oryza sativa
  unsure (1)..(1730): unsure at all n locations
tggggcagggcgggtacggcgtggtgtaccgcgccaccgtggtcggggaagatggccggagcacggacgtcgccgtgaagcagttctccggtgcaaacaccaaggggaaggaggatttcctcgccgagctcagaattatcaactgcctccgtcatcgcaatctcgtcaagatcgtcggtaagcgatcatttctcgttctggttaaccgaaaaggatacttagtttagattgaagttgtgattagagtattagattgggtacggtttgtctaataatttggagtaggaaataatattctgagatggcacacaagttggcacggcaaatagatgttttaagaagctcaccacgctatgtggcaacttgggccacttggcagctaaatttaaaattgaatcatcagtccatgacgtctttgcaagcagattgaatcataagatagatattggagtgctctggttgacaatatgataatgcaagatttgatcttttgcttgcattgtgttagaagaaatatagcgttcgttagttggaacttggaacagccatgcaaatgcacatctctctctatatatatatatagtttaattagctgccaattcaccataagaggagacattcatatcccaaaacaaacaccgtacgttcagtcttcatttttcaaatttcaaaatgatacgaaattctgtaagcaagttctaaacacattttggacgacatgcacgtctgcaggttggtgccgccaaaatggcaggctgttgctagtgtacgactacatgccgaacggcagcctggacaggcacatcttcggcgagccgggcgcggcggcgctggactggaagcagcgctacaacgtcgtcgccggcgtcgcgtcggcgctgaactacctccaccacgagtacgaccagatggtgatccaccgcgacatcaagccgtccaacatcatgctcgactccgccttcaacgcgcggctcggcgacttcggcctcgcccgcgcgctcgagtccgacaagacgtcgtacaccgacatcatcggcgtcccggggacgctggggtacatcgcgccggagtgcttccacaccggccgcgcgacgcgggagtcggacgtgttcggcttcggcgccgtcatcctggagatcgtctgcggccgccgcatctcctgcagcaaccccgccgggtgcagccagctgctggaggccgtctggaagctccacggcgcggcgggcggcggcggcngcngcggccgcatcctcgaggccgtcgaccagaggctcgccggcgagttcgacgaggccgaggccgagcggctcctgctgctgggcctcgcgtgcagccacccgaaccccggggagcggccgaggacgcaaaccgtcctgcagatcctgacgggcgccgcccccccgccgcacgttccgccgtcgaagccggcgttcatgtggcccgcgatgcccgtcgcgctcgatggcgacgacgacgacgagacgtcgcgcagcagcacggtgatgaactcgtcgtcgtcgtactacgtgtcctcgtcgggttggacccagaactaccaggtcagcaaggagcacgaggtggcggacagggacgtggcgacggtgtgaccgtagacgagtccacggcccacacgtgcggccgggacccgacccatcgcatcggatttggcacgttaccgtggagttggtgacaacgttgagaacaaagatgggacgggggctgcaggaatt

SEQ ID NO: 67362 - DNA, 2014 bp, Oryza sativa
acaaaattgaggagaaagagaggtatagtctgggaagagagattagacaagaggaagcaggagattgggactagagaatagcaattgagaggggaagcagcagcaaggaggaagaagctatcgcctgaggcgttctggtaattgattcatggggaaaatccaaatccccccttacaagtcactgctctttatactctccccccacaactcaatattgttcaaaacactacacataaattaatttctcttccaattttccacccctattcggttttcacgctttctcgtgatgcgctcaatttctcgttatcgtgggcctacagcgcagcccgcgggtagagttgcctcgtgccacattggcggcaaaagcgcgcgcaccttcttccactttccatctttccctgctttaatttcgcgatcgctactgcaacactaaggcagcgaaagaacagcggtacaacggcgaagtacgacgatgatcgcatagtacagagagaagggatatcaaatctcctgcccggcaagagaagtcgtagaaggaagcactgaagcatcctgtacttcgatcacctcgtcaattcattctacaggttccttttttctccctggttttggtcggatcatgttttatgcatgtaattgttgtattactagattcagataatcgaatatttgctctttgatttaggttgcaaaccaataaattggtataatctctgcagatgggtcgaactagtatttccttcattgttcatactggttgtacaactggtggaagccctaggaaatctggtggggaaaggaattgttcatcgatctatcttttagacagggattctctgaaattcatcgatttggaggagtcattgcttatacatggatatcaaaaaggagatggtgtatactacttgaagccttcttatgtccctccacaaggtcttgtactgattctaaatgatgaacaaatcaagatgatgttggatgatcataagacggaaacagagtgctcactgtacatttttgcgaggccgcaggaattagtgactgataatggaagcacatcaaggtttttaagcccaagtagtatcccattaatcggacatcataatagtgtcccaggtgattttgataaagatgatttgacattgcatgaagagtatgtacagcaacagttgagggaaaagaaaaaaggcaaggaacctgctattggcaaggagccagtaatgttcttccaaggagactctgatactgaggacctatatggtactagccagatagatgcagaggttaaccaagcagaaccacatccgggaaaaactacacaggaaaaagaactagtagggaaaaaaactaacaagagaaaagtgaaggatataggccaatcagctgaggtggattatttgtcagatgagcccaatgatgacacaatagatttcaatgacgaagcacctatctatgtgcacagatcaagaggaattgaagatatcattttttatgagtccaccctacggcgtccacacatgcaagttggcatgttgttcagtaatgttgatcttttcagagctgctttgaagaatatgatcatcaacgaggggagggaggtgttcaagggcaagaatgataggaatcaagtttctgtcaagtgtaaggcagataattgtccttggtacatatatgcttcaaaattgcctggtgaagacacctttaaaataaaaaagtatgtttcaaaacataactgtgggaaatcacacaatatagcacagctttactggagatggcttactaatgaatacatggaattctttagatctgacaagaaatgggatgcacatgcctttcaagattgtgtcaggcgagataccaatgtagaagtcagcataagtaaggcatatagggcaaggagggaggcctacaagaaagttatgggcgatcatgatttgcagtttaaaagaattcaagattatgctcatgctgtgctatctgctaatccgggaagtaaagtttttgttaagtg

SEQ ID NO: 67363 - DNA, 63629 bp, Oryza sativa
  unsure (1)..(63629): unsure at all n locations
cgtagcgttgtcctctccggccatattcccactacagttctcctacccgtctgctatggtccacgcctgttctcatatcatacctccgtacgcaacggctgtgtgccactcctccttcaccctgcacgtccgctggggccacctgccgcgcggaagttcaccccatccccgtttaacgtaccagaaccattaacgttcgaccgaacgaaagctaagacgcgccgtcaccgtacgttccccccataccgtgatcgagctcgagaccgatcgatcgaccgagaccgacaacgacccctccaatgtacgttgccgcgagaacgtgatcgagatcgatacccgttcgaccgtccgtaagcgaagaccgaactcggtcacctgtactgttgccgcgaaaaccgtgaacgaggatcgataaccgatctaaccgaactagaggcgataacgagaacgatcgacccaagacaagtgagaacgagggaacgaacgtgtatgagaacaagcgaccgagaacgagcgaccgagaacgaggacgaacgttaacgtgaaatgcaatatatatatatatatatatatatatatatatatatatatatatatatgtatatgtatatgtatatgttacttcgcatttatcctaatacatctttttgtatcttgcagaaaagacgtgttgtcggagtcgtccgtcaagcctgagtggaagagctagccctagaaggaattggcgcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcagacatgactattttagtcttagcatgtaatattatttgagttttaatataagattactttatttgtaattagacttagtatgtataattattgacaacggaattagtgcgacaagtagcaattgactattgtagtattaattagacttagcatatacgcacgaaacacttagcatagatgactattttagtcttagcatgtaatattatttgagttttaatataagattactttatttgtaattagacttagtatgtataattattgacaacggaattagtgcgacaagtagcaattgactattgtagtattaattagacttagcatatacgcatgaaacacttagcatagatgactattttagtcttagcatgtaatattatttgagttttaatataagattactttatttgtaattagacttagtatgtaattatttactagctagggttgtgtaatatacgtcacctagacttagcttatatcacgatttgtaattagacttagcacgtaaggttgtgtatggttgtaatgtacgacatttacacttagcatacatgacttagattgttaaaacataaatgtctcgtgacttagcagatgtttcttgtatgaacagatggctgaccgcgatgaggaacagatattgtacgatgcaatcgcggagggaagcagccagtactggaatgaagaagtgtcgcgacccaaatcgactctaaaattcatcctcgaaattgtgcaaagaataattaaaattaatgtgaaagcctccaacaattaaaatgtgcaaagataaaagtcaaatggggcttggaggatttttgtatatttcctaaaagcctaaaatgcttaaataaattttagtggaattttcagagcacaaataataattgaaaagaaataaacaaagttaaaaaggttttataaaaagaaaaccctaaaagaagtctgtttccccccccctttccctcttgggccggctcggcccattccctccctccctctctctcctctcccgcggcccatcggctccccgcgcgcgcgcgccgctgacaggcgggcccgcccgccactctcgctgacgggtgggacccacctgtcatccccctcctctcgccgcgcccgccgccagcgcccgtgccctagcgccgccgccgccgcgaatcccgccgctcccggccgctccgcgtgcaatcaagaggggggatttactccccgtaatcccctcccccgtttccccctcttttccctctctctctccctcggattcgctcggaatcaagcccgaaatcctcgccggcgtattcaatggcggccgaatcttccgcgcgcgattcctccctccccggccgctctttccttcccccggcgctatttaaaccctccccgagctccgcccttccgtttccgccgctcaccgctcgctctcgccgtcggaatcgtgctcgcaccgtgctcctctctctccgccgtcgccgccgagctccgttccgtcgccgccgtgcttcggttagccgccgccgccgctccgctcttcctcccgactcggcgacacctccctcggcatcgccgcatcgccgtcgaccccgtccgcgcctccacttcgcccgccgaccgccggagcaccgtcgtcatcgtcttcccgaaccgcgccgccgccttcttccgcttcggccgccattctcgtcgtcgtcgttgtcccggcgtgagccgaagaccgccgttcgccttccccctttcctcctctctctcgggtgccactccgccgcgccgttggtcgccggcggcgaccatcggggcgcgggtgcgcgccactcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtctgcgcgccctctcgctcggctgacgcaataaatgagtttttaattaaaagttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagatgaaacaaaacctcaactagtgggtactctattcatgggtccactagtatgaatttaggtagatgcttcgctgattaattagtcaacattaggtggttttataactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgggctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagacgtgtcttgtgggtaaagatgtacacctctgatcagagtaaatctattcgaatagccgagccctcggatatgggcaagccgagcaatgtacccaagtcagtgttataattcttaaaattttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtttagttctaggatcgtgtttacaaaatggccttgagcaactaaatgtctttaaatgctgtttactgcaaccctaacccctctatgttattattcctttgtactcccttgcatttattctgcatttgtgggtgtgtcttgttgagtacggtggttgtactcagtcttgcttaattttcccaagcccagatgaggagctccttgaagatgaaggctttggtgtctagctcgtgcctgccgtcaagcgcctgtggtcgtcgccctagtcttccgctgtttttcgttgtctttgtgtgtgctgggccttcgctgcccatgtaataattttatatacgcttccgcttgttaaactctgatttgtatcaacttttggtgtaccttgcctcctgggacaaggaataatacacgcacgtcaggaacgcctgttgggtgatttccggtcgtgacaagttggtatcagagcctcctttgaccctaggacgagccgtagatcccaagccttagcaatattttcaaaaataaaaatcctttattatttgtgaaaacccgctattctctctttgtcttgctgcttcatttatcgtcaaaatctgatcttttaaatgttgttttcccttttgtttttgtttgtagatggccggcagcgttacccgtcgtggtttgcacatgactggcttcgtcttggagctgcgaggcatgtgcgtggtcttggggtatccacatggagtggattaccaggccaggccgcttccggatcaggagggtgaggatgcagagcctcacgctggttgggaggtcactgcagtgatcctctccggctctcccgagcggacttcactggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgggacgccagctcggaggatgacgctaccgtcgtgcatctggcacgcatggtggaggcgtacgacgcggctcgtatcgacttccatcagatggtgcgtcgtggcatggtggagaacaacatgaagatcctggagctgcgtcaggagaacctgcagctcaagaaggacctcgacgcgttggaggcgcagctgcatcagctcaagatcgcccagggagagatctgccgccccaagcgtcgccgcgtctgccgcagccagaagatcaccgcccgcaagagcacctccaggcctgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcttgcgcgtgtgtttttcctcgtttgtcttcttgagtcgtgtggggcatggttacgccggtgtgtggtgtaactatgtcggagcctgtcttattttgtttgcctaagcaacttgaaccttaatgaaccaatttaatatcagtaataaatttaagaataatggtagtcgtgggtggttagttttaatcgtcagctctccttctctgtttgctggttctgtgtggggttttcagatggtgacgaccaggagaaatgttaacaccggtgaaggcaaccaacccgaaggcagcaaccccaacccccaaggcaatccacctccaccaccaccaccagacaccaacgccattctcacccaaatcctcgcccagcaagccaacatgatgaatgctttcctccaccacctccaaaacccgccacaacagaatgctccaccaccacctccccaacactccaaactcgccgaattcctccgcatccgcccacccaccttctctagctccaacaatccagtagatgcgttggattggttgcatgccgtggggaagaagctggacactgtgcagtgcagtgatgaagagaaagtcatcttcgccgcccatcagctgcagggacccgcatctctatggtgggaccatttccaggccacgcagccagagggacagcctattacttgggcccgcttcaccgccgctttccggagaacccatgtgcccgctggagtcgtggctcttaagaaaagggaattccgagagttgaagcaaggcaaccgctccgtgatggagtatttgcatgagttcaacaatctagcccgttatgccccggaggatgtgcgggaagatgaggagaagcaagagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctcgcagcagcagcaacagcagcagaatcagcaagggactcgtgcgccacgtcctcctacgccaactgtgcagcccgttcaaggccgcagggacgcttcaggtccgcagcggctgtgcttcaactgcttcgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttccccgttcattccatccccgctacaattttgttcgactctggagcttcccactcgtttatatctgtgccattcgtggaaaaaaatcagttgggggtagaaaggcttagaaaccctctgctcatcaccacccctggcggggttatgacggcaaagtattatagccctgccgttcctatagaaattcaggggattccttttccctcggatctgattctgttagacacaaagaacttggatgtgattcttgggatgaattggttggctcaattccaaggagtagtggattgcgcgaggcgcactgtcactctgtaccgaggaccagaacaaccggttgttttctttgcacctccaacctctgtcagaagttcagaactgcatcagataggtctgtcagaaatccccatagtcagagagttcggagacgtgtttccggaggaactacctggtatgccgcccaagcgagaaattgagttccggatagatcttgctccaggaaccactcctctgtacaagcgaccctaccgtatggcagcaaatgagctggccgaagttaagaaacagttggaagagttgaaagaaaaggggtacatacgtccgagtacttccccttggggtgcccctgtgatttttgtagaaaagaaagacaagacgaagaggatgtgcgttgactacagagctctcaatgaagttaccatcaaaaacaagtaccctcttccccggatagatgatttgttcgatcagcttaaaggtgccactgtattctccaagattgatcttcgttccggatatcatcaattacgtattcgtgaggaagacattccgaagaccgcattcactacgcgatatgggctgtatgaattcacggtgatgtcgttcggcttgaccaatgcacctgccttcttcatgaacttgatgaacaaagtgttcatggaatacttggataagttcgttgtggttttcatcgatgacattctgatatactcacaatcagaggaagaccatcagcaccatctccgtctggtgttgggaaagttacgggaacatcaattgtatgccaagcttagcaagtgtgagttctggttgtccgaagtcaaattcttggggcacgtgatatctgctaaaggagttgctgtggatcccgaaacagtgaccgccgtcaccgattggaagcaacccaagacagtcactcagattcgcagtttcttgggtttggcaggatactaccggagattcatcgagaacttctccaaaatcgctcgacccatgacacagttgttgaagaaagaagagaagtttgtgtggagcccgcaatgcgagaaggcgttccaaactctcaagcaaaagctggtttcctcgccagtgttaatcttgccggatacccgcaaggacttcatggtgtactgtgatgcttcgcgccaaggattggggtgcgtactcatgcaggacggtcatgtggtagcctatgcctcacgccagctacgacctcatgaaggcaactaccctacacatgacttggagctagcagcggtggttcatgctctaaaaatctggcggcactatctcattgggaatcgctgtgaaatatatactgatcacaagagcttgaaatacatcttcactcagtcggacctgaatcttcgacaaaggagatggttagaactcatcaaggattatgatgtgggaattcactatcatcctggcaaggctaacgtggttgccgacgctctaagtcgaaagagccattgcaatactctcaacgttcgtggcattccacccgaacttagtcaacagatggaagccctgaacctaaacatagttggtcgtggatttttggccgcgttggaagccaagcctaccttgctcgatcaaatccgcgaggctcagaagaatgatccggacatgcatggactcctcaagaatatgaaacagggtaaagccgcaggtttcacagagggtgaacacggaaccttatggaacggaaagcgggtatgcgttccagatagcagagaacttaaacagctgatacttcaggaagctcacgaaagtccttattccattcacccgggcagtaccaagatgtacttagatttgaaggagaaatactggtgggtcagcatgaagcgggaaattgcagagtttgtggctctatgtgatgtgtgccagcgtgtcaaggcagaacaccagcgaccggccggacttctccaacctctccaagtgccggaatggaaatgggatgaaattgggatggatttcatcaccggacttccaaaaacccaaggtggatatgattctatatgggtaatagtggatcgattaaccaaggtagctcgatttattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcgtatcacccgcagacagatggacagaccgagcgtctaaatcagatcttagaagatatgcttcgcgcatgtgtcctggacttcgggaagacttgggataagagtctcccctatgccgagttctcctacaataacagctatcaagccagcatacaaatggcaccctatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgacgccgtgatctggaattcgcagtggatgactttgtgtaccttcgagtcacgccattgcgaggtgtgcacaggtttcagacaaaagggaagctcgcacctcggtatgtgggtcccttccgtatcatcgctcgacgcggagaagttgcttaccagctggagttgcccgcctccttgggtaacgtgcatgatgtgttccatgtgtcgcaactcaagaaatgtctccgagtgccatccgagcaggccaactcagagcaaattgaagttcgcgaagatttgacctatgtggagaggccagtgaaaatcctggacaccatggagcgcaggaccaggaaccgggtaatccgtttttgcaaggtccagtggagcaatcacgccgaagaagaagctacttgggagcgcgaagacgagctgaaggcagcccatcccgatctcttcgccagttcttccgaatctcggggtcgagattccgtttaaggggggtaggtttgtcgcgacccaaatcgactctaaaattcatcctcgaaattgtgcaaagaataattaaaattaatgtgaaagcctccaacaattaaaatgtgcaaagataaaagtcaaatggggcttggaggatttttgtatatttcctaaaagcctaaaatgcttaaataaattttagtggaattttcagagcacaaataataattgaaaagaaataaacaaagttaaaaaggttttataaaaagaaaaccctaaaagaagtctgtttcccccccccctttccctcttgggccggctcggcccattccctccctccctctctctcctctcccgcggcccatcggctccccgcgcgcgcgcgccgctgacaggcgggcccgcccgccactctcgctgacgggtgggacccacctgtcatccccctcctctcgccgcgcccgccgccagcgcccgtgccctagcgccgccgccgccgcgaatcccgccgctcccggccgctccgcgtgcaatcaagaggggggatttactccccgtaatcccctcccccgtttccccctcttttccctctctctctccctcggattcgctcggaatcaagcccgaaatcctcgccggcgtattcaatggcggccgaatcttccgcgcgcgattcctccctccccggccgctctttccttcccccggcgctatttaaaccctccccgagctccgcccttccgtttccgccgctcaccgctcgctctcgccgtcggaatcgtgctcgcaccgtgctcctctctctccgccgtcgccgccgagctccgttccgtcgccgccgtgcttcggttagccgccgccgccgctccgctcttcctcccgactcggcgacacctccctcggcatcgccgcatcgccgtcgaccccgtccgcgcctccacttcgcccgccgaccgccggagcaccgtcgtcatcgtcttcccgaaccgcgccgccgccttcttccgcttcggccgccattctcgtcgtcgtcgttgtcccggggtgagccgaagaccgccgttcgccttccccctttcctcctctttctcgggtgccactccgccgcgccgttggtcgccggcggcgaccatcggggcgcgggtgcgcgccgttcccgtcggccgcgccggcgaggccgccctcgggcgcgccctcgcggctaccaagtgggcccggcagtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatggtattttttaattgaaaattaaatgaagaaattcgcaaatatccatttaaagagcatataatcttcaaatggccatatcttggccatttgaactcggaattggaccgttcaagtctctaatttttccttaagatgtaaagaacccatttttgtgctttgtttctgctgttatgtggagttatttagtgttaaagccttttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagaataaacaaaaccccaactagtggacactctattcatggttccactagtatgaatttaggtagatgcttcgctgattaattaggcaacattaggtggttttataactttagacttgggaaattctcatatcatttggacaccatggaatggttggcttatgttggaagtggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcggagggttggtgcccaatgctaggggctcagttccgtctgcctgtcccgggggttccggccgtaggcggaattgggtcggtactcttgtctaaggctaggatgggttggaaactatgtcacatcttccgtccgtataccgtggtggtatgtggcacgtggcaacacgtgaggaagatgtgtcttgtgggtaaagatgtacacctctgatcagagtaaatctattcgaatagccgagccctcggatatgggcaagccgagcaatgtacccaagtcagtgttataattcttaaaattttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtttagttctaggatcgtgtttacaaaatggccttgagcaactaaatgtctttaaatgctgtttactgcaaccctaacccctctatgttattattcctttgtactcccttgcatttattctgcatttgtgggtgtgtcttgttgagtacggtggttgtactcagtcttgcttaattttcccaagcccagatgaggagctccttgaagatgaaggctttggtgtctagctcgtgcctgccgtcaagcgcctgtggtcgtcgccctagtcttccgctgtttttcgttgtctttgtgtgtgctgggccttcgctgcccatgtaataattttatatacgcttccgcttgttaaactctgatttgtatcaacttttggtgtaccttgcctcctgggacaaggaataatacacgcacgtcaggaacgcctgttgggtgatttccggtcgtgacaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatgtatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcaccgactcctcctcaggatcctgcaccgtctcctcctcatgctccgccagcaccgtctccacctcaggatcctgcaccgactcctcctcaggatcctgcaccgtctcctcctcatgctccgccagcaccgtctccacctcaggctccagcaccgactcgtcctcaggatcctgcaccgtctcctcctcgtgctcctacacctactcccccgcaagctcctcttccggcaccttcaaggtcaagggcccccccagctgcaccgcctgcccacacaagggcaacgaagaaggcgaaagttgacgccgcaaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggctatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagccgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcacacatatctacgaactataccagctggacgccgtcgacgtctctattatgagttgctggattttgtaagtatatcgttcagttagaattcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcacaatgctcgaccaatatccacaagaaacagaggacaatctcgtccatctcctgaaggcccagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggtttcgtcatttggtccgcggcaaatggagagaaagacttaggcggaagttcaaatttcctgtgagtacacatgctctacatttatatttctccgattcaaatacatacaagtgtatattaattagatctctcgttgcttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgttttattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatatatgtatgcatatatatgtattgaaacatatatatgcatggtttatatatatatatatatatatatataaaccatgcagcaacagagccatgaaaaaaaaaaaggtcagctcgatctttactcccggttatttcacccgggactaaagatagcgatctttagtcccggattggtactcccggtttggaaaccgggactaaatgggggttacgaaccgggactacaaagggtttctccaccagtgtgaattagcctattgactaggagacatacgtattagttatcaagaagttcatattttcggtttctctcatccaaaattttcaacaaggatgaaaatgagaaatctattatctattatattatattatattatattatattatattatattatatactaaaagtccattaaccttcctacaaacgctcccgagctgccatgtagcctcctacaaactctcataagccgccacatggcgttctaataaattagaaaaaaaagggtggacccactaattttgccaattaaatctccacctaaaagaaaaaagattcggtatccccaccaccgtacgcacgcacgtacacgtactcccctccacaccattcaaactctccgctattctcctactccttccgtttcacagtataagtcattttagcattctccatattcatatttatactaatgaatctagacatatatatatatatatctaaattcattagcatcaatattaatgtggaaaatgctagaatgacttacattgtgaaacggatgaagtatttttttagctaacttctcctattttatagctagcacttaatatataaaaaagataataatcgattatctaaatctacaaaattctcaagttacatattttttctcatttttttcaactgttgtgttatttatcaattaaatatcaaattcaagatctatattacccatattttgttatttaaaaattaaaaattagatcatgtgacctttatctaattattgagtttttatatgattttgtcagttaaaaaaatagaggaggtgaggagcgagaaggacaaataaatacgtacgtacatgcacatctcacgtacatgtctcacgtacatctcacgcctttttaatttttaagataattctaactatataaaataatggatctctcatctttaagttaaaatcgatagttagactttttttagaatttttatgattttatctgatttattatactgtcatatgatggtttagtagcgtttgtagaatcacacgtggagtgtatatgcttggcgctctaataaattatagaaatcctagaaaatcagaggaaaaaaaaacattcaaccttcaattttcacttaaattggtggatccgttattttaaaccgttggattagatctattaaaactcccacgctgttaatctccatcccgaaaaagaataacgtacgtacgtatcgtacgtacgatcatctcactttctcactttctggaaaaaaaaacttaattacctacgtcatatactatggagaaaaattgagagcagagctactagagccatacccaaatccttctgaagacttctcagactaagactcctattctattcctactccactagctttagaacactactaaattagagagagagctttgattcttcttgcttgaggtgtctcatggagtggaggatgagagggctttatatagccctccaatgatggttgtggcggttggaatggtcggaaatgccctccaaccatcattggggagtgatccaagccattcagaagaaaccctgcgtccaacggcacctgggagggttcggccgaaccatgggctggaccattctggccaatctttggcaggtggcctcctcttttgctcctttggcgatggcagccgaaggagggagggggagggcggtggaggcggcagcggctgcttcgggcacggcggcggcagggaggtcagcggctgcgactacggctctcggtatcggctcagggagggtggttgcgacgacggctcacaacgtcggctcagggagggggcgacaacgacacgggggagggagcagcggatccggcggctgtgttggcagggagagccggatccggcgcttgactccccaccggcggcggcggcgatgttgggaagggtggctctcggcgtcagctcagggagatggatctggagggctcggcggcgtgtctccttctccctctccctcctccaccgccgccagctgccgtcgccaccaccgccgcgggctgccgccagctcggggctagccggatttttgttaatgtgttgatttttgtgatgcttgaatgctcaggtgaatggaaattttttactgtaaattgttgatgtaaatttctgtggattttttagtgcttgggtaaatttctgtgaaatttttgaatggtggagtgttgacagaggcggatggagcggtgtcgctccgtctgtcgtttttttaaaacatggccagcattttgactggcggagtgaaaatgttttttcgctggtagccgtcttaagctannnnnnnnnnnnnnnnnnnnnnnnntgatggctagcttaagacggctagatcttgattttcactggcctttgctttgtggcggctctaaattcagccaacgaaatcccaaaatagccgccatgaaaaatggatttcgtaatagtgttccattcccttcttagtgaagtggacagcgttgacaaacttttgtatggctcttagtactacaagccttcacaagttgtccttcctctctttactgatccggaaacggttacgatgatgctgaaatactttcgcaaactattctttgatcctttagtgattagtatcataccagcaagttccgatgggaagctgatgacatgatagaccaactgcaacaggatattggtgatgatgataggatgatgacaaaggctaactccgacgatgtggaaaaatgtgattttctttttgttgtttccagcaagcttagagctagtgcatataccgatccactgattgggcgatgaacgatcaagccataacagggtcagggtagtaatccaatcaaattacacattacttcatctttttaattgttacactctctttctctctctctataggatagtcgtctttaaaattttgctcatatgcaacatggtgatttaatacagaatgaccatttaagcttctgcagcactttataaacgtaagcaaattttatgagcatctttcccatccttgaaaaggtctcacaaggtactatgaggtacgaggtaccattcatatccaactgtccattacaaagggtatgatgggaagtaaaatctcgacatcaaggtgggattcattcaacgtagcgctgctatggagcttgccatttgtgttgccgccgatctcattcctactcgcctccttccagattgctctgattcgttgagctcgtccaccgacctatcgagctcgcccgtcacgccgcccgtcgtgctcgagcttgtccgcctgtgcactcgagagtcgagcctgctcgtgcttggagctcctcctctgcggcttcgtgctgtcttgattccataatagcttggccaatgaatttaacctggccactgccgaagtgaccagcaagagagagttcattttaaatcaacaaggtagcccgcgcattcgcgtaagtatatatcgtagggctgtatttcaaacactataaagatgggatataagccagagaatatttgttgttaaaaaaaagaatgataaaataaatcatacatcactatatacaatgtaattaaggaaatgtaaattatctagcaataaaaaaagaaaaatatttaccgtaaaatagatggaatatactactaaatatgataagaataagaatatctctcatatttaaataaaaatctttttgtcgtggtcatatataaactcctctattgttcttgcttcaaaagctatgtgcatttttaataaaacaacattaataccactaaaataaattatacattattaatacactaaaaatcatctacaccgcttaacttggtgttcaccacttatttccacatctatgtataaatagtctaaacataccacttcaatcgaataatacaataacaccattaaaaatagacatgaatgtctctctaacggataaagttgactataattgccaaggctttcttatgtaatgccctggaacatcagtcccacatcgacgtagccgtaaccccaaagatcagcctatagcatcatttaacacttaatacactattggcacactcacaaatgattctattagttagtatgtccctttatatacattgcctacattagcctttcactgatgccacctgaactcaaccatatgtatacccttgcagtatttacgatagcatagtgaatactataccctgcattgaaggacggagagggacaacaaggaggaggtgatgaaaatagttataatttttgtcccctacttatttctgtgtagtatttttaacaaaatcgtagtttaaaggctatggacaacacataagtgctggacggccggctttgatgttttttttcttgattagtatttctttgattttactattgatatattagaatattcttctttatactactctggtattgtattactttccgagtatatgaataccaactttattatatatccaaattatattaattatgatgctagcttatctgggaaatgcaatggtgtgagcataatgatcatgtatacgatttctctatgtcatgacgatgatattaggatagtatttggtaatttaagcgtggtgtttagattgctggatatcgttatttggggttatatgctgcgaacatgtcgaggtgggccgctgatggtgacagctcagtacgggtattcctccgcgcatgtatataatcctaagttactttcctggggagggtactcatccgtatttagccctagttggatggtcatgacggattatcgtaagaaactcggcaatcaggagtggcttctcaagcaccacgagggcatttggaaagagggtattagctaaataatcatataactaggaagtatgtataatgtgtatgtatattagaagtataggaatagattctttctattttcgttccacttagcttagatgatttattatgagagtatgcaattctcttgctgtgtgtcactctaccctattcattatcttaaccccttcttagactttgattattacaagtaatatataaattattagtatagctctctctattataatcatcccacgggattaaataaatacgatacccttggaatactctcgggtgaaatactataatggtatattcgtgcgcttacagatgaaatcggtaaccataatataccacgagagtttctgcgccattgctgggaattatatttctagtaatatcgttaagaaacaccaatagggtcctcgacattcgtgcctccaattgtgtcacacataatggacaattcctgaagggaaactcaccagtgcggtgacgcatgaccaatgatgaagccgagccatccatctttgatgcaccaccaccaccaccaccaccgctgccgccgcttccagtgccacttgatagcccgccgcagccaccagctgccaccaaagccacagccgccaccttgggataggtttggatggggatttccggtgtgtgtggcgggagcgacgagtccgattgggtgtagttcaaccagccgcttctagcaccgattgcctgtcattgctaccaaccatctccaccactgccaccatcgccgcctaaggttagatttggggatttcgagtgtttgtggagggagcaacgagtctgacagggtctagttcaatcggacgtagttagggttacatggtgcgatgccaggggcacttccgtcatttcgaaattctctctcctctttttgcctggaaataataaaataatgcctcgggtatcctacgaccatttacacaagttatatgtggaatccaacgcagtgtcacgtttctgtgttgtcttccagccaattacatgattttagatgtccagtagcaaattctgcctacaaattttagctctggaaaacatgccagatgctaatagtatttgttaatttagacctatacttgtcaagcactcaaaaaaaatccatccaatgcatccatacatctaattcatctaaaattcatgcaaaattcatccactgcatccactgcatagcaatacaatgcaaaaaacatccactgcatagcaatatctaattcatgcaactatacaatgcaaaaaacatccactgcatccatacatctaattcatccaaaattcatgcaaaaatcatacactgcatccattgcatccacaatgcataaaaaaaacaagggagaggaagtgtacctgggaggaaaggaggccggtgggggcgggcttgacattggtcttgaggatctgagaggcggcggcgtggcagcggcggtcggcgaagcggccgcgacgtctgtcttgaggacttggcggagaggaagccggcggtggcggacttcgagaggaggccggcggcggcggtcttgggcgtggaggaggcgctggcggtcggggaggccggatcttgaaccgggaggcggcggcggtggtcggggaggccggatccatgagggctcgtggacgacgagggaggaggaggccgtggtcggtgaaccgggagggcgacggcggtgtcgaggaggacgaggcggcggtggcggcgtcgaggagaaggaggcggcggtggcagtcgggaggcgacggcttggaggaggaggaggaggcggcggcggtggatgtgagagggtgatagagtgagaggcggcgtcggcggtggatctgagagagtgagaggcagcggcggtggaggaggaggaggcaacggcggcgtcgaggaggaggaggcggcagcggcggtggatctgagagagtgagagagttagaggcggtggcggcggacagaacggataaggacccgtggatgaggattgactaagtaaaccctactcaatcctcatctctatcgggcagagtactatacccgatgcggatgacactcatccgtgacgggtgctatttctaagcctgatacggatgacactcatttatgatgggcattagtactaagcacgattgagatgattacatctctatcgagcatagtactaaagcccgtcatagataacttattaaaatagttttaaaattatgataagttataaaatcatttataatcacatataattaacaaatgtcttatttacatagtttaaaattcctagtaattttctaaagttcatataattaacaaatgccttcctcacatatagtttaaaattccttttaatttttaacaaatgtcttatttacatagtttaaaattcctattaattttttaaaatcatataattgacaattggctttctcacatatagtttaaaattcctaacaattttttaaaaccacataattaacaaatccatttcttcaaagagttttaaatcgtaattaactggaatggcatgaaacatatgcaattcattcattaaggctccaatacaaattaaatacatactgataccaatttggaaattacattactacaaagacttcatttacagtgatatgcctttcgaatggtttgaacgaacgtacaccacgttgcccaggcatgtgatgggccgtcagagatgagaggatatgtactagtgtttagacctatacttgtcaagcactcaaaaaaaattcttaggataactgaaaggcagcaaattaaataaactagccatttttctatagtactagttggatgcccgtgcgttgcaacgggtatatatacatttgaaaaatcatcacttaaacaatcgtaaatataaatcacatcatgtcacctactacctcgtggacaagattgttttcgtgaggcctctacttaacctctaatctagtaatctctaccaagcattgtgagccacggaggcatcgtggttgcacattattctatgagaaaatccatgaaattccattgacaagcaccctaattccagaaatgccatcgacaaagacaacttcgcagaaacgccattgcacaagcctctttctcccaaaaataccatcacaccgtaactactgttaactcctctccgttaagttgtatgaaaagacaatcttacccctaggcatccatttgctcacacaatattattttgcattcatgtatatttctacccacatctaaattcatagacatctaaattcaccccctgagctcgattgtgaatcatgggtacctaaaatttctaagtaaagcacacagaaacaacaaggacagcaagaaacagcaagcacatagaaaagcacatggaaattaccctcctcgccggcgcctgtgggactctactcgacggcgcctacagcccccgcgctgcagcctgcgaccgctgtgaaccacatcggcgcgtcctgttgcgctgctgccgcgggcctcccctaccgcaccacccccgtgggccgctggcatagcggtgccgccgccatggaccactgccgagctgagcggcgtgatgggcgtgcagcactgcaaaaaggcacgatggtcaactcgagcaacatgacggcgactggtggggacgtagtttttatcctcacgcagggatgtgttggagatccgggatgcatttagtggagctggaagcaatacacgcacggtatatccctaaggccttgttcagtttagaggggattgaagaggattttattccctctcaatccaaaatcctcttcaatcctctccaaaccaaacaaagcctcaaggggattaatcaaacaagaccccagtgagtctggaccccccccccggccccccaccacccgcaccccaccatgtactcagcgtatccccatcctccccccttggagtcccatttggtcttccgccaaccccaatctcgttagccgcatccgcaacggagtggagcctggtgtttttattggacggggcgacctgcctgccccgcgttgtgctatggatcaactatcagcagcggggacatacaacgagctttagcccccaagacggccgtcgccggtgaagggacgccactgcaccgcagagttttcattcacggttcacggagcttcttctgcgatgcagctatggtccatccatcggcgggaggtcaactcaattgttctgctcaatatctccatcgcaattcaagaagattacagaaataagatccaagagcagagcgtttcgaaaatgcaagtcgcagagagctgatgttgtattgactttcctgtttagacgtactgtcgaaacagggatttgtcagtattaatttcagctactgatttcactttgtcttgtaccattattaactcgttaattctctcaacagcacattgcagagaaagctatcagcggtgaactgttagtctgcgattgtgatgcttgtattataattcgtaatcctattactggatgcttcattctttcttgtggtgaatgatactgctacttggccgcactatttcgtgaaatgtgttagatggatctccctccccttgagcccaacggctcaagggggccttgacccgcgccctaatcgggggcgcccagcccaatggctggtgggcccccgtcacactgtgccatataaagaggggtggaggacgggacgggataacatgacacaaggaacgaggttcgtcgccgccgccactccaccccacaaaccctaaccgatcgagggggcacagccagtgacgggaagtccaccgccgcgccacgcctcgtcgtcgacaccgtcgctgccgcaaccgcatcaccgccatcggcaccgagcacaccgtcgccgccgtccacgtcaagcccgcgacgacaacgacgatggccggccggacttcctcctcctcaacaacgactggtcacatccctaaaccctctcactccctctttgttcattcatctattgttgttcatccatcgcaaatagaaccacccgactagatctaaacctaggtgatccaatagacaaccctaacaatggtatcagagccaccctagagtttagattggttggggaaagaaatccaaaagaaaggcaaagaaaagcaaacgatccaacggatcgaaaagatcgaatccctaaccctaatcttacctcgtcgccggccgtcgttgacgccggccacggagggggagaggggcaaagaggcaccgccgaggagccactcgacagccgcgcgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggtttcggcgacggcgacgccgctccgtgcaaccgcaagagaaagaagagaagaggagctagggtttcggcgccggcggccggaggcggttttgtttgcccgatccgcccgcgcgaccgtccgatcgaaaccctagcaatcggacggccgacggcggccggaccgaaatcggcccatgtgggagcgcacggcaagccactttcccggcccaggcccaggttgcggcctggcgaaaggggagggggcgcccgcccgcgcgcaaggcggccgtgggccgaccggcaaaggccgaaaaagttcattttaggtccctcggggccgaatcaaaagaaaggaagttcattctaagtccctgtttcagaagcatttacaattatagttgttaattgtgtttatttctaagcaatttgaaccaacgtgaaaattgtttagagaatagataaatgtgagaaatgcttctgaacatgtactttgtatattttcatgcaaattacaatagaattttgaattgtttttacatgttttacctctgtttaaatttgaaccaacgggagaattttacagagagtaaataacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaagcagcttgttacagagaggtaccatggaggtggtgtaaaagaccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcttgacttcctgacagtgatcatggcaaagaaaggtgagaacattattacatttgtaaagaatctcattatgattggttattctagatccacatggtggatttattctggagcaactattcatgtgtgtaattgtttaaagggattccgttccatgaggactacgcaaagaagtgaaagatccattagagttgccaatggagttgaagcaaaagttgaggctgttggagatcttcgcctagaactcgcgaatggcttcacacttttacttccagacgtttttatgtcccttctttgcaaagaaacttgataataagtgtatccaaattggattttgagagatatgattgccattttggaaatggcaaatgtgaactatggtataataatgaatgtattggtcttatgttgcaagatcagttttatttgttatctctttctgagaatgtgaatgttgtgtcctcgttgacaaaagaaaagaaagcgaactcctgatgtctcatcgaaattatggcactgttgtttaggccatatttcgagggggagaattgagagactggttaagaatgtaattcttcctccattggagttctcagttttagaacaatgcatacaatgtatagaatgcatcggtgcccaaaacaccgtatgagctatggatcctccgtgtgtgggggagtcctgcaaaggataaagtatttaacccaaaacagtaagctgccattttattggctattctgaaagatcaaagggtcatcgtttctactgtccaaacagttatacaaagtttgtagaaacaagatacgccgtcttcttggaagacgaaatgattagggggagctcggtaattcgagaaattgatcttgaggagaggcgggtgtctgtactcgctccgtcgactcaggaactttccttctctttacctgctaatgttgtgccagcaatgcatgccgttgcggtaccaacacctgttgttatctctcatgtagcaacaatgaatgaaagtgaggaacctgttctacaggattcaacagaaattgttgccacatcagaggaggagctgcaacagcctcaaacagataatgtgcctgaataggaggcccctagaaggcctgaaagagtcgcatatggaggatgatcccatctcatatgaagaggccatgagaagccatgaaagatgaaatgaaatcaatgatgtctgggatttagaagaaattcctaaaggagccaaaacagtaggctgtaaatgggtctacaaaaccaaatatgactctagagggaatatagaaaagtttaaagtgcgactcgtggcaaaagttttcacgcaaagagaagagattacaatgagacattttctccagtctcttgtaaagattcctttaggattataatggcactagtggcacattatgatttggaattacatcacatggatgtaaaaacgacatttctaaatggagatttggaggaaaaagtatacatggcgcaaccgaaaggttttgtcatgaaaggaaacaaaaatatgggatgccgtataaagagatccatttatgggttaaagcaaagcttcaagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactacaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtatgcgcaagtgtgcacacgacctgacttggcatttgttaccgggttatttggcagatttcaaagtaatcctggcctagagcactggaaattggtatagaaagtcttgcgtgattgcaaggaacaaaaggcctcatgatgtcttacagaaaagcagaatcgctccagatagtgggatatttggattctgactttgcaaaagataatacaaagttaacatcgggatacatgtttaccctggcagtaggagctatttcatggaaaagctcaaaacagtctaccactgcagggtctaccatgtatgccgagtttatagcatgccatgaggctatggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatatgtttctgaatagagatgtgtatagtggctgtcgaatccatcggtaattaaccgtgacgatgaaacatgctctatatgtaaatctgtgatggaatagaaaaagctaaaggaaatagtgagataaagggggagaatgttagatggatctccctccccttgagcccaacggctcaagggggccttgacccgcgccctgatcgggggcgcccagcccaatggctggtgggcccccgtcacactgtgccatataaagaggggtggaggacgggacgggataacatgacacaaggaacgaggttcgtcgccgccgccactccaccccacaaaccctaaccgatcgagggggcacagccagtgacgggaagtccaccgccgcgccacgcctcgtcgtcgacaccgtcgctgccgcaaccgcatcaccgccatcggcaccgagcacaccgtcgccgccgtccacgtcaagcccgcgacgacaacgacgatggccggccggacttcctcctcctcaacaacgactggtcacatccctaaaccctctcactccctctttgttcattcatctattgttgttcatccatcgcaaatagaaccacccgactagatctaaacctaggtgatccaatagacaaccctaacaaaatgtacatgttctgaagtagtatgatcaatatcaagcaatccagaaccgaaaatcaacaactaaaaattgctttgatcaaagatagcttccgctatttttagaagaattgaggatttggagcaaagcacggttttcctcaagcccatttcgctcattcactttacgaattgagcagatctatatcattccagctacgccttgcctcacaaactttttttttcatttttaatctcgcgtaagatttaattatccatggtcgctgaaagagatgattctgatgaaggaatcctccctgccggcaccacccccgctgccgccgacgctcgccgtggacgtgtccgtcgtagtgggcctgctcacggccgtcctcctcgcgctagctcttcttcttcctcatctacgccaagcactgcaagcaccgtggcctgggcgtggcgcgcggtgtcgctgtgctgggcctcgggttccagccgtcgtcgtctttgtgcaagcggtgccgctccggcctgagcagctgtgccgtgggagcactccggtgtcccggttcggcgacatgggcgacgctgcgcggcacggcgagggaccaggtgaccgaatgcgccgtgtgccacggcgcgttcgacaccgccgagctgctccgcgtcctgtcccggtgccagcatgcgttccacccaggctgcatcgacgtgtggctgatgacgcactccgcgtgcccggtgtgccgccgcagtgccgctgatggtgcactccgtgtgcccggtgatagggaatcaacgtttcctagctatgtatcggcgtcaaagggggaggagcgctgcgacatgcgcagatggaagcgtgcatcgcggacacgagcggttgcgtgagcgtggatggaggcgcagccgtgtaggggtgggtggatgcgcgatgcgagcgcggatggatggggagtgggctggtgcgttgatcttgcgggaggatcctgggagagctctcagccattagattgtttaggactcaccaccgccactacgaattttttaagtagtaaagataccggaggttaaaagatgacggcaactcagctactatacgagtaaaagttcacctcctattcactttacgtgacatggaagcatatatgaatataattggaaattagatctacagtataattcaatgtcgaattataaaaataaataacttgcaaagaaaaccaacaatacagtttgattcaactccatgtagtcaagaaatatcaacttccaaacaaaaatctctttgtttttccaccatgcgtgcaagttgttttagaagcacgcaacacaagacttggtactccgatttatatatgtatgtctactaagttacaaaccacaccatgaattcaagtcattatctaaagaaaactttaggttcaagtaccaaacgaaaactgaagatcaggtctgaattccaatacgcattcaagggtacacctcaattattgatagaaaacctaatattggcatgattttgtaggcactaaatccagctttggaaaatatactttcccattctttctcctctctctcaaccccatctatgtacatcatgtagagatcaaacaacgcttgtgtctctttgaagatgtggggacacccgataaagtcatggtgtcccacgaatacgtatctgcccaggatgttcagttacgcatgaaatgatataaaagcataaacttcgtttatacaatacttaagtcacttagttcacaacacaacataaatacaaaccattacatatatggcctataaagccttatttctaaaaacagataaactgctagacttcaccacaggaactgcctgagcgtaggatgacctagaaaccatagttgtcccactctaacagatcaacaggtcctccacatgcatcttcctcttcatgatctgaacccatttatgagtacaaatggtactcagcaagacatgcttatgataataaatacaataattgcaatatacaacatgtagtattgagaactggaaggattataccctaaccttaacagttatttcatttcatagagcctatcttaataagcatttgttataaacactattgaacatttaatttaaacaataataacgagcataaaagtatgaatgttacttataaataacatgaatagaacattaaataataaataagttaaccatattaattaatagccatttagtttaacttgtgcccataatctggaatcacccatagacacatctccattaaccgggagcatggcgtattcgaatactcaacgactctgcagcgtctgcccagctttacccacacgatacccacagctggcagggctgaaaagtaacaaggtgtaatattgctccatatatctctcccttctgtctagtaagttaaaggatgctcgagatgttgcttggagtgatccagtccaaggtgtgtaccaacctacctccgcatccacttaccattgttcgttactcgatgggcagctcagaacttcatggacccaaagggtagttctgaactctcggggcccatcgagcccacatatataaatcatataaacatggaccatgtcactttgcttcacacacttgaaagctaatggccagtacaccgaaaggcctgcagaagtttaatcaattggagcaatatacggctagattcgataactcgatcgtgtggatgggcgaaactatgtcattcttattgacacaaggggggttgattattatatcaattttaaataagaaataaccataaatatatccatatattcaacacgaccataaacaggtccataaaaccaaacactctatcatgtgtaccacccgcttacatgcggtgtcaacaattctcagcatatagccataaatagttctataagcatgctttcatatgcagtaataatatccataataaatcaatagtatgttaaataattaacagtttgtttaagtgtttatcaaattttatcctaagtttgttagactctaaggcttattaaggtatttataaaaacaacagaaaaatataatgcaataatagcaatataattaacttgaaagaattcgtgcagtctatcgtactccaaaggacaagtacgctactaaaataactcgctatctactgggattaaattgttcaagggagggtgcatgtcttgcaaccttcgggctcgatgtagtcgtacaaaccgtctcctactggcgcggagatttcactcgctccgaataccggaccaacgtcagcgttttctatttatgcaaccatcatcatcacaataaataatagaaaaacaaagataaccaaaagaaatagtatcacaaagtgcaacaatgggtgaaaaggatttaaagaaataattttagggatttatggaatttcggagaacggcgaaccctagggctaaaattagggtcgcggcaacgggtgctcggattgcaacgaaactgatactgatggattcggaataattctaagagtttggaataggtctcggattttgtttttgaggtcaaacaatggtcaacctgatagaataagaaaaaggatttttctgatttatttttcaataggaaaattggatttgctgttcttctcgttctgcacaggaactggccagaatcccacattgccggcggcagaggaggccggttttggacaagggggcgccggttttgtgatctagggctcgaggcgattccgtttttgtggtcggctgcgagaaaagcgctggcggtgaggctggcggcggcgggcagtaacaggaggcggaggcggccatggtggcggcaactccggcgaactccggttcgggaggcggcctggtgaggttcaatgaggcgagaggagtcccagggtggtgacggccaaagctagcgggccctggagcggtggcgcaccatgcggctggcggcggccgaacagagaggcgacgccgagaggcggtgccggcgatgttccgacgatagattggatgggtaaagagaggggaaagggagtactcggcatggggaatccgattttaccttcaatttcagaggatcggcgatgtatgcgacgagtttcggagctcaatcaatgacgccggtattagggcttcggggatttttcctccggtgacgacgattgagttaacgggagtaggggcggatttgaggaggtgaaagaggttgaaattgcgcttcttttgcctccggtcttgagcgttctagtggagggacgaaggaaatacggaggctggaagctggaggtgtcgcggcggcattcgttcgtcgttcatcctcgtgagagctcgtgcgggcgtgtggcgtgcgaggggcggcacgagctgggcgcgagcacgacgcgaggcggcacagggttggcacgaggcagctcgagcgcggcttgcatcgggctggctcagcctagcttggcctagccatgtagagaaaagaagaaaatatggggaagattaaaatagttaggatttgaattgatgtggaatttagatggtccgacattcgggatagatttaaatcttattcaaaggaattatttgaggaatgatatgcactttgcgacaaaattaaacgagaaaagaaacatcgaaaacaaacatggaaaatagtattttaaatgaactactaacttgacggttatttttttagaagatcaaagcaaactaaatcggttttaaaaagttgtcaaattttagggctgttacagaagatgtccctctgcgagcctgatccaaccactatgtttatgattatcacctttcctccagcatctctagtaggtattgcatctttgcaccgtcgaagtatcttgacacaatcgtcatcaccaaaacaatgcaagacatactgaaacataaacatttagaagtataaaataaaagaagtttggaggctaactagatagctaaattgaagggaaaatgcatctctaaaaccctcgaactattataaattgtctagtcaaacctatgaagtttgtttttattaagccagatctgttaggtgtattcattatggctaatgcgccagcctggccgctcggcagaatccgtttagattccccgccgggcccacaaccacagcttgggaagtcgtgaggcgccacgtcagactgtcctcaagaggccaatgtctgacgtggtgccgggggctactgtcggagatatgggctcgggggtatgtgaagtgaggggaatttaccttcccatcctgccgcgtggccctacagcttggccctacccccgcacctcgcggatcgcagaagcagccgggaggcctcgaggtgccacgtcatgcccctcgggccctcgcgccaccttgccccgaggccctcgcccaactgccatgtggcggggggagcgagcggggaggggacccaggctgaaccgctatcaatgcgcgaggcgccccaactgcccctcgccgcatttcatgcggcaggggcagacgtgcggtgccacccgactgacgcacggcagtcaggaatgaccggtctgtgaccggcctgtcaccggtcatgaccgattggacgggcggccgtgcccccacgtcgcctctgtatccggcggagtggaggtaggtatgacccatcccatcggagtgtcattcggagctccctccacgaaaggacgaccaccacaagtcttcacccatttatgagggaatgacaaggttgtcccccgtgtcaggcggggggcggcgctgggtcccgctcaaggacaagttacggcttagcttccgggcgaagggatagatcgtgatccggtcaaggtagggtgggttcccaccctgtagaagagtaggtagaggcggtgcatgtggtatccccttgagctataaaaggaggatcttgcccaccgagaaaggggacgactctcagcagacctgagctctaggagaagagaagcgggaacgctcaccgaaatttaggaaccctagtaactctcaaccttaatcccacacacaggagtagggtattacgctccatagcggcccgaacctgtataatcctctcacccacacgcgactagcaacactcagggaggatacgcgatctctagaggcgagccctttccctcgaccgaactcacaaaagggggatctcacgatctcccgctagagaggatcactcctcgacaatgccgccacaatctactccaaatttctcaagtatcaagtttgagatttaatctacatgtccaggagtttagagttatcaaccaatcagctcagttttgacgagttggacaacagcatatactttcctctaagtgaagcatctacaacagctatagcaccaagttctactgccatcttcataaattaagatgcgttgcatcaatcttcgtcacacacatgccaacattaagaaaatacttgagcatggatttcttctcaacagtttgatggattattgtcactgacaacatcaccagcacctctacttcatcggccctgatatctctgccattgctaaggggtgactacgtccttgccattggttgcttttgtcatcaccgactttcatcgccgacttgttatttcgtcttcacggttggcctactacgcaactgccgatagaggacctcatcgttatcattgactactacactgctattgactggatcaacgacaccgtcatcttcatcaaaccatgcctcttcggctatgcctactctgctgccgttgatgcgcaacttcgtcatcataaccggctatctctgttgccgccaattgtcattatcgccgattgcatccaccatcgctgattgttttatgcttttgcgtgattgatggatttcgccattgccattgatgagcgtccacgtcttcaccaccggcttgcctccgccgccacccatgatttattcgttttcactactggcttattatgcttctactgatgggtgtctttgtcttcttcaccgggcacctcgtctgttatcgactgattatctcgctgccatgactgcacaactttgtcgccattgctgtgcgccttcgtcttcactgctagctgacttgtctgctgccgactggtttcttcgcctccatggctatgcggcttcatcacctttgattggtgtcattgtctttaccaccaccaacatcttcgtcagctttgatgggtgatatcattttcatgttggtcattttgtctctatgccgactgcgtcagctaccatcaatggacaattgtgactacaacagaaggataagctacatgcttaggggctcatcaacacaagcatgaggattatattttcaatttggacttgttcaggatacattcaacatggattcatggtcatgagtcgatttctcaagctcaacgattggactattcattattccccacgagggccatcagctgagtgcttgcgccagtcgggattcaattatcacatctacttttgtattctccatgagggataattactcggatgagaagccactcaaatgagatacgcttgatctacatcaccgaggatatttatcactcaggatcatattaattggcgtattttatacgtcatattttaagggtatcggtagacatactttaggtctaggcctaatatgtctgtaatccatattttcaggtgtggcctgtcacgttcttttagggacttaggcatctttttgcttaggcaaaagtgcgagtgatcgagtgcccaataccttaaaatccttttataccacagttactcaactttttaggagttggtacaatgcattttaaaaggtgccgaacagtgaagctttatatggctgccccgctgactttttatatagtcaaggcactgtttggttttataaaacaattgattggatacaatatcgttgctttttgccgcgtaagtgtgcattttttattgaccaatattatggcttgggctgatcatatattatggtcatttttcaggcgattggtaaatcatttatgagtttatttactcggatgttacaccacatatgccatatatttccagatgtggtgaaaccatgtatcttttagggactcaagcacatttattaaagcagtgtgtgcatggtgtatgcccaaaaactttggaaatttatttattcacaacatacaagcttctttatagttgttttgctatgtgaattttcaatgatatagtcaactttagattgtacgcatcatattttacaaagcagtcggtatatcacttggatcatgttattcggggattcacactgcacatgctacatattaatatcaagtcaaatggttgactacaattatcaaatccattcggttggttggattatttactccttgactatatgtttagtttgttcaactaatcacatagtcggggggctccacctattaggtgcatctagtcgatgcacctaagtctacatttaattatttttcagccctccacagtcttcagatttagtaaagttactagggagaccacggtgaagatgattgaagcactcggctttggagtaatctagttcgagagaagattatcttttcgattgggaaggtctcaggggctactgtggagattataggtaccccatacccacacagtatggttatctgactagttataggggatagcttatacctatggaatatgtaacggatcatgacttaggtattccgtttctttgtatattacggaacggcttaaagtcctggtttgataatattgcaaattagatttaggaaaccgataccgtattggttaaggtttctatcttgtaatcctgccctccatcctatataaggtgggcaggaggcctctaggggcagatattcataccccagatcgtcagatcaatacacacccagcggattcaaatcctcaaataagagtagggtactacctctcatcgagatagcctgaacctgtctaaatcctttgtctctgcatccatccatatttaggtctcatgcgctaccccctttatagtgctgaaatattgtttcgacatgtaatccattatcaaaaaaattctcaagttcttgcagtagatcacacatcgcacccccaccaccaagtttttctattactacggactacaactacgcaaattagtgactaacaacagaggacgagttcaagcgtgatcaagaggtgcttatacctttatctcttcatcctggggtacttgttaggaatagtcccacattacttatttaaggggagttaaaccaacttaaaagtaggagagcccctcaccactcgagttagattttgagatattgtaagacttcttcctgattgggccaatgtctcccggttttggccaacaagtggtatcaaagccaatctctagttcttgtgcacactcagcgtggtgtaagcccaaaatctagtggaccgcgggtgtgtcctgtatgtgcccatgtgtggggccggtctctattgcttgtgcacagtcagcgtggtgtaagcccaaagcctagtggaccgcgggtgtgagtcccgtatgtgcccgtgtgtggggccggtctctagtgcttgtgcacactcagtgtggtgtaagcccaaagcctagtggaccgcgggtgtgagtcccgtatgtacccgtgtgtggggtcgatcagtgctaagcggcaccaatgtgtgacgggggagattgttaggaatagtcccacattgattatttaggaggagttaaatcaacttaaaagtgagggagctcctcacctctcgagctagcatttgggggtgtaggaaggtttggggccaacagaactgtcctttccttcttcgcgatcctccggaaagtcaaactctgcacaaaagcaatccaacaatcagattataatctccaaatgaattaagaagcaagcggccaccaacagaccaactcaccaaccccggacaatcggaagatggaagttgtttattagagcgaggcgagatcggttcaaacactgcagttgtagtactttgttaattgattcgtggttatcaaatggttattaccggtccactgcccgaaatcatcacgcgattagattctcacgaggacgcaagagctatagataattggataaagtattagcaagtgacggttatatttaagcttgtgcgcgcgcgcaaggaaagcagcgggatggacattggcccaagatgctacagatcggaactatcgcagcaccgtcctcatcgccgcatccttcctaaatttatcaccatataataaaatttaaaacttcttaaattaatcatcataagcatgatgttttaatcgatacgtgcatcgcagcaccatcctcatcgccgcatccttcccaaatttataatcatataataaaatttaaaatttcttaaattaatcatcataattagcatgatgttttaatcgatacgtgcattgtgagagaatttatgcatggtgtattgattgatgtgacttaaattatcattggtcttggtgcataaatatatatatgatgattattttgagaataagagagtagttgggaactaacgtgcagtgcacgtaaaacggagcgactcattagtgcataattaattaagtattagctatttttaaaaaaatagattaaaatgatttttaaagtaactttcgtgtagaattttttaaaacacacactgtttaatagtttgagaagtgtgtgcgtgaaaaacgagagagtgagagaaagttaggaacttgcagcaacaaacgcgcgtaaatcagtagccattcactagtgcacatggttggcgctacatactgacactgccctcattggcttggatcttcctatgtcacgatttcctttattttatatgcttactctaccgctgtcaactaattaagtaattttacagttcctgtggcgttaccaaaaaaatacaatattttaaataatttttatgtaaaatttagttcctcttgatatctctggaatgaaaatttacattgaaagttttaatacctcttggtacctctcagtgattataaaatttctccaactaattactatatcccttcctgtttgctattatattagtgtcctctgctaatcaatttcccatgtttctcctatcgagtccaccaaagtctattacatctctcttttagtttgttgaggtcacctaggtttgcaacttccccaactccacgttggagttagcctttgtcatcatcctatcatcatcaccaacgtgccatcgcggttggtctatcatgtcatcagcttcccatcggaactagcaggtatcttcctcaatcactgaaggatcgaataacaatttgtgaaggtatttcagcatcattgtaactgtttccagatcagtggagagccgaaggataacttctgaaggcttatagtactaagagccatacaaaagtttatgaacactctcgagtccacttcactaagaacgtgatggaacttctcttcttcatcatcaaagagttgcatacttcaatgacatcacatcaagcaaagacattggatttatcttataatgtattgttaatatagagttcaaccttcaaatgaatgtatttagtatttagttgtacctttcaaatgcaatgttattacatacatgttgcatttgagtggagtgctaagcatattagttttagacatttcacgtcaattgtacatattttatatgcttattggaccttatcaatagcaacccaaagtccctctcttctttcccaaaattgacgcagaagaggctcatttgacaagtgcaacgggatgctgaagaaattttagtgagaagcaaatgcatggtggtgtctcatagtccaaatatttgcactaaaaattatgggatatatgttggtcaggctgcagtgttctctgaggatcacaaatatgaaaatttttttgatgggactcttgattcacgtatagatttcaatagaactacttccttggttttcctaggttttgagcagtgataaaaaaaatcattttcattataaacttgaaaatggaggcagttcattttggcgatttttcagaaattatttttaaacgtgatatccacagtaatttattttgatccaaaaatttccagaagtttgcacagataaattatatccaacattgtttatgtctgccacaatatggaatttaaactttatgtttttatttttatttctttgaaggcgctataaaattctttaatggacagtttcattatttgagtattaggatatgctgtcacatgcacaatatgtttgtgcaatcatgctgttattaccaatttggcaaaatttgctacaggatatcgaaaaatcatgtaattgactgggagataccacaaaagttgtgtaattggttgtaggacacccgaaataatattttattattttcgggtaaaaagaggtgagaaaattttcaaaatgacggaagtgcccccggcgtcgcaccatgtatcccgactcttcgccgtcctcccacaccctccccccccccttcgctcccaaagaaacacccgaaatccccaaagctaaccctaggcggcgacagggtggaggcggtttgtggtgacgtcaggcgaatggcgctggaagtggcctgttgaactagactcgacaacgatggcgatggagctgtgatttttgtcagcgggcaagcagcactggggatgatgtcactgaggaagaagtgagatgggaggaaagcgtcgctacgtctaacgagcacggaggttccaatgaagccattggacatgtattgggatcctaatggtaagtctcagtgcttttttgttacaatttaggattgaattgtatgatttttttagggttttttcacgtaggatggacgctagctcaacttgcagcgttgttgtttaggttggttcatatgttcagtttgatgagaacggtagaccagattttcatgtgtcttgtgaaattagttgggtactagacaaggataccatttgttgcaatgaccttatgaatgattttaatgacgaggtcaaacgtagttctcaacaacagataacaataactttttgggacaaaaatactaagaggtatgtgcagagatagttctttgcgctgcttgatacatttgatatgtactgggagatgaggaggctcactttggttgttgatatgagtgatgacctacgaaataggaccaagccttgtatggaacagggcaacatgaaaattttgcacaaacgatgtttgcaaagccaaatttcattgcataaactcatatgttcacgattagggtacttcacaaacttcattgtttgggttctttggggtcctcaatgttcgcgctaccagttgtgtcacacacaatggacaattccccaagggcactcaccagtgcggtgacgcacgaccaaagatgaagccgagccatccatctttgatgcaccaccatcgtcgccacttccagcgccgctcgatcgcccggcacagccaccaccagccatcaccgaagccaccaccgccacctagagttaggtttggatagggacttcgggtgtgtgaggggagggggggagcgacgagtccaactcagtctaattcaaccggcagcttccagcgccgctcacccgccatcgccaccaaccacctccaccatcatcatcgccgcctaagtttaggtttggggatttctagtgtttgtgggagaagcgacgagtttgactgggtctagttcatctggaactagtcggggttaaatggtgtgacgccaatggcacttccgtcattttgaaatttctctctcctcttttttcctggaaataataaaatattgtctcggatatcctacagccaattatacaacttttatagtgtccatcggcagtgtcacgttctttacggtgtctcccagccaattacacgatttttggatatcctatagcaaattctgcctaccaattttagctctggaaagcatgccagatgctagtagtatttttctacgcctatacttgtcaagcactaaaaaaaattcttgggttatttaaaaggcaaccaagtaaactagccatttttctgtagtataccagagcttaaaagatgacggcaactcgatctactgtacgagtaaaagttcacctcctattcattttacatgacatggaagtatgaatataatgggaaattagatctacaatagaattcaattcgaattataaaaataaataacttgcaaagaaaaccaacaatataggttgcttcaactccatgtagtcaagaaatatcaacttccaaactaaaatctctttattttccatcatgcgggcacgttgttttagaagcacaacacaagactttggtactcgcggtagcatcttgaatgggaagacttatgtatgtctactaagttacaaatcacaccataaattcaagtcattatctaaagaaaactttaggttcacgtaccaaacgaaaactgaagatcaggtctgaactccaatacgtattcaagggtacacctcaattattgatagaaaacctaatattggcatgattttgtaggcactaaatccagctttggaaaatatattttcccattctttttcctctctctcaaccccatctatgtacatcatgtagagatcaaacaatacttgcgtctctttgaagatgtccctctgtgagcctgatccaatcaccatatttatgattatcacctttcctccagcatctctcgcaggtattgcttccttgcaccgtctaagtatcttgacacaatcatcatcaccaaaacaatgcaagacatactgaaacataaatatttagaagtataaaataaaagaagtttggaggctaactagatagctaacttgaagggaaaatgcatctctaaaaccctcgaactattataaattgtctagtcaaacctatgaagtttgtttttattaagccagatctgttaggtgcattcatctttgtacaaggtcttgaagttcatgtttgtttatttaagccttgcaaatatcttatttattatatattagtcaaattaattggtgtgaatatcttgttttttgtaaggaaatacttgaccttcaaccctggataattactcactttattgactcttcaaaagttgtgttttggtatagtatttatctttgctaattggaggctactcttgaacatttatcgatccttattaatcatagagatgaaaacattggggatttcacatattaattagaatactatatagtgcgaagactggattgagtatatgatcgaaatcgtggcaatatatagttgttaccatgataattgcactaacacaatgatttttttctggcgataggtccatttcctagtaatgtgagaaaggacattcaattattgataatcgttcatcttattaaaaatattatctaaatatcttttgtttttgttacaacttattttatactccatccatctatttttgataggcatatttttaaatctgaaaaaattacttttgataggcatatttcaatccaaccacctattctcttaatgactttcttgaatttaatatgtgactccccattctttcataaagatcggctatatgggcatcgagaaatgtaaatattaatgaatcgcttgtttacgaggaataactagtagcttgtttaaatggatgataagtagaattacctatccttagtcattgtgccaaaatgaaatatgactatcaaaaatacatggagcgagtatcattaatgtatacttctaaacttcataaaaatataaaatttttaaataaaatggatggttaaacccatgaaaatcaattgttttagacatttaaaaatggaggtagcatatagccacatactcaatacgattttccctaaaaaatatacttcctccatttcaggttataagattttataactttgattaaagttaaactgatttaagtttgactaagtttataaacaaatatagtagtatttacattaccaaattagttttaaactaataattaaatatatttttataataattttatattggttaaaaatattattattttttataaacttgatcaaatttaaaatagtttgacttttatcaaagtcaaaatatcttacgacttgaaatactaaataaagatgcgacacaccttgagtagtacggcatctgccggcgggacgtactcaaacatgtcgccggcgacgaaccgcacgtcgccggcgtccggtggcgccttcctgaccacttgcgggaggtccagcacgctgcacttgacatgggggaacgccgcggcgacggccgccgcggccgcgccatggccgccgccgacgtcgacgagggagccaatcccgcggaacacgtcgccgccgccctccctgaacacgacctccatgacgaagcggctgtccgcggccatggcgtcgttcaggacggcgccgtacgcggcgtcccttccggtcatctcccacctggggaagccgtgcgccatctcgaacagcgacatcgccgcgccgccgccggcggcgacaggctcctcctcttcctcctcgtcgtcgaccctgaaccacgcgtgcaggctgaagaacggggtgagagccgtggggtgcacgagaaaccttagcatgggagacatgtcgtgcccgccgccggcgccggcgacgaggaggcgggacgccggggtgagcgtgtacacggcctcgccggaggaggccggctgctgctgcttcatggcgaagatgccggagacggtgagcacgcgcatgaggcgccgaaggtgcgggaccttagcctggcggagcgcgacgtcggcgacgatgtcccggagcgtggcggcgccgccgcggcggtggatggcggcggggatgccgagctcggcggcgcacttgagcgccatggacttgatgtaggagaagaagtggtggtagagctggaggtggccctggagcaactcctcggtgctcatctcgtagctatgttgtgttgtgtgttcatgcatgcatcgctagctatgcaaacaagcgtatttataaggacagacagctctctagattagattagtagtattatgatttgtttaattcagttttagattgttatattttaagatggatggagtcgtatatcatgatagtcgaaaatagcgtgggacttatgatcaggtagtagtaccgagctgtgatcattggttcgaaattttggaaattttgaatttttggaccccaccggtaagcacatatcttccccgaagattttgttttttaaaatatttgtggatttgactgataatatattcaaatttaatcaaaatatgttaaaatttccccaaaaaaatcggttagaaaatatcaaaattcatgaattttaaaaattttggcagccacataaattttggtgactaccgaaattgcaaacactctctgtgattgaaacagacaaaaaaagtagctatcgccaaacaccctaattcatttttttaagggtaaattggaaccatgccattataattttgcaaagtttgagatatgccatcggtatctcaatgacatgtaacaccctaattcgtttttttaagggtaaattggaaccatgccattataattttgtaaagtttgcttgttgccggcagcgacacttaacctagtacctgttattatcagctacccaacgtgtatgacctggtaaaagaatattgtattgtatttgttgtttcttacaggctttcctcccacattatggtagcactaagaggacaattaacatgggtatggtcatcgtctcccaccaatttttaatttaagacaacatcatattttctgctgtgtacctgctcattgaccatgaactttaactttgacctggttccaaaacaccgtttaatttgttataagaatcatcgacagcaacaggtggttaacaaattttatcgaaattaaaaagtataaattaaactaacactttaaatttggcctgcatgattggttgaaacaaactactcatgaattaaatttgaagtatatggatttatatcattccggctagctagtaataaaatttattcgaatgaaatttgacctgcataatcggttcacatctctgtatttggaacctttgcttccagcttcgacatttctaattaacgccgtcacttctactgtataccgtcaacattcacgcgccgccaccttcatcaaggcttcagtagttcagttatgcccggaagttgttataaaaatccattcccaatcatgcgccgtgtacttaaaaaaaactaagttttagacattgacaaagcctcaaaatgcacattgttattattactttcttgatctatatatttataaaatataaaagagtagtaaaagtacaattgcagagaaaaatcgatgttaactctacatggataaatttcacgtattaataattaatgatctaaggtatgaaaaatcctgaccggatcagctaacgtttatgtgttgtactgaactttattacaatatttagggataaagaaattactccctccatctctgaataattatagttttagttagtaaagggcatgtcaagaataagactaaaagaccattatacatttcattaatatggaggaaaaataaggagggagagaaaacgaggaggagaaatgagtactattggtttactggataaaaatgaggagcaaaagatgcagtagtcttctctgaaattccaatttgaagacaagttctcatcctaaaactacacttatttatacaatgactagaatagtaaccatagaattaaatgagttatcacgtaggataaaatataacatgtcaagtcagtaattgaagaaagaggagtaaagcgtgtcttacattagatatggtttctacacaatattcacaatatattgacagagtagtagtattaaattcgaatataatcagcagtactatttgtgttggaaaagtagtagtttcttaataatttggaggatataaaaatcatggctagtttctttttattgtgattgtccttagagactgaggaagtggtaatctataatggattaaatacataatagtagtatgaatttataaaagattgtttagtttcgtaataatagaatatgcatatataatcctataatatttaatagttgaggacggagtaaataattatggcaagtagcagccatcttgaccacatcgtcacctgaattcaagattatgtcgatgtccatttaactacgcctttttaattttcttcatgtccatgtgtcgacatctctgttttggaaccttgcttccagcattgacatttctaacgccgtcatttccactgcataccgtcaacattcaagcgcagccaccttcgtcaagggtccagttatgccagatggtcattataaaaatccattcccaatcttgtgccttggatttaaaaaaataacattttgaacattaacctagtctccaatgcatatttttattattactttctcaatgtgaacggaatttaagaaatagaagtttttactgtaaagctatatacacagagaatagatcaaaactattcctattctacgactatcatatactctcttttattcattctaatttattataccaatcaaaataaaatttagccctaaaatatcttgtggcatgtaacagatgggccacttcggcctatgtgttgcatgtacgtaacctaaacagccatctacccccgcaccttatgacctaacaaacttctcttctcgctagtgttgttgggtctcacgtgtcaagttggtggtggtggtggcagactcactaccaccattgttattggcttttaaagtagtatagataataatatcaaaaatataatttggtaaaatagtttcacatattaaattctaatatattttattaatcaatgatgtaagattttaagttttgattgcatgaattctaggttgtcctttagagaacaaagataaagggtggagcattgggtaggtcgatgttaggcgcgagccatataaaaatcgctgggagtactctcacctgtccagcattgccaagagcccgaaagcccaagaaaccatcaccatggacatgacgcaaacaaccgagtgggacaagagcataagctgtcaagggggagaaatcacctccttgcctcacccgcctctctgccactgtgccgaagaagccgagaggattcagatcctggtcattttaaaaaaaattattttacaaaatgaccactgaaaaactaattctaaaaaaaattcttttttgcgcatcggagtgcctggtaccgtcgtttaataaggcggtgccatcacctctcacgctgtccacatgccaacgtggcaccatgggggccaaccgacgttgatatggcggaaggagggcgccacgttagcatcggctggcccccgtattgtcacggtagcacgcagaggacactagaggtgatggcgccgctatgttggacgatggtgccaggcactccggcaaaaaaaaaaatcatttctagaataagtttttctagaggtttttttataaaataagttttaaaaaggactaaaatttaaaaaaatccagcgggatctagttgtgttgttcgggaaattagaaggggctctttgcagaattattcttgcatcagagtccgcacctaatcgtcaccacgctatatcagcactcagatcatgtcgtggttggtgtggattagtaagaccctatttaaatgggacttagatgggacttttaagtccctatcacatcggatgtttggacactaattataaatattaaacatagactattaataaaattcatccataattttggactaattcgcgagacgaatctattgagcctaattaatccatgattagcctatgtgatgctatagtaaacattctctaattatggattaattaggtttaaaaaatttatctcgcaaattaactttcatttatgtaattagttttgtatgtagtctatatttaatactctaaattagtgtctaaatacagagactaaagttaagtccctagatccaaacaccacctaatggatactgaatcgagtttaggggtttaagagttcaagcacttagatgacccatttacataaatatagaatttgtgtgtgcacttcactcttattatgacaccattgactttttacacaatatttaaccgttcgtattattaaaaaatatagtatgaatatgtaaaggtatgggttaatattatattttatttgatggtaaaacaagtgacccccaaaataaattatatttataattttttaaataaaatgaataatcaaacgttaggtaaaagtcaacaatatcgtacattttaaaaatagaggatgtattattttttttaaacgttgacttgttggatctcactagcatcccataatatcataatattaagagaacattattgtgtacttgtgtactcggtcccgccatgaacaccctcctcctttttcgttcttccttcgctactaatatagataagcgaaaacaattttaatcatctcatatggttccaacttcaaaactgtatgaaagatcctgattattgtttatgttttctgtaccgatcgttttattctaatattctaatatctctatccaaggcaagtagcagccttctagtgcttaaccatattagagtaagttttgttgaggtgatggtcacctctaattttatccatatcattttctagtagcatatacaacacattgcctctaatacacttatcccattatttatttttacttaatctattggtcactttctcttatcatctatctaggagcagtttgtgtaaaggttgctcattgcatgatcagtggctctttttctttctccccattgctctcttttccacattatcatatattatcctatttctttcatcctaaaatattagacataactattttttctcatatctcaaaatataacataagacgtgcatgcatacatacaaacattaacttaactatcacctcttgatattttaaatttagtttattttaaatcctctacgatcaaaccctcaatctcattgcttgcatctatggacatgatccaactgaggaggtgattaagttttttcttagttttttattatcagttactccctctgtcccaaaatataagcatttttagctatgaatctggacagccatgtgtccagatttatagccaaaagttgttatattttgggacggaggtagtattaagctttataatttgggatggagagagtatatggcatttggaccaagagctctctcatcacctgaatattctctccctctcaatataaataaatgtagttttagaagtaaggggagaaattaagagggagagaaaattacctaggtccccctagtgaacgagaagggtaggtagcgagtggatagttgatgtatgtatgtatgtatgaagagaaatttaaattagatatgattgatgggataaatagtactacatgatttacttattttgaaacaaaatttgaatataagaaatatatacttatttttggactttggggaagaggtagtatttttaaaaaaaaaaaaaaagtggatgtcatttgatacgctttttaattttcttcacgtgtacagagtacagactacagtgcacggcggccttaggacgttcgtcagttgtatccaatatttatttcgccgatcgtgacaaatacattgttttgcacaacaagataacgtttcaaatttagttttgatcactaattttaaacagtggtctgcatggcggctttcccatgtttgttgggaataaaagcatcatcatgccaaacattggcagccaaagttgggcttaaaaattaaaacatgtagtagtacatcacccaacaggtttattactactcgctcctcggtttgatttctcccgagttgattattcaaagctcccaaatactcgctcctcggtttgatttctcccagagttgattaccgattcaaagctcccaaatgttgcgttcatatttaacttctttttctgccttcggcttgcatgtcaaatcccattactcactcatattaactcggactcgctcacatcatcaggttgtttatcagacaacaggagccattgtgttaacacataattcagacaatacaacaggagggagccaaacgccaagataaataaacagatgatactataactcgaagaaaaccaattattcttttttttagttacttgctactatgccccctggctacagagtaaggtatacatttgcgaacaagcaaaatttgtggttaacacatactgctttgtaacgacattagcatgcagcttgagttcacttgccactgaaagaaaaaaaaaagctatgggtgtatgatctggcaagtttttttgtgctctatacaactgcagaaaatatttaataaaagaatcaaaaatgaaaattgatgggagccgtgaccgtgatcatggcagcaagatgccacctcttgctcaaaatggagattccagtggctgtaccaagacagatgatgcatacaaaaaggtttcctgcacctgtcgacgagctgcgttgtcacaccccggatcctcggctctgatcagaaacaattgctggccatgtatggattggcaattttgcgcacagaacaaacatcaacttctcatcaagcttgatcctgatccatgatgaattttgttgtagatggatataaaggcaaatgctcttactgtttgcccgcagtgtgcaagttgtagtttggttttgggaacaggtgctcagttaatgccattcaaggggttctgcctctttcttcgtttttcccttaggacgaccaaacattctcacgtttttaccagtcaagagcttcagtgcacgctcgagggtaatcttctttgggtcagcactctgtcatatacaattttcaagaaattctcaaattgaccctgccatatacatttttttaagaacttctcaaatttaccaaaacaaggaagcacacaaactcaatttgaaaaaaataatatgcaagtctaaagattttttttttttaaaagcaagtcagtaattgcaattgttttcaattagaatttatgaaaacaaaacaatagaacgagcataaaagaatgaacaatgcattgttcgtttctatgctcgttattatggtgtctgatatcaacattcaacagatacaatattcaacaaatacctttggcaaggaagcaagagttctcctgtgtctgatactaaatccagctttagaatgtgtgataagtacaggaagatcatcatcagggtgttttccctgttagacaacaaaaacatcatgggacaactcatcaacgtgtactaatgaacagctaaaatgttagacataccagaattttgggatactgcaatagctcgattgcatctttcagagtgatagagtcaatatctttcacctgaaataaagggtagccatagctaaggttgagttcttgaaaaggtcaataagatagatcattgctaaggacagggttgcactgtgtttaaaaccagataaagtggaagttacctcagaaagaggagctcttttcggtgatactccctttctatcctctccaacctggacgtagtggccataaggaccttgtttcaaaaacacctgtaaaataagcaacaaaagtatatcataaatatttgttacatgcaaaattacaaagcaggatagccgtagtaaatataccttttcatcagaatcaggtagcgctccaagtaacctaggtgtgaaagtcctttgagtttcatcagatgcttcagtttcatcgtcatcgtctgataacgtgcgagcaatgtacctacaagtttaattacacaatgtgtactcaattataattgagaaatgctggaattagtttataaacagcgctaaaatggataatagcagtgattatactcaatgaattgataatttctaagagaggaacagagggtcatacttgcatttcggatgtcgatcacagcctatgaaatagccctcaccatacctactaactttgaatcttagggttccttcagaacaactgcagatattgcaatcattttaagcacacgttatgcataaggattaaagatggcattgtagttatcggttaacaatgccatattaatatgtagtactccttccgtcccaaaaagagttgatttctggctattttccaggtgcatagctagaaatcaattctttgggacggaagaatatatagtatgaacatgtagatttcacaatatgataaatattaactctctactagaaaatagcttctagagagcgatgacatgaattacctagggcatatcctactatcattgtctaggtcagaaaagaggatggaaccgaatttttcttcaagcattctttctacctgcaacaaagtggatagctcaaatattgttctcaatactcaagggattgcacatctatatgtcaacagtttcatttgctaataactagaataaagatgcatcaaaatgattattacaggctgactaatttgtctcatttctcatttcgtagcccaacatttctcatttcttatgccaaagaagaaacattgagatttgcaagtttcaagaaacctaaggcaatgattacatgttacaaatcctacccatagaaaccagaatccttgtatttaataactacaaagatcatttgatggaatcaacaccggatcagcagaggcaacggatcatacgatcttgcacgagaacaggagtttgttcatgcacgaggtcctcgcagaagcactgcacgagcttcaggcatggagagccgcagggtcattaggtttaaaactttccaagatgatgaccagggcctgcatgcccaatccactcccttaccagctggctatctcgtgtatgacgacgatgtacaactttctatctctaatggaaatacatgcatagcttttgaatgttccccccaaaaatagaagggtctggtatcttaattcagttgctatgacttgacaaaagccaatgtgatcatgtggcaaaaataaacttatatgcatcatatggtaactagagcaagctgtaatactgttgctctaggatatattactctcctgttcatttttagagacgcagtttaactttgacttggtaaatatctcaaaattaaaatacaacaccaagatcaaatgaaagtgatttgaaatatgaatttaacgacacaacttttgactctgtaaacttataaagagagaaccatcgtcacttcaaaattacaaaatttgaacctttaaaggcaattgcaccttatgagaaatcaggagtgatttgcgttctacctgtaagggtaaacaaaattatactaggtatctaatgaataaagcagtacctttctgacgtcaaggcgactagcatcgccgcaatatttattgaatcgttcccaaaagtctttcagaaggcccttccattcagttgatccagcagagacattatctagctattaaagcagcaggaaaggagtattaatatgattattataccaataacaacattatcacattaggtggctagctcttcacaagaataggaaaagaagtttatatggtttcacacagatcaacccatgtcagtggaagtttgagtgataggaaaagttacaagaatcctaccgtttacatccatatatactggcatacctcattcaaaatgacaagaaaaaaacatcatcagtggaaacaacaggcctgacctatgatattgaccaacctctttttgtgtttatatatttcaagctaagcaattctaattttagcatattgacccacatctgtgggagtaactagccagcttaggctgtgttcaggtgttggtgttgggaactaatccctcgcgaacgcaaaacggagtgactcgttagcgcatgattaattaagtaataagtaatagcttttttaaaaaaaatggattaatatgatttttaaaagcaactttcgtatagacctttttgcaaaaaatgcaccattagcagtttggaaagcgtgcgcgtggaaaatgaggtatgtgagttgggaaaataggataaagaacacagccttatgctggtttccgaactcaaaaaataggaaagaagatgcatatataaactacaaactgaaatttgtttactacctcagtctccatgttagcagtaaagctgagatctgcaacttcagagaaatgatgcataagaaacgccgagacctgaggaagatggtaccgaacatttgtcaaaaatagaagaaatgaaataatttaattaattaaagttatcagaagaaacattgatgtgggaactgaaagaatggaatcacatacaaaaggaaaacataaactatggaatgcacaagttactcatcttgagaaaaatgacataggaagagaaaatagagaaaaatatccatgtggcgattgcatcactgaattacaaatgcctattttgcatccttgattgatcaaaatagataaaacatcccttacaacctaatccacccaggctttgtttgacatggcactgcttttgagattgagattgtgtggttacgtgtatgtttcatcacacgtgacatgcaaatcatccttcacttgtgggaccaaccatgttaagaaaataaaagcagcgaaatgggggatgtaaagggtcgttgtcagccaggtggcagcaaagagctcacagaacagtgacagccagatgaggcagcagagtcctgagtctagcatgctgctgcgggtgtttaaaagggacccatcacctgcagcagcagtgtgtcactatcagggaatctccgtagatggcaactttacttgttattagtcctgggtagcgcctacgctcacaagcgcagctctcactatagaactactaccagtgctcctacacatccatgtgaggcatcatgaagaaaaggcacgagacagtgcaggtagttgaacaggatgaagcggaagccacaagggtgaggattggccattggaaatgtgcagatatggtttctgctacaagctggtcttgtggatagttacgaaggcagaagcacaagcacaagcagaaagacattgtaaggtgatgtttgggctctattcaattcatataattgctagctagaatgctagatgccacataaatgcaccattgcctactataacaacatgattggggattgaagtttgaacagtttaactattgaagtttagaaaacttgacaagtttaggggctaatatgtaatttccttacaaaaattacacttctgcgtaatggattatatgatataaggacatattgtctttatttaaaccaatataatgaaaaataaatgtgataaggattatagatttattgccaaataaggctaaaaggaaggttaacatcaggaactataccatccgaccacgaaattcagggtgtagaacccgactttttattgtcacatatttacgatcctgaaaagcaacaggtaaacactgttatccatgtggcttgaatcattgctaattataataatgatgcaagatcctggaactttgcaactgtttattttgtccatgtgttctacaaaaacacaaaataattttcatcatctcacaaatagcaaagtaggcctgcttgatccattgctaacatttgaccccaataaaagacaaacatttgtgcatgtacgcttgacaaaatctgtatgtttgctaccttgcccaggaatgggatgggatgggattggatcccattcaatccctgtcaatccaagttggatgatggattcttggggctgagatgtttccttagccttaccttatttacggccatatattagatgacctagcacccatgtaacaccttagctacagtacctccttgatttctagattcagatcttatcttatgttacaatgaactctaaagcccgatcaacaatttacatggcagtgaactacaattgacatcaacattccagtcccagagcttaatgcccaggatgaccaacatataaactgaccccaataccccacgttagagaccatgaaaaaaaaaaacttccaatggattcgaaaggtccagggtgatgtacgtccattaaagtcctacagttaccagatggtctgtattgcatttcatggtttatgcatcactacaggagtagctacatgagcaacccagaaaaaacatgctgtatgcgcatattagtgtgttcaatgagatatagttctggagataacagagtagatcttagcaatatggcacctgcaatactttcattatagatgcatatgtggatggccttccaattccaagttcttctagctttttaatctgcaaataccaaggaaaaaatgatacattcttaaatatatctgataaaaaggaaatatatttctataccaagcatggaaatgcccagaatgaacagataaaaaaccaacatataggttattactgaccaatgcactctcagaataacgtgatggaggtttagtaaagtgctgtgaaagatgaacgttaactggagacaccaagtccttaacctgagaaaaagaaatgcaacagtaacatgcttatatagttgaaagacagacaacagtgcacattagcataaaaaataggtcatataggaagtgcatagttcaggtaatttgacagctgctgacctctaatttggacaaggcctcaaagttatcctggtgaacagcatcaacctcagaattgtaactggaaggacttgcttcagtgtcctaaaaggatagcaaattttcccgttactgagttaagcaagctaaactgaacactaggcacagagttcttaatagaaacgtaagtactgatcgttagatctccaaaggtaacatattttcttaatagaatattaaacataatgataatcaggacagatccatgcatctcagtgaagatagaatgctcaaatagaagctctctagataattaaaatggaggtagcaccatggcacaatctcgtatgttctacaaaattggcaatttcatgtatcaattactcataatagaattaggatttaggaaacataaaaatggcagaatcaaaagaaaatataggatcacctagtcagatactcagatgtgtgtatccaattctagcttagcagcgcatatgacagataatataactctttttttaaaaaaagaaaaaactagggtccacatcagcctaagcctaggacttatccaagttgtcccaggatgtcacatggtccatataggcatacatataaaaagaaacaatactgcaa

SEQ ID NO: 67364 - DNA, 2436 bp, Oryza sativa
tgacaggtctaatggcatttttgcaattttctagtggcagttttgcaataacgattcaaagtagtggtaaatttgcaattgccccaagaatttaagtttgttattaggtcgagcggcagataagaagtcgtcttgtattgcaatttatttgagctgcgagtcgtggtttcatgatagtcgtgttgaactcagtttttatctgcccgctgccgtgcggacaatgagcgcccaccaatccaccgtaactgataactcttcgtcccattttaaatacagccataaatttttatatctaactttggttatccgtcttatttaaaatttttctataattaatatttttattattttatatgataaaatatgaataatactttatgcatgacttatgtttgttaatttttttagaaagtttttaaataagataaataattaaagttagataggaaaacttatgactgcatttaaaatgggatggatgaaatacttaataattactaattacagcatcacaaacaacggcttccttacgtggcacacgtaagccgttgcttgctttcttcgacctcccaagtagggctggacggaaaactcgaagctcgttagctcgctcggctcgtagcaggctcggctcgactcgactcggctcattaggataacgagccgagccgagccaagattttagctcgttagtataacgagccgagccgagctaactcgcgagctgctcgcgagctgaacgagctgcgctttctggactgcaggccgcatccacctgtgtccgcaggccacaacccagtagcccaaaagcccccccagcccacacgcacatataggagaaaaaaaaaccctaagcctcttgcccttctcacttcctcagtcctcagagtctcacgcgcggccgcacaggcacctggccgccgcaagctcgcggctagggttactgcaacagcgccagcacgcgacgcggcgcgccggcgccgtgaccagcgcctctccgtccgtgagtccacgagcaggtcccgttccgatcctcactcggtcactcatctttcctttttcctctagatagatctacatttgctgattgccgaactgctactgaactgctgactactatgctccaggtccaagccctcagtcggggtcgcagccatggagggtgagaataatgcatcgccgcatcctccaagtttggagtcgaggagtaagcttcgtggacgacgaggaacaagcactcggtcttcatcgaatcccactgtgtccttggaagtggtggtatgttatctaatttaaaattgctagttcgtacagtatagacttgaatgttgatttaattattgctatccagagtgctgtccagattatttagttacttccatgtagatgtagataatgaatttatccccaaaaatgaagaatgtcacacttaattttaatgcaatggcaacgattcagctatacattaatacatgtatatttccttatgcagccattggagaaagtttcagaagatgaagacgatgataacagcttcaaccatagggatgatatgtctgaaagcctacctacagttgatggtggaagtggaagccagaagggtgatgatgagtttgatgatggtggatcaaaggctaagaaggcaaagacaggagggaaaaaagctggtgtcacagtgtctcccaagtgcaagatagcaagaggcaaaagagctgagtgctggaaacattttaaggttatcaatgtcccatccaagaaggagagaggtgtcatggtggcaaaggcaaagtgtaagttctgccatagaagctatgtgtatcatccaggtggtgctacaacaactctgaaccggcacctggctggttgcacacaatatcagaacaagttgacaaaggctaaagctcaaggtacactaaactttggtccagaagatgacaactctcttattgttaatcctactgagtataatcatgagcacactagagaactgattgccaagatgataattgctcatgagtattcatttcggatggtagaacataaatggtttaatatcttgatgaaatggatgaatggtaactacgagtttattggtaggaagtctataaaaaatgaatgcatgagggtttatgaatctgaaaaaaatcaactcaagaagagtttgaaagaggcagaatcaataagtttaaccactgatttatggacgtctaatcaaaaccttcagtacatgtgtttggtggcacattatatagatgagaattgggttatgcaatgccgtgtcttgaactttatcgaggtggatcctccccacactggaattgtcatagctcaggctgtttttgaatgtatggtagaatggaaaatagaagacaaggtcacaacaataactcttgataatgctacaaacaatgatactgctgttacaaatttgaaggc

SEQ ID NO: 67365 - DNA, 25196 bp, Oryza sativa
  unsure (1)..(25196): unsure at all n locations
tatacccataggtgtccctgtccaagtaaaactagggaaactaatatgcatacaattcgagtagtgcttgtcgtttcatgtagaactctattcatccttccttttgtggaactcctcctatatccgaaggttgtttccgtataagacatggtatgtggtgggtcttgccgagatttagtcaactactattaggtacgtggtatccataatcctgacaccgtatgaattagattatacatatatacttctataaatcaagtacgtatcacaacaatattcaggctttgatatggacggaaacagatcaacaaatattagggggacgaaagctacagcagcaggttaagaaacgttaaaaaaagatttccgtaaaaaaaagaaagaaaaagatttctgtaccaaaaaaacaagcgctaaaaattttaggaattgctaactagcagcctccgataaaaaaaggtgcaaaaatcgggtttccgccttccgtaaaaaaggaaaaaaatagtgcgaacaaaatattttgtccgattcttaaaaaaaatcccgtcctccgtgccaaaaaaaaaacaagcgcgaaattttttttctatccgattaaaaaaaagtgtgttcctgttttccttaaaaaggaaaaaaagtagtgagaaaaaaagatttttgtcctatccttaaaaaaaatagtacgtataaaccggtcctcccgaaaaacctccgtgcccgaaaaaaaaacaagcgcgaacaaaggttcccgttttccttaaaaaaagaaaaaaatagagagaaaaaaggttaatggaagaaaaagtttttgtgaaaagttaaaaaaaaatctgattccataaaaaccgatgcttttccaaaaattcctccaaaaaaaagaggttgatgggaaaaaaactaagagtccataaaaaaaatccaatacgagattagtaaaatttaggaacaaaaaagttaaaaaaatcaaaattagaaaaaaagaaaagaaaacaagagttaagtagaatacaatttaaaattaaatataatcagtatagaaataagagtacatatcagaacccaatagtagatgaattaaaataaaaaaataaagtagatgaattaaattcggaataaaaataaaataaaatctaaaattaggcaaatgaaaaagatagttaaagtaggaatacaattttgaaacggctgatgaaaataaaaaataaaaagaacaaaagaacacaataagaaaaataaaataaattctaaaattggtgataaaaagtaaagactattgaaagaaaagaccatctaaaacacatgacgagattaattaagtaacaggcttacagtggagcagagtggtggctgttgatgtgacatctaaaaactattaataaatcaccagataaaatcctaatgacgattaaaaggaaggacgacgggcatgtcgtgaagtaatcggtcaaggcggttggcgggacttctagaaagtaaaaaaataaaccccaatgaaaatcatatttgatttttaaaatctcaattaaaaaaaagagaggcagcgggtgggtcgtataggagtacaatggcagagccgctgatggttggtgggtcttctagaaagtaaaaaaatgaattccacgatagttatgttcgattttacaatcccaatgagaataaagagtatgcggcggacgggtcgtagaggagtatagtggcaccgtttgacaggatttctataaattataagaaaaaataaaacccaacgagacaataaactctaaaaaatataaggtctaatttttaaaggtttgggcttctaaaaagtaagaaaaataaaccccaatgataatcatgtttgattttaaaatctcaatgacaataaagaagggcggcagcggacaagccgcagaggagtacagtgacaaagttgctgacgttttggcggaattctagaatgtaaaaaaataaacctaaacaataattatgtttgatttttaaaataatactccctctatcccattttaaatgcagccatagttttccgcacgtaattttgactgtctatcttatttgacatttttctaaaaaaaaattaaaaacattagtcacgagtaaagtactattcatgttttatcatcttataacaacaaaaatactaattataaaaaattcaaataagacggacgatcaaaattgggcgcgaaaacttatggttgtaattaaaatgggacggagggagtaatgacaataaagagaacatgcagtggacggtcatagaggaatataattgaagcgtttgacaggacttctaaaaattacaaaaaagaaacctaactggaaaataaactctaaaaactataattttttaatccaatttttaaaggtttgaaggagaatgaatagaaacaatggtggatcgagcaaacaaataaagaataatatgatagaagtaaacggtagcaactggtgtgacttttaaaagttataaaattataaacacgaggacgataagatttggtctttcaaaatcttaagacaacgaggtaactatttaagaaattttaagtaaaatcatgttaaaaaatataattttatatgggtgctagccgcgcaattgcgtgggccacccgctagtttgtataataataaggttaatggtagaagagatgaagtagtactaattaagctgactgaaattaaacgctgcatgcggcaaatcctcccgattaataaaaacaactcgtgatcagccaatgtgaaggctgagaaaatcattatacgacatcatcagaggccactacgtaccgtaccctacccgcgaaatgacaggttcgtgctcgtgcaggtagtaataataatctaaccaaattaaagagataaaaccaaacaaaaatatctcgaccgatcgccgccaccactactacgactacctccttcccagtggatgcgcagatcgatccaatggctgactacctgggtgcgcaacgatcgaattacgcgaaaacgacgacgaaatcgtcgtgaaatctcacgtttccggcgcatgcatccatgttctgcccttgccctggccgccgccgggcgggcggctaacctcacctcgcgtcgcaagacgcgagtggctccactcacccacccacaccgccacacgcacgcgcctttcctttcgcgtgaaaaggtagcagcagcaagccactcaccttgtcacgtgatcccgtcgtccgtcccggtcacctcgcgacgcgatgccatgcgggtccacctgtcagcgacggacgaaaaggcctacggctgtgtatgatttatctactactattagctagaatatttttaaaatagattaatatgattttttaaatatttttttatagattttttttaaaaaaacacagtgtttaaccgtttaaaaaacacaggagatgtgaagtcggaaaactaagcttaagaccagataagtggggcgggcacggatcgatggagaaagtgcatcggatggtgtttgtatgcatgggaccatttctggtacgcatccaccgtaacaaactagcaacacacttatatatattaataaacttgcacagatgtaaactgaaaaatcgttgaaaatgttttgcatctgctgcctttttttttatctccagcccaaatttgaaaatctgaaaagtagcgcactcacacacacacacacacgatgtttcgtctggacgcagtggagacagattgttagttatcgtcttcatcaacgtgacaacatcgatcgatcgtccacatggttgttttctgctcgatgacacattggccacgttacgtgcgtacctaactacggccacacaatactgcatctggaccgtgcatattatacacttcttttttttttccttgtagaggaagatgtgaactggaactctttttttttaggggaagaaattaaaatcttagatgttgaatttgctgatgcaagcgtctcaatgagtgagacttgactgtggggtgagtaggaagcagttgaatctcgtggtcgatcgatcgtgtcgctacagcaagcagctgtgcatatgactatctccaatttttttttaaagtagataaatattaataagtatagtttttttttatatgaaaggctagctcgatccaggatttggtgacatggactcggataacgggataagataaggtcgccgccgagtatctccatcgatcgactgtcatcagtcagaagaccgaaataaattttggttttgacaaattttcgttgctcaatttcgaatatactactacttgtagtgaacagcgatgcacctaatggacttttcctcgcatgcaacgactttgaatgaaggtctgaaggacagagagatatatgatcgattgatcatttgatcattgagttagctaatccatcactgtttgttacaaaaatgcatggcttttagttcatgctcgcccttgataactcaaaagagacggagaattaaggaaaggtccatcatatcaaacccccaattcgatcttgatcatggatacggggtatattatatatacaggtggaaaatgaaaaggagctatactaaccaagcctctctgtgcaatttcgagctgtccctaataattgcgagacagaggattatttgcctaacgatggatcgatatgatcgaaccactcaatattgtttcccggacacaccttttggcgagacgcatcatcatcatggagtccaggaaaccaaatcaaccgtaaacaaaaaacaaggcgtgcataattaattagtcactagtaaattaattagattgaaacaagctagcagatgcgtacctcgccaattaagaatcccagcaagtggaataataagcatttatcatatggtataatggtaatgtgacccttatcatcataattctaagtagtagtagtagtacttctcctgttgaccaacaactctactgatggagtgatgtggagttgctgtgttttgtcctttggtggctggattttgaggccaagaaaatgcagatggatggatacatggtaacaccagggataatagtacagttcaggtatagtgactacggtcataacctaacataacaatgatggtcactcaggtgttaaattgggagaggacgattgcatttgtacctgaagctgaaaggaaggcttttggagtggtacacgtaacacgtactcgcggtggttcagagatgttgttgcaaaataagggaagagagatacatgggagatgatgatcgattggggaacaaaagttggtggctttttctcggggtgttagttaccaagttagttgctcgtgtgggtctcatggacgatctctcgatctccttggaggtttcctcctgctggtaaatcccctcgtcgattcggacagaacggtttgattattttactgtgttttcggtaggagtagaagagctcgctcgtgacgcatggttgaccgatagctccgtctggtactgcgtcgcatctatacaaaatacggtacactcattggttggtacttatggtttttggagagaattttgttgtatgtgacaaacagagacatgtctgttttcgttgatctgggttgggaatccatctcttacgcccagaaaacggaacgtcccgttaacacgtgattaattaagtattaactatttttttaaaaaaggatcaatatgattttttttaaagcaacttccgtgtagaaacttttttaaaaatacaccgtttaatcatttgaaaagcatgcgcgtgaaaaacgaatgaggtgagctcggaaaactaggcaaagaactcaggccgcggcgtgacagaggcaagcgaagatttcagttggactaagagcaagtttaatagtatagccaattgttggctccaaaccatttataggctgtgtttggatgcctccctttcccaacccctccccatcgttttccgcgcgcatgtttttgaaactgttaaacggtgtgttttttacaaaaagtttctatacgaaagttgcttaaaaaatcaaattaatccatttttttaaaaaaaattagcaaatacttaattaatcacatactaatgggtcgctccgttttctgtgcgcggtgtttgggttgggatctgcctccggcgaacacagccatagtcaacttaatagctaattcgtacaatagttacctataaatatatactacacaattaatatctggtcccgcctattatacaggcgtgcatcttggagtccgtgttgtagcagggtataaatctgtagccgctgcttttccctctcttcttttatctcttagaattgtgtttatagctggtttatagtttgctattgtacctactctaatcatggttgaagtgaaaacacggcgtataacattaacaaatacatggaggcatggagtgagcgtcgttattagagccgtggttgcgacgcaaaagtgcaaaaaaaaaaaaaaggaaggagggaggcgtcgtggtcggggtggttaggttagcggcctcgtccgatccggacgacgatccaatcgtccttttgctctctcctcctgcctgcgcgcctttgactcccgtggaaaacaaacgccacgacgagagagaaaaggcaggtggtggtgggggctatccacggccgcgcgctcgcgcgcgtgcgtgaccccgaagcaaaaaccaaccaaccaaccaagccaagcccgccaagcgcaagcgcggagccccgcgcgtcgtcccaccaccaccgcgcggctgcattcgacgcgattcacgcgatgcggccctcctcctcaccgcgcggcgccgctgtcgcgctgcgccgacacacgcccccgcgcgctcacccgcacgcacgcaccaacgcgatgcgtgtgcgccatgtcgctcacgcgcaacagcggctggctcgcgcgtcgcggcggtggttgtgtttttcttttctttttgggctaaggtgatcgatgccgatggggtggatttggatgggctccatgtggtggtggggggagatcaggagatgagatgctgcctcggccacgtgagttaacgagggtgtgcactgcacggacaggacacgacacgaccatgcgtttgtcaatgatcgcatttgcccggagctaggggctcacgcgcgcgcccggattgcctaacaaaaatacgtgtatttgtatatcgtcgtcgtcggtgtagatgtaaacgaaggaccgtgccacggaccgtagcataactagcacagctaggagaagattagctcacgtatatccatacacataataatgctagttgatactgctgctgctgctactaaatgcaagctcccagggtccccaactagcaaccaccactggtacgagtacgtctttcggaccgacacacgcgctgctcatgacaaaatcactgcatgcgagcgttctgttgatcaaatactgtcatggcatcatatgtttggacatgaacaacttccggtagctatagtttctctcagtaatttaaaatagttgaaatttggtaactatataagaaatcctgccaaaatttgataactatataagaaatcatgccaaaattttggtacagttgtcaaaatttcgacaatgccaaaatttggtaatgttttttttggcatcaaagtaaacatgtcactaattaaaaatcaaaaactgagttttctcagtttcctcatattcttactggtcgcttctcgaaatctaaaattcttaaaaaatgggcgccgccttaattgtactactaccatgtttgaactgttgtaattcggatgtaacaaaacggcatcgtactagcatgtgttaatctaaagttaatctcggatgggtcgttttcaatcagcagggcagatactgttctcatctcgcagttttctttttctgtaactgtgtactactagtacgagtacccaacgtatacgtacgttttaacagatgatttttttgggagtttctcctgtggattatacagtatagaaatgtgcgctttgcttgatgacagtgaggcccggggcccctgaaactcccccaaaaatcccagttatctatatatacccggaaggaaccacagtccctgcctgccatcatcataattcgcagggcaaccaccgctgggcacgcacgctgcctgctggagagcaccacccaatggaaactgattgatcctgcctctgccatggtgagctcgagcttgagctgagagccatcttcttgtacagctcgtcgtcagctttggtgttgttttgtgtagtgtagtagtggagtacagggtcacagtagcagtagtagttgccgagttccttctttgtttgctcccactctccctggatcttttttttaaatttgtttttttatttgttccctttttttttcaccggcttctatcttttcccactgctgctcgtagtggcatctgctgcttctttgtgcggcggcaaatgcgaaagctgccaactttgcgctcggttggttgttgttccttctccaacttagctagctggagtactcttttgcagctctccccaatcccccctccaactccaacctcctataaaatcagcggctcgtggttttctctctttcctgggtagattggattagaggaaggtgttgctctcaagtgactgatcagttgcttagattcagattcgtagtgcttgcttgcttgctccctgttcgttctgagttctgaccgtgcgtgtgtgtgtatggttggtttcttgattagttgttcttgctttggtttgagttgccgaggtggatgaatccggctaatgtgggagcaattattggggttttgtggcaggtgaggtactggtatgcaggagctcggtgggattaatcgattcttgaagaagagcagctcggcgctgcggttgttgctgtgcccaatctagcggcggcgccaggaaggaagaaaagctgcgaaaatctttggttggtcagtggaggtagcagcgagagtaggaggccatgccggagtcttggagagacgcggaggcgaacgcgtcgtcgtcggcctccgtcgccgcggcggactcgagcccggggaatggcaagggcggtggcggcggcggcggcgccgcggtggcgaggggagagcgggcggcgtcggcgtcggcgtcggcgcgggtgccgttccacaagctgttcgcgttcgcggacaagacggacgcggcgctgatggcgctggggacgctgggcgcggtggcgaacggcgccgcgctgccgttcatgacggtgctcttcggcaacctcatcgacgccttcggcggcgcgatgggcatccacgacgtcgtcaaccgggtgtccatggtctccctcgagttcatctacctcgccatcgcctccgccgtcgcctccttcgtccgtaagtgctggaacacaccactgtactctactctactctactgtctcgccgcaaagattgcaaagctgaacttgttgttggatgatcttgtggccagaggtgacatgctggatgatcaccggagagcggcaggcggcgaggatacggaacctgtacctcaagaccatcctgaggcaggagatcgccttcttcgacaagtacaccaacaccggcgaggtcgtcggcaggatgtccggcgacaccgtgctcatccaggacgccatgggcgagaaggtgagctgagccaccaggacacactcctccacatgctcaattttgctctcaagctgtaggcagctaaccattccccccatgtcaacgtcgggctcaggttggcaagttcattcagctggtggtgacgttcttgggcggattcatcgtcgccttcgcgcaggggtggctcctcaccctggtcatgatggcgaccatcccgccgctcgtcgtcgcgggggccgtcatgtccaacgtcgtcgcaaagatggcgtccctcggccaggcggcgtacgccgagtcgtcggtggtggtggagcagaccatcggatccatcagaacagtaagcatcaccagcagcaaagtgatcgatgaaaaggagcacacaatagacacaggattgttgtgccactatcatatagctgaaagaacccccactaatgcggcaatgtttgacgcctcaggttgcatctttcaccggggagaagcaggcagtggagaagtacaacaagtccctgaaaagcgcctacaaatcaggcgttcgggagggcctcgcagccgggcttggcatgggcacggtcatggtgctcctcttctgcggctactcgctggggatatggtatggtgccaagctcatcttgctcaagggatataccggcgccaaggtcatgaatgtcatctttgcagtgctaacaggatctctgtaagtcttatttcgggttatttttgtgcatatatagtttcagtaatatttatgcttgatttttaccaattgcttggaaaagcactacctttgtgttgtgtcctcaatgcttgaagtttctgcttcggttcccagtttcattttttagaaatatagttaagtcatgattccaaccttcaaggcatgctcctaaattacagcagttggtaggtgggaaaggattagaccgacgattagaatgtttagtacacacatgtacttcaaagttccaaattcctctttttgggatggggataagggaagttacaacagctaaagttttgtgattatgatgatttcgacgtgttaggctacaagcacaaactaaggtgcatgcctcttttttttttggtgatggtgatagcacttatcatgggtaaatagcttaacggattttgggtgtttggcacattggcaagtgatttggtagattcacctcccttttgttccaagttttgtactacctaactaccaactcccaccagcagcctcaggtagcatccaggatgcttttcatggtcaacaaaatagatgatgctaatgaaattgaagaatttactccaatttataaaataaatgaaataggtttttgctgtgaaaaattattggttcgtacactgtttttttagtctttttgtacctttttgcttccattttagtgatggtagccagtttgtacttcagttaaattgaccaagcaaactgattataataccagatgctgacttattttgttatcatatttaacagagcactagggcaggcatcaccaagcatgaaagcttttgcaggtgggcaggctgctgcatacaaaatgttcgagacaataaacagaaaaccagagatcgatgcatacagcaccacaggaatgaagcccgatgacattcgaggggatattgagtttagggacgtatatttctcctatccaactaggcctgatgagcaaatattcagaggtttctccctttccatacccagtggcacaacagttgcattggtcggtcagagtgggagtggtaaatcaacggttatcagcctaatcgaaaggttttacgaccctcagcttggtgatgttctcatagatggtgtgaatctcaaggaattccagcttaggtggatcagaagtaaaattggccttgtcagccaagaaccagtcctatttgctgctagcataaaggaaaacatagcttatggcaaagacaatgcaacggatcaagaaattagagctgcagctgagcttgcgaatgcctctaaattcatagataaaatgcctcaggttagaagtctactctatatgcaagttttgtgtttccagtattcagaatttttagatcattgggcataacatactgagatttcttccttctccttgccaatatttacagggccttgatacttcagttggtgaacatgggactcagctttctggtgggcagaagcaaagaattgccatagcaagagcaattctaaaagatccaaggatcctactgctagatgaagctacaagcgctctggatgctgagtctgagaggattgtgcaggaggctcttgacagggtcatgactaacagaacaactgtcatagttgcacaccgcttgagtacagttagaaatgctgacaccatcgctgtcattcatcaaggaacattagtggaaaaaggtaaaattcccaaaaggctcatatcaatgatcaaaatcatccattttatgagctctcagttgcccattgcatctttccttaaacatttaacatttttggtcaggtccacaccatgagcttctgaaggatcctgaaggagcttacagccaactgataaagctgcaggaagcaaaccggcaggacaagtctgaccgaaagggtgactctggagctcgttcaggcaaacaattgtcaataaatcagtctgctagccgcagccggaggtcatcccgtgataacagccaccattcattctctgtaccatttggtatgcccctagggattgacatccaggatggttcctctgataatctatgtgatgggatgccacaggatgtgcctctaagtcgtcttgcgtctctgaacaagccagaaattccagtgctcatactaggttccattgcatctgtcatcagcggagtaatcttcccaatctttgctatactgctgtcaaatgtgatcaaagcattctatgaacccccacatctgctgaggaaagattcgcagttctggtcatccatgttcttggtgtttggcgcagtatactttttgtcacttccagttagttcgtaccttttctctatagctgggtgcaggttgatcaaaaggataagattgatgacatttgagaaggtggtaaatatggagatcgaatggtttgatcacccagaaaactcaagtggagcaattggtgcaaggctatcagctgatgcagctaaagttagggggcttgtgggtgatgcacttcaattagttgtacaaaacacaacaaccttgattgctggtttagtcattgcctttgtatcaaactgggagttatcactcatcatcttagctttaataccactcattggtctaaatggatggatccagatgaaattcattcagggtttcagtgcagatgcaaaggtttgtcctctactgaaatgtttgttttgctggattattacttccgcaaaacctgacttctttacttgtttatgcagatgatgtatgaggaggcaagtcaagtggcaaatgatgcagtaagcagtataagaaccgtagtctccttctcagcagaagaaaaggttatggatttgtacaagaagaaatgtgaaggccccctaaggacagggattagaacagggattataagtggaattggctttggtgtttcatttttcttgctatttggtgtatatgcagctagcttttatgctggtgctcggcttgttgaggaaaacaagacaacttttcctaaagttttcagggtaagtattctgtactccggcagtggtaggagaatttaaacttcagctacttcatatataaacttttaacatcgctcacatatttttgaaatgaagaactcaatttttctgccatctgaatgcaggtttttcttgctcttgctatggcagcgattggggtgtcgcaatcaagtacccttacatcagattcttccaaagcaaaatcagctgtgtcttcgatatttgcaattgtggatcgtaaatctaggatagacccaagtgaggatgcaggggtaactgtcgaaacactgcacggcaatattgagttccagcatgttagcttcagatatccaaccaggccagatgttgagatattccgagacttgtgcttgacaattcattctgggaaggtacgaaaccatccatacaagaacctctttacattcaaaatgtttatgcttgctaaagctaactatccaaatcatttttatcagaccgttgcacttgttggggagagtggtagtggcaaatcaacagcaatttcattgcttcagaggttttatgatcctgacgtaggacatatactgctagatggtgtggacattcagaagtttcagctaaagtggctgaggcaacaaatgggtctggtgagtcaagaacctgccctcttcaacgacacagtacgagcaaatattgcttatgggaaggagggagaagcaacagaatcagaaatcattgaagcagccaaattggcaaatgcccacaagttcattagttcctcgcatcaggtttctttctaggtttctttcttttcattggtgtttgctattgtgattaaatgctagaaacatttttctcaaagatttgttttacctgaaaatttgtagggttatggcacaacagttggagagcggggagctcagttgtctggaggccaaaagcagcgtatcgcgatcgctcgtgcgattgtgaaggatcccaagatccttcnnnnnnnnnnnnnnnnnnnnnnnnnnnnnnctgaatccgaaagggtggttcaagacgcgctggacagagtgatggtcaaccggacaaccgtgatcgttgctcaccgtttgtctacaatacaaaatgcggatttgatcgcagtcgtcaagaatggagtgatcatcgagaagggaaagcacgataccttgatgaacatcaaggatggcgcctacgcctccctcgtcgcccttcattcagcagcttcttcatagccgccggtagtaaggctcctgcaagtgtctgctgaacatatattaacagaactggcacacacactgcaataattctgcaggtgctagtctttgttcctcttttgatggcatacataactgcttatagccaagagggaaaggctatacagatagtaaggaccaaatgtaaatgcaacaagttggtccttaacatatatattaattcatatatatatatgtaacacggatcatagatacccaaatagatgatgattatgattacctctcatgtgtttgctcttattttcccttggagattttattttctaccatgcaaggaactaccgaagggggaactgttcaagaaaggatgaacacatcagaaagatgcaccctggaactcaaatctcatcctgccaggctgccatgttaaattgttaatcagtcaccctcctctgacaagatgaaagaaactcgatggaaatttttatagacagaaatactgaaacaacaaacctgatgcatggaagagcagagttaaacaagactccgcagaagcatgatttttcttggcgatctccttgaaggttgcaagatcagatccaaaaaaacagcaggtgttttttggtgaccaagaaacaccaactctgttcggcacaatcgtcaatggccatggccaccatggcaatcgaaaacctactggcttctctgaatttatcaggttttgtcactgtcatgtactagtatactggtgtgtggccggggttgattcgtgcaagtaactttcaggacctaacccctctacttccgaatgacaacaaaaaaaggcccaatttcaaagcgaactgttgttgctgagagcacaccttgcaacctttgctcgttgtgaaaaagcacatataggagtgtacttcccttctagaatctggttaggaaaattactaccaaatccgatggagtatagtcgagaggcctgagatggatctaggtatctaaacgattcagacaacccagcggaatagtaaaacgagatcccacaataaccaagacctaatctcacgatatattagacggtgggagaagagcaattgggggagcctcttcagttgaaactccgaactggaagctttcccgccacatcaaacaggaggacacaggggaaaagcaacaagaggaggaggaagaagaagaagaacacagaccaacgcgacggcgtggcggaggaggcatcaccatggaatcgatcgatctcatctcaccaacgctacccgtcggcgatctccggccggcgagggcgacggcgcgcgcgccggcgtgatcgatcgatctccgcgtcggccatcatggatttgccccccgatgaccctccccaccctccctcggttgctacccctggggttgaaaaattgttgtcgtgcgtgcgcccatggattggatgagcgaagaagaagacgaccatgggggaatgtgccaaagcccgttgacattttgcgttcaaccgcggctgtttactgaggcggttgctgtcgattactagttttttttcttgtcaacaaggattttttttttttggggtcagtgagctgtgttgacaaatttgttggccggccaacttggttgtatatttttattggattggattgggctcttaataaaaaccctactagatcagttggcgggtatatttatattttgggcttcctccctctagtagcactgaaacaaatcgtttttaaacttgtgaagaaaatttaggagagtactcgctcaaatgactatcgttgtacatttacactgaactggaaaaagaacgcaagccatggaaggatgtgaaaaggcgagcgaaaaaaattgacaaaaatagtttatatttaaaacgaattataattagaaccgaagtagaattgccatggtgaaatagcacagttcctctaaatttagttgtgtaaaaacctgaaaaacgaaggtaggctctctttataaaggcaacgcaaaatatatctatacaagtaattccacatgagatatggcctattgatctggacataaaattcatgtgtaaaagtgaacttactttgaaactacttcctctgtttcagattataagatgtttttgactttagttaaagtcaaactactttatgtttaactaagtttgtataaaaattagtaacattttcaatccaaaacaaatttattataaaaatatattcaattattgatttgattaaactaatttaatattataaatattattatatttatctataaacttagtcaaactttaaaccgtttaactttgacccaagtcaaaacgtctcataacctgaaacggaggcagcattactcttacaaaggtgtcctcaataatatataccacagtcgtgcagtcagatctacaacagctgcaaagctctctggaagtccgggttcagattattcttacatttttttttacagctcaaaaatgaagggggaacagactttcagttcagatttcagaatgtattctatatcaactgaacatgaaggtgccaatcgcccgaggaggcaaggagaactgccacttgccacaactaagatttcagtcacaatgccttccattgggccggagagctggctagctggaatgctggatgtcaactcctcatgccagagtttcttcctgcattcaacaatcgataggcacatgaaagttagtactactgactacagtgtgattagccataatagtttgtttcaaccacttgcatatatgtcaatggctagagtaagggttagttgtgagaagaatcacagagaacgtgatagttgctatcagaaactgcaccagaatacacaatgcagtgccaccacaaactcacaaagtaaactgcatttatacaagcaaagtttttaccaagctcacggctatttgaaattttgcatgaggataaaaaaagagtactcaaacaggtcgtcttttgtcattgaagttgtagtaaagacagtaagatgaataaaactattcttgccaaaaaaaaaaaagaagaagaaaaagaagaatagaactaggaaatgcatagaaaccagagtgtaatacccaagatgatctgaatgagaagctggtttagtttggcatgaaaatttgtggccttgccccgttctagtgagaatcttttcattatcacagcgaacaataaaattctatatttctctgcaacattatccatgatgcacagaaaatgaatgtacatgtttctaacttgagtagaagacgagattttaaaaatcaatgaatcataaagtttgtcacatgcgccttgctccttccatagaaacactagacttaagattttaaaccatagaattcagaaagttttgtcatgtgcgatgttgaagaactctggtggggaatttccaacgaatccttccatagggaatgtatcatgtatgggcctggtcagtggtcacacacacacatatcttcatagatgcgcagcccaacaaacacaatgtaaccttaatccttccataaaagcattcatcaactttctaatgttaattattccctttgcgaaccagaacaaagcaacaatcaaaagcagaaaaagttttaagcgctccatgccgtgagcactactgatgagaggacaaaagcttccaagaatgctttgagcaaatctccatattcctcgtggcaactggcagccttatcatcaggcacaaccatatgcttttggaccgaaaactgaacacccagaccctgtattgctagtggaagtccagggcatctttccatcacaagtacagaatcactgttacttccaaattgtttaatactccctccgtttcgaaatgtttggcgccgttgactttttatcacatgtttgactgcttgtcttattcaaaaaatttaagtaattattaattcttttcctatcatttgatttattgttaaatatatttttatgtaggtatataattttacatatttcataaaagttttttaataagacgaatgatcaaacatgtgctaaaaagtcaacagtgtcaaatatttcgaaacggagggagtagtaggtagtaaaacagcaacagatcgattgtgtaatacagtataatgaggcaaatagttctagatacgggtgagtggccttccaccgtttcgcatcggacatctgtcatcgtattcgtggtgctatgccaacaatctctgatctcatagaagtatgcaacagaaacatctctaacgtaaagtatgatttcgaactttcaatcgtgcaaaagaaatctatatgctgacaaaccgtcatatgttctatacttgtccggtgcgacagagtccatcgatataaaaacaaattgtctctcatgtaaattgcggagtgtgagctgtgaatactgtggttccaaggtaagcctttctatggtagcaatttggcaattactataggatgtggattttcatccctcaagggggcatcccctcgttgtttgcatgtcatctaaatagttattaaaaaattttaaaaaaattgataacatagattaatacgaaatatatcactccacaaacatgaaagtccaaattcaacttctataagttgcaacaaaaataacaaattaaactgaaaatagttatggtatattcacaactgtatttgttatttttgttacaacttgtagaagttgaatttaaacttgcgtgtttgtagagtgatatatttcatattaatctatgttgccaatttttttcatattttttgatgactatttaggtgacatgcacgaaaaggggatatcccctcgagggatgatttcactttcccattgctatataaacataggttagtgaaatgaagatcttgaagtcttggtacacatatgatatgcccattgaatttcttaaatatatggacaaaaccaaatagaacattgcaaactatatttcaagtacttaaatgcaaattgcactactttaattgcaattattgattgtttcagttaataatttggtacttcgcaatccaacagctttgtataatcggcggttgagccatcactgaagaaacatgtcccagcaaaggcttagaggctaccacatcaagcatatcaagaaagaacacgcgatgtgttccaggtgttccagacaaacaatttgtttttaccaaattacacagtaataatccatcaaaattcagaactaaattaaccccaaataaaaaaaacagcagctaaacagaatgtttcagcgagatgatcagttcagtgtaccttctcaggaggccgtaactttctgcaggtgaagccgtcggcgacgagcttggcgaccgcgtccctgagcgcctcgtattcctcccggacgttgtacacctggtgcgagatcctcacgtaccccgtcaccggatcgccattgccgtccttgaccatctccggcggcgcatccgccgccgccgccttggagttgtagtagagcggcacctccaccttgaactgcttcctcagcatcgtcctcaggccgacggcgtcgtcctcgctcccgacgcccagcgagccgggcagccccaccatgagcatgctcccgcacatctccggcggcgtgccgaggaacgtgccccacgcggcggcgagcatcgtgcccatctcgaccaccttgtcgtggttccggcggcgtatcccctccacgccgccgtcgaagcgattgacgaagtcgacgacgtccgggaccacgagctgcgcgctgtagtcgcgcaccccgatccaggcgctctccatggggaggccgttgccgtactcgctggagacgacggggtggtggagcttggaggagacggggtcgtccttgcgcgtgtggatgaaggcgacggcggaggggcagaagaaccacttgtggaggttgctggcgtagaagtcggcgccgatgtcgcgcacgtcgacggggacctgccccacggcgtgcgccgcgtcgacgaacaccttgtcgacgccctcctcgcggcagatggcgacgagctccttgaccgggatgaggacggtgggcatggcggtgatgtggtcgatgacggcgaggcggacgcggcggcgaccgccgtccctggccaccgcgagcgccgcgcggaactcggcgacgatggcgtccggggaggagacggggaacgggaggggcacctcgacgacggtggcgcccgcgcgggccacgtacgcgtggatggagttcttgatggagcagtaggtgtagaggaacatgagcacgacgtccccgcgcgcgaagtccccctcggcgaagctccaggcgacgtgctgcatgatgatggcggcggccgtggtgacgttgtcgacgagggagacctcggaggcgtccccggcgccgacggccgcggcgaccgcggcgcgggagcgggcgagcccgggctggaggtggtggaagtagaacgcgtcgggctgcgacaggaacaggcgctgccaccgcgcccgcgccgccagcaccgacgccgggcagcagccgaaggtgccgttgttcaggcgcgccacggcgcggtcgtggtgcgcgaactcggcccggacctcggcgtccgtgatcgccgccgcgcccgcgcccgcgcggggccgcttcgccgagggcggggacgcggcgccgtcgacgtcggcgtcgacgccgttcgcggccgcgtcgccgccggactgaagcgaggccatcggaggttagaggagatgttgacttgcaagcttggagccgtcagaggtgtcgggtatgggttgggccgttgggggcgttatctttgatgggattagtatgcaattatgccgtatgtggatgaaaaatcacggttgtctgatcaataataaaccaaacaagcgaaacaaatttttgtaccgttgggcaaaatgtatctgaaaatggttccgttggagcatgaccaatatgagaggagctgttttctttttttgaaaatattttgattgactcaaagttgttgaagcaagaatcacaaaagaagaaagattttattcacttgacaccggaccattagctttctccgtagctaagattcttttggattaaggctgcgttctaaatactagtacatcaaaagagaaacacgtccgtgtcgctcggccggctctgcaaggacggcggcgggcagagctccgttcttcccccaagggcactattcagacaggggtttctaaggcgacctaaaaagaagaggtggcggcgccgtccagatctgtgctctccctagccagatccggtgaggggtagcgacgcagttttgaacagcggtggaaggtgacacagatgggaaagagggtgccgaggcagccgctcgtgcagctggatccggcaactcctacttgcgtgggtcgacgcggcagcggggaagagggtgcagagcaaaggtggctccttcagctgggtcaaggctggagggagtggtggtggagggcgctggcggtggggaagagggcgtggaggaggcgacttgtgcggctgtacctagcgtccccatagccaaatccggtcgccctcattccatcccgagggcgcacggttcgcttgtcggtggcattagagggctagcaagtgtggcgacagaggcttggggtgctggccagcggtgacgaccccgatgatgatctaggggggaagttgtgccggcatggaggagcattgctggcggagggaggctagcgaggcgcatagagtatgcggcacgaaggcccgtggctggcgagcacggcgcggaggcgacgaggccggcgcgttggatggagtggtgtggcagcgagcctaccgtggtaggagcatggcatggctagggcggtgcggcggtgaggctactgcggtgggaggacgaaggcgatggtcatgcgatcaggtggcccgttaggagacacgagcaacctggtcaaggcaacagcagcaccatgaggtaggcgttgaaggctttggtgagttcctttctaagtgtcaatcctcttgccgccacaagatggccacgttggacggggtagcgtgagggagaggtgatccattcttctctcttaccctcttcctctctaacccacccacatgtgatcttattcttatgactctttctctagtagttatggcagtaaccctatcaactatcgacattcacttccttctagtggcagagccgaacaccatgaagcctagtaggagtataagacgaggattctctattgaccgtaaaatgtttttttttggtctatgaacaataatgcttgttaactggcactccctaacttagaggtggctcttcatcacatttaaggtccattacagtttgctattgtaactacacataatactagtcattcatttttcaacccaatggctcaaatcgattgcaacactgctatttatgtttttatacaatgttttgctatattacattgccatagtatctatgcgaatcttacctcttctcccttgatcctatattcctatggcacaatagcaaccgtatgggatctaaattgctccaccaatgtctcattttctacttttatctaccatggtctcatctttctaagggctttcacagtgtaacctccacacttgaacaacatggaatatcacataagatgacgctcctttaaaacaactcattccatagtgcaaactagttttaatgggtctcactcctaaccgtattcacttttcatctccctctctctctctcctctctgccaccccacggacggaggatccgggaagcgaggcgtggattcttcttcgccacctctacagcgcacctcgtctctgctcgccattgtcagccacatccacaccggcgccccctcttcgtcggcgccgctctctatcccccttcccctacatcaagacgacccacaccgtcgacaccaccgaaaaccacttcgtgcattgctcccgtgttgactaggtgttgaggacgagctcatggtagagattggggtggtgggcctacgagctccatggcggcggtgcgaatcaagcgacatcgacggtatcaacggcacggaggggggaagatgatgagctttgcagggtgaagagggtgacgacaacgaggagctttgcggtgcggagaaggtgatgacgacgagacttgtagcgtggagaggaggaggacgacaagctctacaccggtgaggtgaatgcagtgcccccaatctggccagcgagcttcgaggccgtcgtcccctcctcattttgcctgaagtggtcttggtggccgtcccctcctcccgagcggcattgcggcttgggccaacgagctccgtggtggccttgatttgcttgccgaagtctacaaggcgccactcccatcttcttgtccttcctccttttgcctattttagaccaccccttgtgcttcactctccagaggaactcgtggttcaagcaagaatgaaaatccttggagaaccactgattccccctcctctgtcctccacggcagcagacatctaacgtggtgcatcgaatccacacaacagctagatgcacttagaatgacctaatagagcccccatcgtacattctttgccctattttagtaataaagcagccacatcacatcacctgttttagtaagagcacgtcatgtctccttgcatatttgcacaacacacctttaattttgcaaaactgcggatgggtgcatttgtttttttttttcattgtgtaaattgcatagaggtacaacggaattgctctatgcaggtaatgtggattcattaccgacgtgcctgttaacgtggaaaaaatttatcacgcttgacacctttttagataaaaatacaatcatctaagtatctaaccaagttatttcacttgaatgcttaattttgatgacattattgtcaattatatcattttttatgcactccgtactcaaagattgtactatactcaattatacccatcctccaacttcttacacatatatgcttaatttttaaatttttatcctatctacttgtaagtttatatatgcacaatagaaattttacacgtttacaagttgaacataacttttgctgctatttcagacatcactccgtataaaaaactagtgattcgaaaagcttacgtatcgatgtatgaattgcggaacatcggcgcagtacgagaggggctaaaattgttcctagtggatatattatggcaagtggaaagtaattaaacaggaagctgtcgatgaagacgagcataaacttcaaattagttgctttagtgacgtaggagatggcgattagtgcgcacagccgtgctcccaacaaataacaatgattaagttttgattaggacaacaattcattcattgagtaatactaagaatttaggggcaattgcaaatttaccaccgatttttttaatattgcaaggatgccactcgaatgacaggtctaatggcatttttgcaattttctagtggcagttttgcaataacgattcaaagtagtggtaaatttgcaattgccccaagaatttaagtttgttattaggtcgagcggcagataagaagtcgtcttgtattgcaatttatttgagctgcgagtcgtggtttcatgatagtcgtgttgaactcagtttttatctgcccgctgccgtgcggacaatgagcgcccaccaatccaccgtaactgataactcttcgtcccattttaaatacagccataaatttttatatctaactttggttatccgtcttatt

SEQ ID NO: 67366 - DNA, 56094 bp, Oryza sativa
  unsure (1)..(56094): unsure at all n locations
ccctattttaaaatttaaacataggccaaaccactaatgtgtaggtctttaccttaggcgatattatgtttttgaaaagatagggcgtagtatgtattattgaatccggcgttagatctggttagtatgatatgaacttagttaacctagttagtttttcatcaagcaacaatgtcaaagtaaggtcatgttcaaaatagttcacggtgaaggcaaaccttagattggtccaatgtatgtgttgatctgtcagattttgtaatgacattaaagggcatcgataggtctattgagagatcatttaagtcaatttataattggttgaagcgaggatttagaatagacttaaaagtccacacaatgtcagtatctgtttgtagtgagtcgtgcaacggaaggttatttttgggaactcatgccgatgcatatcactgttgcttggaaacggtatctggagatggcttttgaaaggtcatggcccttggttatttttgtgtcagtgcatgaaaatgatagaaatcttgcaatggaaaccaaagatgtcgagggtccaagccatgttggggattatattgaaccatcgggggaaaatgagggaaatgacacggggtgatgcaggccatgggtgtagtggatgaggaggagagaatcagtacaatcgttgatgaaatggagagggaagattcggataacgagcaagcgaagagcgatgcatcatccgacgagaaaggtgatgtaatgcccactgattagacaaacgaggacttctcaggacttgttatctcagaggggcatcatgtaccctgggaatacaaggacaacgaggtaattcagggtgctacatatgctcataaggaggatatgaagaaggcagttgtcaaggttatggataccacatacctaataatagttgactaaatctcggcaggacccaccacataccatgtcttatacggaaacaaccttcggatataggaggagttccggataaggaaagacaactagagttctacatggaaacaacaaggactactcggattgtatccatattggtttccctagttctatttggacagggggacacctatgggtataaatacaaggccccctaggaggagaggggacatggaacaatagatcaagatacaagatcaacatacaagccaacatgcgctaagacaagatgtcggatatggacttcagaggtaagcatggctagtcccctatggtgtctacggatactgataggagagacatagcgttgtctctgatctcaccggacaaggattagaggaggaaggctaccctgttgtcgactacgtgtcagcacttcagaccgccatgtcgacaacagatagataggctaccccaaatattgtactggtgtgattatggtaaataagagcaatgaccggcttcggccaacaggagtagggttattacctgacaattcaagggcccgaacctgtataaaaatcctcatctccatcttttttactacaatctcgcatatatcctagtaccaatgatccccatactatataaataccggaatcgcgacatcaaacgtcgacagcagtgaagcattgggcagtctcattgatgagagagtttagggtggtcaagtcaaccaattatgtgtatgaagtaagttgcgtgaaagaagattgtccgtggcgggttcatgcatataagggtaaatggaaagattattggaaagttagcattgtgaccgagcaccagtgccacttacaaggggtggagaagtatcaccgcaacatcacatcagcttttgttgcaagtgagatgtacaacagtgttgtcggtaactctggctttgaaccaagagcaattattagccacattgaagacaaattcaagtacaccataacctatgccaaggcttggagagcaaaacataaggttttagagatgaggtatggcacttttgaagcatcatatgataatttgcagcgtctgttagccaccattgcctagaggaatagcaatacatactatgatgtgcatacatttccattttactgttgatcctaccaagagtgtgctgcaaagagcatttttctcattgggtgcttgcatcaacgcatttgtgcactgccggccagtattatgcatagatggaacttttttgaccgttaaacacaaaggtcagatattgacagcgattggagttgatgggaacaatcaggtgttaccaatggcttttgcatttgtagagagtgagaacactgaaagctggtactggttcttggatagagtgcgaagggaagtcgtgcatatgaggcccaatgtctgccttatacatgatcatcatgcgggcatgttgcgggctattgactacttgcagaacggttaggatgagaagggaattccagctaagtggcccgaccttcggagtcggtggtgcatgcgtcacatgggtgctaatttctataagcaattcaagaacaagctctagaatggcaggtaaaccccctaggactccccacatggcgggaacgtccagagtgtcgttgtggtgaccgttgtcaggtgataaggtccgtaagataacgaactcgaggacaaagatgcttcgtgtgtcctaacattgacgacgacgatttcgtcgtaagtatcttttttttgggtaccactaatcactactttcatgcacttacctctccttacgcaatttttcaaataggaggaggttaggaaatgtcaattcgtacaatggatcaatacggtcagagttacttccattggtcaaacgataacgcaacctgagacgaccacgcaattcatttaggcatggatggagtacgaacatcaggtacaaattgcaagcttagactggaggaacaatccattaggtttacctaaatggtcggagcgtccaaagtgcggttgtagagatcgctgccaagtggctacctcatttgcagaacaaacaattggcaggagatattttgcctgccccaatgtagacgacaatttcgttgtacgtctaacaaattccaaatttaactagcatctgcttattattactattctatatgactaactatgtttcttagggcaatccaaggaggtgcggattcactttatggatcgacgatgtcaatccaacatatgatggccaaaagatagctgagtctgaaacataggtagagtaccagcgagagaaggaccatcaaaatgcaatacatgttgaacgacgcagaaggggtcggtagataaactcaggctcgatttgacaggaccgacaaatttgtatcttttatccatggcacttcttaactatcttgtcattataatgtttcattattatggtgtgttgttgtatgcgtcacgaattataaattaatgtgattgtatcgttccaatttccaaagtttctttgacgccacgatacgttgtatccttataatttataagtacatgcttatatttttataacttctaccttcaaatgtgtacatgattcaacatacgtgagaattatacataactgacaatttataggtaacaaaccccctcatcaccctccaatctatttgaaaaattagattattcaaattttataaaaatgtacgtactttgttcgtttcaaaacgatattttacctaattttaagtgctaaaaaatcaggtttatgtaaaatacctatttcgtaaaattttaagtgcaaaatagttaggtttatgtactgaataatttggaaccattcctccttcgatttcgaaacgatgatttacgtagtttttaaagtaacaattaaatatttcgatgtaaaaacacccttcgttgggctccaaacagcctaaacaaggtaccattcaattctaataatatttttcttgttttcacaatttttaaagtgacaatttactacattttctaaatgaacggagctaatcgccaggggctgcccttaaagttggcggcccccagcacagtacaaaatcaccctccctaagggcggcaagggggccgcctgcaaaattctaggggccctcgccgcccttttgcagacggcccccgcacagttgaaaatcacccttgccgagggcggcaagggggccgcccgcaaaattccaggagccctcgccactcttttgcaggcagccccctgaacagtgttaaaccgccatccctaagggcggcaaggggccgcctacaaaatgcaggcccctatagccagccgttaggcatgagccaacgaccgtctgccacgtcacgaaaatcaccctcccaaaaggcggcgggcaactagttttgtaaatttttgaaacacaaaattagttttgtaaatattttaataaaaaaataaaaaataaaaaaatttggcttgaaacaagcctaccactcaagaaggcccaacaagaaacttaggacgggatctttaaagcccatgggcccgctagttgggcaaaaagactattgttacccttgtaaatatccttgttataaggatggttaagtaaattcccgagtaaccaaaccctagggttgcaaaccaagggttgtaaaactataaatagactccaagagatacgtaataggacattaaattttttaagaaatcgatatatattccactttacatttccacataatagagtgtagttttcctttcaacaacgtatttgtcaatcgacaacaatatgttaaattatagtgtttattaaagttttaagttttatctaaaatagagacaaaataatttatccaaatgttatcaatgtaatcgtggatctaaatccgtggatttatagagctaataatccctatctccaaaaaaatttagattcagaattgtgcaagagtagatgtggttatgatggaaaggataagtaaatgctgatggaaagggataagtatcgataaagtgtccacgcgaacacttgtgaaacaggaaacccatgctagactcatcatatattataactattcacacatactctaaaattagatttggcctaataatattagtatattacagtgtattttaaccaacaaaatgacacaaagcaagattctattgtttaggttcagacatagtaacggtgagccgatacccacccaacagataacggtaaaaaatcgggactcaaaccctaataatttcacctaaagaaatcaggtctcctacaagacattttcctttcaatattctacctcatattcctctttgtgtctacaaaaactttctacaccttttttttttctgaagccacaattctcggtgctatcccaacataagtaagtaaataataataataataataataataataataataataataataataataataatagtggtagtagtagtaataataataatgataataataataatatgcatcttattaaaataaccatacataaatctcacttatcacataaaaatatatgtatgttgtagaaaaataaaagaagcataattgttacatatataccttgtaggtcggtttacttgatcaatagcatattatcaatctcagaaaccatttcatcgctaacctaggtatgtatttcattccatctaatttcacccactttacgtagtagaaaatttatgacacacatgttttattggaatatttacgtattctgcagcaacaacacaacctttattgttatatccttgagataattagtttaatttgcagttgataaaaaaactaaaattatcatcaagtaaagtcatgtataaaccaaagatctcttcaaaagaaatacacatacaacaagaattacggtaatattgcaagatgtaaggacaagttccaaattttcaaattagtttcgtatatatggatgggaatacgcttctgttgccttaaccactcaatcatctactaaaacacaagcataaatgacaatgatttataaagttgaaatagtgaaagtgattggatacattacttatttattctaattgttagagataaaacacatgcataaaagaacacgatctatccatactgcaatagcattattggaatagcatactgcaatagcataggtgacaaagggacgtcttggtgatgtgttatcctggagtgtatcatgcattattggatgccgctgctatctaaacgtaaaaaagaaatgactttaacccatttaaccatctttgttcactcggagattaaggttttcttattccttaaacacgagaaagaaacaataaatgattaaatatgtaaattgtttaaaataaggatggaaagacttttgaaataaaaataaatacaaatgtaacaatatcttatttgatatataatagtactacctaatctttaaacttgaatttattagcctttgcatacttataagaatgcaatgcagcacgattttgtattggccaccagttaaactcttaagataagttattagatatataatttgactatcccatcactataggagaaactgtttgttgttgccagcgagacgatttatccttatttgcaatacagtgtttagtgtaagaagaagaaaatttttagacagattgagagagggaggcatagaacatcactatgggagaaactgtttgttgccagcgagaagatttatccttatttgaagtacagagtttagtgtaagaagaagaaaatttttagacagattgagagagggaggtatagatacatgcaaggcaacattattaaaataaagatgataagcagcagtaacaatttcattggcattgacatgaaaaaactaatcaagataggtctgatacaagggcatgtcatcaaatgaatccgcatagtgctcaaaaggaatgagcctgtcccatcctcacatattctccaacgcaattaacataaataaattaaataaagaaagaaaaaaccctcaactggatcatggatagacggattcgagctttaatccataaataaataaaaaaattgaaaaaaaattaccaactgggaatttgatgatggtaagtgacggaggagatttgcatgtccacattttgttaaatccaagaaagcaatttctccaactcgaaatcagtgaacttaacatcaaggtaaggattcccaaatgtagcctggtgttgtcgaattactgctgctcatcctctataacgctgccgtaactgctttgggccttcatctctctatctctatacgtcgaatcactgctgttcatcctccatgacgtcgccgccactgctttggccttcatctctcaatctctatacgacgccatgatgtctcagggtgggatttattttgtgatcgcggcagagatttggagggagccgatgactcgttggaagcaagttactcatgtatgtggcatatgccctgactccgactagaaaacagatatgagatcatctccaccacaaatcaagggaactttatgggaacaactccctctgtccaaaatataggtccatttatttcataccaaaacatgccctgccattttattggcaaagtgaataatatatgtgttagtttggattaaggcttaatatttgcccataaccacctatctgctcatattttagaagtttatataccatatgagtaaattttataaaactacatatactttgcatgatctatcacaaaactacagatttaagaacttgtttcacaaaactttcttaaatctgtaattttgtgatagatcgtgcaaagtaccggtagttttgtgataaacggacatactaaatctgtagttttgctaaacaagctcttaaaatgtagttttgtgataaattgtgcgaaatgcctggagttttatgaaatttactcctaccatatcaatcatcaatatttctcaaataaactgcaagatgatttggtccaaatgatactccagtacaaataaaaagaaaaggagatccatggacttccaaagaactctctatcggaaagatgagaagaagaaacgaagttgtaaaatatgaacataaacgaactgatttgtagattgggataaaaaaaatagaaaaagaaaccgacaaactgaccagttgcaagtgcgtcgaaattgagcacatgcatgcaatgcacgcggtgactaacagctaggggtggaaaaaaagctcgggctcgtgagctcagctcaggcttggctcgagcttggttggcttggctcagctcgtaagccaaacgagccaagcccaagcctccttttcagctcgttggtgaaacgagacgagcccgagctggagcctaggccatcatatgtttatatcgattatttattttttatggagttattatttgtcaacttgaaatttttcattaagattttgaagaattgaatatataaacttgtcagggttacggataaggtataccctctatccttagatgtacgttgtatactgatacggtatacccgcgcgtatgcggatagtttccgtatacattaaggaaatctatcatgtgatagggatggtatttacggatggaaggagttctactcggacaagactgggtctttaccatattgtgaggggtccgatatctccgagtcctacttggagatcaactgacccgtggtataaaagggaccccctgggcaggacctaaggcattgaatctcaccgccaacacacccaccacagcctatggaaccggagcgcgcaagagccaagtcgccgggagatctagtcagatcaactcgactacggtctcgttggtatcatcaagttctgctattccctttgtaatctgtggtttccatcatataatctcataccaactggattaggactattacctaccaagggacctgaaccagtataatccttgtcttttgtttgcttgatgtcgtactacgtagatcctcgtaccaacggaccccaataccccctatatccggtctacgggtatccccctgtcgacaaaacttatttaaattttacaagttgatgatttgttcttgctttttttaataattataaaatatatatgaagaggtgtttcaacaggaaggcttgcaagccagctcgagctggctcgagccgagccgagctcaagttttagcttgtttccctaattgagccgagccaagccaagcctagtttgttgtgagcctggctcggctcagctcgtttccacccctactaacagtagtagcgaccacaagcctgggctctacagattctagagagaatagggagggaggaagaggccgagcaaggctataggacgataaccggctcgagacttcgtcattgcctccgccatcatcttgacatcttcatcctcttcttctcgctatcgctgatgtcggttgccgcttctcttattcgctatatccagtactttagaatgcttttgagggatactagaccatgggatgccattggatgggactgcttaatgaatcagtcctaacctcccacctctcacattgaccgcatctcgagctcccatgccacagaagaaatgaaacaccgcatcttgctatgtatatataatcaaaattatttttcacccatcgcaatgcactggtacttttgctagtaaagtatatatataattatgtcatctaactattttacactttatatgttatctatactatttatcatatagaattcctgcaacaacacacaaggtttcatctacttaagagcatccccagcagctactctatcacgtacgccatcccgaaaatagcggatgagggaagaaaaacgggctccagcaaacacgccatcacatcctctaattttcgcgcatccgccattccggagagaggaatgccaaatttggcgattctctctcctcacgccaaatcacaacctctgcatctgggtcgagctcccgcccccatctggaattcacagcggcagcagaggatgagaaacagggaggatcaggggcatctccggctagattggctatcggagaaggaagaagggaggtagagaggtggcaccaaccagatctgggctggggaggttattggagaagaagcaccgccgcctcccgcaacccgcgccgccgctcctccgcccggcgactgtcagcaaccccgccgccgtgccgccgctcctccgcccgcgccgctcctctgctcgccacctcgccgccgtgtcgccactccatcgcccggcgcctaaccgcgcccgccagccatcacgactgactgcgctacgtcagtcgtcgcccgcgttgacggacagagaagaagagagaaaaaagaaggtttgagaagggtagagaagaatggagaaaaggctgaaaaatagtgcttcaaatataatataaatgtatggtagttaaaaaatattactaaaatataggaatgtgtgatatggagaatgtaatatggatgatccattggagtgggaagggatataaaggagaaattttttttggatggccatccatataggcatctagaggattaaatttggatgagctgctgtgcgttattgattcatttcatttttccagccgcaaagccgaactgcaaacggctactgtttcctgacgatgggcttgtctaattgaccggcaataagatagcacaaatttaaatttaatgaaaattatccacattaagttttacatggtattacttcaaaattatccaaagaagaagaagaagaagcggtgcgggggcagtaggtccccaaattagacaagaacatgttatattgttaggtggttggctacttccagctagaaaaacaaagaaacaagcaaagaaacataatttttggagaagctcctgctgctgagcatgagctacaagtctacaaggatgcacatgcacgttgttcgttgcatacacgatttccatggtggagggagtggatgatctgggccgtgcagtgcatcgggtgcgtggtggcctgtaaccggcgggcgggtccacgtcggcgttggttggttggaatcctgtggttggtttggctgcctgccgtttcttctcgcctcgccaactttcccttgtccactttggttccttcttcttccattccattgtgttgatgagttgagttggctcatctcatcgtcgccgtccttgaattgccgcctcccatcccacgaattccgcccctcccaccctcctgagatctctctctctcccccacctccgtatttaggtaggcggcgggcgcatcacgttctattgccccctcctgcccgccgccgccgccgcacagccggcgatcgagcggaattcccattcctttccgcccggtttccggcgctgccgcccccctcttaccatcccgggggggcccagaggccaggagctgtcgccggaggtgagattaaatcatcaatcttcattctttatgctcttctttccttcttctgcgccccgcccgcaaaagaaaagatctttcctttctcccttttcttttctggaggcaaaaataaaattaacttaagctcaccctgtgggtagtagtagtaggtagatggtttgtttggatttggaattggaatttcatatgggccctttgctctttatgttcaatattatttttctataataatagattgtatttttttaatgttgggaattgaatctggagctgcctaccttctgcagccgtaagcataattagtgttcaacttgtttgcactcttacatcattgtattacctggcatctcttaggaggagtaatagtaagtaatttattcccataaatagatgcaggcaggtgtcttcacttaacatcaaagaaatttagagttttcatccagctgttctctcttcattctacaggatgccatttcttagagcacttgagtttcacttgcaaattgaggaaaacgccttgtctcttgttttgctagtagtattaaattagacgtcactgtttttagaagcagttgaaaagggttctgtttgatctttactttatcatcatgtcatgcacaagttatgcacataagacaacttcttcaaagacttctgaccctctgaatgcatgcactctaggatttcaatttttcggagccatttgatgctaatgccacaccaccactcctgctaaagctgccctcattatgaactcgctggacaatgagtagcaattgcacattgctgatttccatctcctgcggttacattcgtacacgacagcatgggaaaacttgcagctgttgttcgcaggtttgtatacttctctttttattttgaccccctacaccctcagcaccagaactaatatcatctccttgttcaactgacatgttgatatttgcagtgtacttagattaacaaatgaaagcatgaggattgttatggtaacaattattggagtgctcttgggcttcttcattggaatttcattcccatcagtcagcataacaaaggtaagtataacaatggttttgtcaacagaactgcatcatgtcaattgaccgtaagagaataacttaattatctctgtttgaattatgccagcttcactttccttctagctttgtatcatacatagaagacagaaactctgggctcacaacacaagctttgcttaatcacgcctggacttccgcccgaaatgcaagggaaaacagttctgaaccaagttcaaacactactttgaaggtactttatattacttttctgcactattagtttagctgtagagtaccatgaaccattagaattatgtatattcatttgatagttgtcacaaaatcctctgcttgagtaaatgatggtttgcaagtaatagcttgtattccttgccgctgttcatcccaaaagtataaggtccattgtaacaaagattttgctttcacagatttatgtcccaacgaaccccaagggtgcagagagactagcaccagctattgttgtgccagaaactgacttccatttgcgcaggttatggggagaaccaagtgaggtatattttcttgctcaacatactcgtatcattttattgccaaaaatatttggaattctggaatcttatctttgtttgttatttgttcttacttttatcaagcatatactccttaatcctttttcaaaggttttattttactgtgcctaatatgtcctgctattgagaaattgttgttatatattattaccatgtgtctcttcttgttcatcatgttctgattaagtaaaaactaagaaacgttaaccttatatgtcctggttttcaagtagttcaaaatagaagacctaaactctgtagctttccaagactgtgttggttggcatgctgatattatgattttgcatatgtaggacctgcccttcaaaccaaagtaccttgttactttcactgttggatatgcacagaaagaaaatatcaacagagcagtgaagaaggtaacgttgttgtaactttagtttgcttaacaactaaaatgctgccatccccagtttgtttaatttgcttttcagtctatatcccatttcattaaactcacagggtctgatcattttgttgttccgttctgcagttctctgacaattttgctattctgttgttccattatgatggtcgggtgagtgagtgggacgagtttgagtggtcgaaacgagccatccatataagtgccaggaaacaaactaagtggtctgctactttgctctgatgctattgtcattctctcaggtgctcaattttgaaggatatcttctaaagatttatttatgcacatacatgtaggtggtatgccaaaagattcctgcatcctgatattgtggcagcttatgagtacatattcatctgggatgaggaccttggggtggagcatttcaatgcggaggagtacgcttttgctcttgatgtttcagttgaccacttgttgatatgccatcatgccgcactaacatatgtctgtcgatgtatatgatagatacatcaaacttgtcaagaaataccatctggagatctctcaacctggtttagagcctgatcggggattgacatggcagatgacaaaaagaagaggtgaccgcgaggtccacaagtgagtaaacatgttctgctctgcaatagacatttttcagttagcagaaacccgctattctgttaatactactacctttttggaacctagcaactcaagatgcaatcttttcttgtcatagggttacagaggagaggccgggctggtgttctgaccctcatcttccgccttgtgctgcgtatgtgattatttctctgtcctgagttttgtctacagtacatcccaatatgtatggcgtgaaagtgctatccacttgagttaggctaactaatctatattgctgttgttcagctttgttgaaataatggctccagtcttctctagagatgcatggagatgtgtatggcatatgattcaggtttgtatttcatagtaagctcaattagtatcttcgggccattcattttttttcttcatttatttgattgtgttaatttcctctgcagaatgacttggttcatggatggggccttgattttgctctcaggaaatgcgtggaggtataggttaccttttggctgttaaatttcaccggcctggtagaacttcattatgaatatgctcaccaaatgctttgtgcatttcagcctgctcacgaaaagattggggttgttgattcacagtggattgttcaccaagtggttccatctctcgggaaccaggtaaatgagacatcttcctttttatttatttttccaaccaagtgtttgcataactaaagtatgctcatttgatacgtttttgcatccaaacgattaacagggcaagtcagagaatggaagaccagcatgggaaggggtaagagtctttgaaattttccgcagacatgaacacactagaactgcgagtccccttgtttgtaaccataatgtttgttcgttcaggtgagggcgcggtgcaggaaggaatgggggatgtttcagacgagaatggcggaggcggagaaggcgtactacaagatgatgggcatcacccctccgaactccacactggtgtagatctaagctaggctgattcttcatcttcatcttcactcccatctctgcctctgtctgaatgacgaggattctgatgtgttttacctgctgtacagacagttctgatgaactgatgagtgtgtaggtaggtggtcagatagagtgtggattggatggtgatgattgtagagcatacatttacacatgagggagggagggccatcgatcatgaggagggtgttatacataccatctataaaatcgattattttgtgtttttgtggtggtaatattgtttttgagttctgattgttactgaggaatgaaaggaatgcatgcacgctttagagagagtgcaatatgatatctggagcataagaactctgagaaacaaacataaaatggtgtaaattacctggaatttgtgatatccattccaaatgaggtggtatcgggcttgtttggtttggagccaatttttgccctaccaaaatcttggtagtgccaaaacattggtaaattttgacactatcaaattgagtagtattcaatttgaactattgtgggtagaatttggtagcaaactaaacgtacatttgctactattaaagttaccaaaattttggtagggtaataaattggaaccaaaccaaataggcccattatgtcattcaaattcgacggccctatcgtacatatttgcaaacgaataataatttgtgaatgaaacttatatatatatatatatatatatatatatatatatatatatatatatatatatgtgtgtgtgtgttcttagcgatctaaaaacaaatgctaaaaaataaacttcggtgaaaaaaccctaaaaaatcaaatttaactttaagggtggaaattgaaattttgtccgataagtataaacataagcgtaaaaaaatgaggccctaatatcagtgttgggaaatttcaaatgctatttgatccgaaacagggactattctgcaaacaatttcggatcttaatcaggggctatcctgcaaaatagattggccgcgtgcgtgtgcgtgtccaccctgatcgccgttggatctcccctcctcgccgtcactcgctgccggataaggaaccaatgcttcgcaccggcggcggagcgcgagccacggcggcggcgcagctgctctcctcctcctcctcgccgccgccgctccgcctcccccgacgcttcctctcgctgacggccaccccctacccgctctactacgacctcctcctctaccggccctcctaccccaatccgcccaaatcctccgccgccgatgaccggcacacccggcccaccgacgaccacctcgaccgcgccaagcgccggtacctccggaagcgccgcagccgccttctccccgaccccgacgccaccaccgccaagccctcctcctcctcctcgtcggagttcgtggagctgaagccggaggtggtggacttcccgcggctgcacgcgcgggaggaggcgctctacttccacgacgcgttcgcgctaccctgggagaaggacaagcactaccgcatgctctaccgcctcgagaagaagtacttcccggaccaatccctcgacaacgccttcgtccccgccgacgcctcgccgccttcctccgacgccgccgacaagggcctcgtcttcttcgacgacgacgataacaacaaggaggcggaggtgaagaagaagaaggatggcgaggatcgaggggaggtgttggagaggaaggtggaggatttcttcaggtcattgaagaaaggccctggccatggcgaggctaacgtgatgaaggcgaagaagaaggagcctccgcaggtgaggcacgaggcggatgaatggccgcagccgcatctcgcgagcaggagaacggagctgccgccgaggtggaacggcccgaccgggacagtcgtgctcatcgacaagcccaaaggtgatgcctctttatcctctcttgatgaacggtctaatgcacgtttcaagagattgcatcagaatttggttctggtgtaagaaattagaatgttaccactatttacacaattgcgagcttgtgtgcaacattgcagttattcgtgccaaattattagcaaataggtagatatagtacatcgtgtgccaacactaatgcttgccgacagcctttgtttaaaatggtgactggatggatataatacattcgtacatttgaatttgctgtatgtttacaaatatagtttatgtcatggtttcatgatgagaatcttaccttgagaactagagttgttgattttatgtatgttagggtggacatttttgagctgacaattcatttatctgagtatgagcagtacatatgtggacttttagattagttcctactagcagccgtttttgttaatttgtgcacaacaaaggtgattagtaaatgtctaaaagagacttggggatattgctagaaacttataaccttcttgtcttccactccagtttatggagctcaacatatgcctttcttgtaaaccaggctggacttcatttactgtttgtggaaagctgcggcgattagtgaatgtgcaaaaggtaattttgggatttttatggtagaatactgtggttttagatctttgctctacagacatgtttattgaatatatgatgtcaggtcgggcatgctggtactctggatccaatggcaactggactgttgattgtttgtgtgggtaaagcaaccaaagttgttgataggtactctaatattctcagtgaaagctattttgtcagattgcctgggacaatttcctgtggcttatcttatttcaagttcttatttgtgaggatttcaagcgctgctatgttagaatttgacctgcagtaaacctcctgttctagcattcttgaaaactttcctgagtgaatgtccatatgcttttaaagatatcaaggaatggttaaaggctatagtggtgtttttcgacttggagaagctacatcaacctgggatgcagattcaccagtatgtatcttgtattctgataaaatgacctactgcatatatttctattaggaacttcaaatcgggtttacttttaacttgtatgacacgtgagaaattaatacagtaagacaacttattaagtacacaattaatacaattgtgttggtttggccaatcttgattaatagaacttgaagtgtggaagatttttattggggaacaattaagttaaatctggtttttttgctacatttaatccttgttaaactttctacatctatattgactttggttcaaattatgctttttttctgtttacatgatggttatgcctaaccatctatgtatcatcaggttatccagagagaaccatgggaacacattaaagatgaagatattagaaaggtagcagcatcattcaggggcgagatatggcaagttcctccaatgttttctgccattaaggtacactatctcctatattacactaaacctgttattgtttccttgtagataaagagaagttgttgctagaattcttctgtgggatttgctaacctcgcagtatctcctatacagttatgcttgataacacagactacaaaccatttgaattatatgccggttgcactatctcaagttctcaacatctgttgctgtactgtgaatttgtgattgctgttgttattcaacttgttaatggcataggtgcagtcaggtttgactgtccctggttggccatttgtacattagttattatcttatgcaaaatgcagaatttgttaatagttatactttaggtctcacaagaagatgctgcgtagtagttggtagaatggtagttaactgtgtagcttaaagaatacatagtgtctttaatcgttatcaatctattgggaggaaaaaaaaatcctccaacttgtgttgatcaaccacagaactgcaattaactaaatagatatcaggttggtggtgaaaaaatgtatgacaaagcaaggaggggtgaaacagtagagctttcaccaaggcgaatatcaatacaccagtttgatattgagcgcagtttagaagacaggtattcttcctagtttcccccttttttacctttgacttccttgagcacagatctacatacgcttggttcatactgttcgagactccacctgacatgatttttgtttgtgtatttccagacaaaatctgatatttcgagttatttgctcaaaaggaacatatattcgatccctctgtgcagatttggggaaagcgctcggaaggtctgcttattattcggatattcgtgtacacagcctttgttttcattgtttttttttttttggtctttctgcttcaggcggttctgcattgaatgagttgatctatgcatagtagttcaattgtttaaaagtgcagaataacccatctcctttttaggtttctaagattgtgatatcatcatattaggctagaaaatcactttatccactctgaagataatagaatttcatttgctacaagtatttgcatgacattgaaccaggggaagatattttgaatttatctattgcattgtggtcggctagtttctggtgttggttccatcatgatctaataaccaaatgccgccttcttttcttatttttagggcatgtagttaaagatccacttatctttcagttgacgtccgagacttgtcctttctttccatttgagttgctgttgttggacgtttccaactttacatctcctttacatcgtggtgactaaatcagatatccatgtttgcctgcagctgtgctcatttaactgccttgcggagagactcaattggtaagttttcgtcttgtgaattttgactggttatgcatgatgatcaattaattttactgtaatttgaacgtctcgttcctcaacagtgaattgtatatcaaaattattcatacatatttttaagggacataagttcctttggtccagatcagccatcatattttagttttacttcgcaggcgacttttcagtcaatgatgcttggagttttgctgagctggaggaacaaatcacaaagggatatttatgattactcaccatgccatttggcaaaattgcagccatcgttgggttcagtttgagtttcagcgcttagcgaacaattgctttcttccaatcttccctggtaggcaattggtcgttgagtactgagaagctattaaccaacagtaacgctcaacccagagatcagcacttaatctgacgtttcagaccttgggggaaaggaattcattctggtgtccctggacactacggatgtagcagctttatatattgcaatgatgcatacctgatgtagcatgcatcctaaattttgatgtggaacattgtcaacattacgatgaaatagaatgtggttatacttgattatgaatttatgatgaaatagaatgtagtagtagcatctcttctttgtcgagccagttccagcgtcgtgtatattttttatgcgccaaaatgtttattactggtaaaggtgatgtccaacaaaggtataacttggttgtctctcatcataataactaaggttaaattgataggattacgattgatgattatatagatatccaaacattgtaggtatacatgtgccgaaggtcagcataaattaaatggcacatcattctgcacttgtcccaaatcctgaaaagcctacccaaactgccgaaatgaaccctagagaaacagtcttctaataagcaattgttgtcatcagcatctgcttcacgaactcgattctctgcaacctctcctcaagctcctcctttgatgcatcatccatcacaccctgctctctcctgcaagcatcaaagattgcatttggatcagtcagcattgttcagattcagcacaattgttaccaaatttcaggctgctccaacagcaccaactgcacaattcttaccttttttgatcatctgaggaagatgaaccatggccctcggcatcggcttcgctgcggcgcggcgaatcgaccggaggagcgaggctgcagcagatgaactgggagagaagagggtcaggagaggaatcaggagccggcctgcccatgcagtgtgagggtgcttcaaagtaggagtcctcttcatatgatcccttgtcagctgctgctgagcttggcttgcaagaaaaagaagaagacttcctcctctgtggatcatgatcaaaataccaaatggcaatgagctactaccagtagtagatttaatctacaggagctccaatgtggtttgcaaattgcaatgcctgatcatggcactagtagcagtgaaatcactgtgaaagcaatgagaaattgagtactctaccttgagtagatgtgagtgctgaaccctgaaatgttcatcagtgtccttgtcaaggttgtcggcgcagattggacacacctggaggaaagtcattcgatcagatcatcatcatagaggaactgatcccaacagtatcaccaatctgagaagaatcacaatctacagtaaatctttggagaatattttgcttagtgaactgttcaccaatcaccattagactgaacagaggtgaggactatttacaagttcacaactacagtgaacaacttgtgtgtagtttactactcctactacactgtgcagtctcatcaatggattatggtacagactggcacaaggttaaagtttttccttgtgaatttttactgaagttaacactgaagcttgattcatcaaaattcagagatgcatcgacaggcacatgagaatgcatttgcagcaagaagagaagaaaaggaatagatagcaggtgcggtgcgttcttcttacagcatttttcatgtcaaagcaatgctcctcctggagatggtcacaaaggaaatgaacctccacctcaatgtagcagaaggggcaagggatgtactcccaccactcatcatctcctgaaaaaaaaaaggagaaaacttttaaccggtaaattcacaattgcagttctttctcccacacctgcaatttcagagtacatctgaaacaaacaaaagaaaaggggggcaatatgtttttttaggaaaaaaaaatgaagctcacaatgcatataaattccaagcaacagtgaaggttccttttctgaactttttgtgtgacattgtgttggttatttgacaatggtagtaagttcacactaaacaccaacaatacctctctcacacacactctcatgtgatccgcactgcgaacctttcgatttacattcacaaaagagattaaaccggtaaacaccacatgaaaatgcatataatgatcctgaattaattctccttttctctgaaaggaatcctgaattagttccaatggaacagatgtcaaacaccaggagaaattctcgccacaaaaacctcccaaaaattgctgattcttttgatgataagagatcaaacatatgcaagacaggaggccattgtcaagaaatcagtaaacatggaaaaaaaaagaggaaacacagacaagagaaaacactccgagaactgaactgaactgaatacccaaccataagaaccactcgaggagctcaaaggatccaccaagaaccaaaatttccttggcacagcacaaaacaaagatcacctaacaagacatacaggcaggccaaagaacattcaacaaccaaccaagaagagatcaaagtgaccaacatgtagatacctgaaagttgatagtggggatggccataaaggtgctgcctccctgctgctggtggtaggaagccatggtgagcctccacttccatctctctcccctctcaccactcactattcactagtactactcctctcttcagtcttcactatcctcctcttgtttacctccacaacaacaacacatgcaaagagaggagttggaaaagcctttgttgctcctggctcttcctgtgtatttatatgtggctgtcaggacttcaagaagcctagcccttttagctgcaggaatatttcagtgtgcatctcaaaaggcaaagtggaaataaaaggctggtaaaaaggcaaaataatgagatattactttctacttttcctcagaaattattaaacaagacacaccagacaccactgcacattctcatgagccaacatcacatggaagctgtcttaaatatatgtagagaaatatctccatgtgttaatgaaagtaatataatagtgtaatgcagtaatcatctgcatttgccagcaatttgaagagtcagctagaaattagtactacgtattaagataggttactctcatgcatcttgctcttatccagagtgtccaactttagattacacaaacatgtggggtcaatatagaggcttaatttacttccgtcttattttaaatgcagttatggatttccgtgttcaatattcaccgtcagccttatttaatttttttaaaaaaaaagtcacacataaagcattattcatgttttatcatctaaataaaaaaaatactaatcatagaaatctttcaaataagacggatgactaaatgttagacataaacggtgcaaaactacggtgtttctggacggagttagtactttggattacacaaacatgctgaagcctgatcaaggcactttcatcttttgtcagctatcactaacaaaacacactgcattgtacggaactccatcagaaaacaagaaaaaatggtgtagagatcattgggggcatgtggcatgtagataaactaacattgcaacttgtgctgctaattagtgaaaggaaaaaaggaacagtcaagctagcagagggtcgttgctgattagcctagtgttctttgtgaccagtcttgctcgtgtcttactttaaatgtttcatttttctccttttatggttgccttttatcgcgtttagataaacctttttggaaacttggaagccaagtctaatggaaaagcatcagcaggaggaaagctaaaacagaacacttttatgtatgtccctttcactaatttacacatacatttttcttctactcccttcatctcttttttgtttgatgttgaattaatcaatgtcatacattttattattgaaaaaaatgccatacatttggaaacagagaggtagtatatgccaattgtcacacagagctctgcatttgtaagtaaatactcctttatagggggatgaattttctgttaattaatgtaataaacaatcacaaaatcctggaatgttgagaacttcagtataggaggattgtttcccattgcaacactcgtcgctcgagacggtttccggtgaacccggaaggccggaaaaagaagttgcagactcgcagttactctttctttctgtatcaaaataaaccaatttcatatgagatgtaacacctcagttcatatcagattcatcgtacgagtttggtttatttttgacggagggagtgcactgaacaccaccaccaccaccccgttctccgtgaagtgtgtgacagtatctttggtggtcagcacagcacagcacagcacggcagcagctagcctggggcaggactgcagcagcaatgaaagctgaaaggcgtcttgtggagttgtggaagccatctcaccattgccattgccatcgccattcctctctctctctctctctctggcctctcttgccacacaccttacatcctcaaaaagcagacagatagagacagccattgtcagggttctctgattctctcactcactctctctctctctctctctctgtgaatatgtgtgtgtgtgtgtccactcagcagtcactccctcaatggcagtgaggttgtgatgtgcgtgtgcccagctttgtgtgttggagtagtagagtcttgcagtgttgtgttgcaccgcaatattatggtggtgtttgtttctagcaccaaatatgaagatggaagtttccattatctaaagagaaataaagacggaaattacgtaaacaagaaagctattaatacacatgattagttaagttttaattattatatctgtattttatagcgacttctatatagaaagttttttatgaaacatattgtttagtagcttaaagacatgctaacggaaactaatgtaaaatctgcgtttaattaagaaaaaacattactatgtgaagacctttcgactggagcttaacttggagttagaggccacctttttctctctgtcctggggtttaggggaaaaagagattaaggaaaacaactagagtaaaaaatcatgttttttttctctcatcgtcctttcttgaaggcagatccatctgcttgcttgtctttttccatgttggcttgtgcatgccattgctgaatgctgatcagcctcagctgtgcagtgctgtgctgagctgattgattccctgcagtgctggcctgtcatgctcatgccctctaggattgttgttactggtaggaagagtaccttggtactagttgtactagcaaagagttggcaagatatttccaactttctcagacacgtttcgaccggtggctcttctagttctacacccttaattaatctgcgtcctgatgatcaccttgcaattggccatcaaactgtcgcagataattatagtacttactttgtactgacaaggattaaacttttgtccttagagaattctgccacacatgcatgcttatgaccaaggtctgactcatttcatctctaataatgcaactggggaacaaaaatccatccaagttctgcaagattatgagaacacctcaactgggtagcaggacagtatcatttagaacattaatcaagttataatccaaacaatactctgaatcttgatattaaaaaagcaggtaaacacaaagcaccaaacatttctgaagatccagcacgtttgatttgttaccacttccaaccatagcaatttttttggcatttcggtaatgccaaatgttgctagggttgattttggcaagaaatgaaacatgcccaaagagcacatcataatgtaaaggtaccattaacataggatccaaaaaaaagacgggaaaggaggtatttgttcatgttacatacaaagagtcacacagaaccaaagggttcagaaatgaggaagggggagggtgactccgcacaatttctactactcatcgtttagtcatttatatcacattatcaacacagcagtagcataacaattacataagcatacaaattaaaacagttgctgctgtgatatactctggtagcacatacgattgtattgacacacattgattatgaaacaaacaatgtggtggtacagtacacttcaggcggagccaggtctagcagaagagactaacaaataccaggcaaaccctgacctcgcagttatcaatttattggctgagtagtttggaatcacaggccacaatcttcaccttgccaacttgttctgtagtctcctcgttcttgaatgatgcttcagtcaagatgaatgtccatacattgtcacagaacctgtaagtgtgcaggtggccctgagaaaagaacatgcatcagtaaacagcccagctacaaaatatctgaaatacaggctcaaaaagttagtcaatcatccatcgtatctaagctgtaccagagaacttattcttaaataaacaaaaaaaatccatcaaatacaggtctgttcgacattgcgtccaaaatgacaagaggcttaaactcatgtaactagaatggaaaatttctggagcaggatagcaagttagaaaaataaagagtaaatttcacaaaactacatgtattttgcacaatttatcacaaaactacagatttaagagcttgtttcacaaaactacagatttagtatgcccgtttatcacaaaactacaggtactttgtacaatctatcacaaaactacagatttaagaacttgtttcacaaaactatagaattagtgtattcgtttatcataggactacacatttagtgtcttcatttatcacaaaactacaaatttagtgtctccattatcacaaaactacaggttttgacaatgctaaaacctgtagttttgtgataatgaagacactaaacctgtagttttatgataaatgaagatattaaatctgtagttttgtgaaacaagttcttaaatctgtagttttgtgatatattgtgtaaaatacctgtagttttgtgataaacgaagacattaaatttgtagttttgtgaaataagttcttaaatctatagttttgtgatagatcatgcaaagtatatgtagttttatgaaatttactcaaaaataaataaaacagagattaattcaaactccagttcatgatttttaaaatggtaaaatttccattagcaaaactctagttcatgattctaaaatagtaagtccagtttatgactgataaaaccatgtacatttcttagctaatggttaatggaatgccagttctcctgcattttcgtcaaaaataaaacagaacacgtaacatctcaacaccacatatcataaatgacatattgtagaggtgatcccttcctaatacagcaattcagtgtgggattaacaattctttggaaaagaaaaagagaactgcggtttgtcaaaagagggatttcttaaacccacacagtgacagttgtaaaagagtggccggatatatgaatttatcaattatcgcatgtcttcatacactggacattatcaggtaaaacaccaaaacaaatgaactggtaactatgcttcaaccattttcaggctaaacatacaaaatggctatgcaaacattacattttacaagtaaaaatgaaaatcagaacatgcaatctcctttgtgaatgtatgtcttagacagctgaataggtcccagctgatgggagattggtcgagagtgctcagagttgaaaattgaaaattgatggccatggttggatcatgaggattaagtgtactgctaaattggaaaggccgaaacaacttaaggaacaactaagaaggggcaagcagcagattcacgagagttcagatgccgacaaaacgtcatctgcaattttgtaatatcataaatgctttaactgaagatttttccataagccaaaactagaaatggatgataaaggtgtgccgtatttagaagctataagatagcgtttacctccttttgttatgggcatggaccaggcccatgcagcagtttaggcattataaattaggaattactcatataaaggtaggagattatctagttaggaaagagatgaggtctattagaaagttagagatagagattgcactggtttctatggtactagatattagttccttggatatcaagcctgtcctccctatatataaaggggtcccacgtactgcattatcaatcaatcaatcaatgaatctctaaagctagccctaggcctcagagcctcttagctcagcaggaagaagccctgcctctgctattagagggcgagtgccctatcccccagtctttgcacccttaccctagccaatccataacatttggtatcagagccaactgatgctccaccctcgatggcgtgcagcggggatttcaattggatgtggagatttcgccaccttgaacctctcccaacgttcaatggtgaggatgatccgcaaatttggttggagagtattgagcagttctttgttgagcagcgaatttatggaggaagagaagtggtggattgcatcaagccaccggaccaggtttgccgcaatgtggtatgagttgattgagcgagcctacggaattcaaacttggccagaactcaagaaaaatatcaaacttcgctttgatgatttgccgactgctaccattgaagttctttccaagaagatatctgctagtgctcgaagactatctgtccgcgaggggtgtagtgttatgggcatggaccaggcccatgcagcagtttaggcatcataaattacgaattactcatatataggtaggagattatctaattaggaaagagatgaggtttattagaaagttagagatagagattggactggtttctgtagtactagagattagttccttggatgtcaagcctgtcctccctatatataaagtgaccccatgtactcttatcaatcaatcaatgaatctctaaagttagccctaagcctcatagcctcttttagctcagcagggagaagccctgcctctgctattagagggcgagtgctatatcccccggtcttcggacccttgccctagccaatccataacacctttctagtctccggtagcaatagagatcaattcttgcaaaactatatctaggatagcgttttacatacttatcacatgggtgcatgcatgcaccatagcccagcaggttgtcatggacagatctgttcatcatccaggtggatagctgctatcaggtagtcgaatctacaagacaaacatgatctttccagctataactaattcttaaatgctatagatttagcccaactcttttagcatggagcaaagctcaccgataacaactacatagctacagtaatataatgctcttgatgcacctttcgtgaaaatgagtcatatacaaatgcatcaatagaataacaagaacagtgctgaactatctagtgactaatgggacaagaataaacacgacaaaacgattcacccgaacttggtgagctgcctgttgcgtctacgaatggcccagaggactgattgatactacaagcacagttagaggagcagagcactgaactatgacaagaatggagaacagggaagtgtgattatcgtacgaacccagcgatgagccctagattgcttgtgatcagaagggaaattgagatgttgagtggtcaagtcgcttcttggcacaaaaaaaaaaggtttctagcagagtaccgtcttatgtttggtacggtttctagcatcattactggtttgttattgagctccaacgctgtttgcggcttgtttctcttgcacaatattgcagataaagaagttctaataaacatgtacacaccagggtcacttagttactttatttcttgttttggtttatggggaaaaatcagtgttttaatatgggcaatattgcaatgtgtgagtttttttttctcgaaaccacaggaggactgcgattcatttcattaagaagagaaattgtacaaccgagtgacccaaaggacccctacagaaacacaaaaaaacatcacggaacgcgacgtgcaaccgaaacaccccctaggagaaactagccgtccagggggagcaacccacacagaatttcgaggagtgcctttgctccagcagtacaccaaagagaactctctctagccactgcatgcaaaacagccgagattctcggggaggcaccattgaagacacaatcattgcgatgcttccatatttcccatgccactaggataatcaaagagttcagccctttctttacctctttaggagtatccttaactgttttgaaccaccagctagacaagcgattcattgatggttgcagtgctgcagcgcccatccaaccatttggaagattaaaaaccatacttgccaggaaaaaacacaagtcaccaaaatatgctgtatagtctcctcctgatcgcatagaggacacacatccgggtgtggcattcctaactcgcacatggttgcgatgtggtagttagggtctgaggctattgtaatgtgcgagttgcctatattttgcatacttttgacttccatttataaaaaaggggcaaggggccaggagtaaagcggattacagtaagatacgtaaacaagtcacccattgttgggcaaaaatatcagtccatttctgtgattacccccaattcacaaacaaaaaagaatctctatcatgccatagaataacaaactacatgggtatcagaaagaatgacactaatctttattcataatttcattttggtgaggattatgctggcaagaaaagatcttgacatttctcaggcttgtttatccaataaaaggtttttctttcttttctttttttttggggccaaacacagatgagcagcttggaatctgagcaactcaaggagtacttgatgtgttgcaaaataagataagtggaaatatgcttgtacagccgaaaaaataaaagcatatatgtgataagtgcaagatttgtctggttatgcccgtgtattatgttgctgataggtcttaattctgttactcgcttactcattactataaagtttgtgcaatatccctcagaactcagagcagcgtacacaggacaggtacgtgtcgaacgtgaatggattcctttatgaataataataataatataatatatgcaagaaacaaattttagacttgattcctttagcaaggtgtgtacggaaaagaaaatcgaatggcaacgctgaatccacaaccaagtgtatcaattctagcactggagaaattacatcacaagcgcatatgagttctcaagcataaataatgagtaggctcgaaacagatagagattaaagttatgcacagcacaagtaaggcttggttttttttgggggggtaggaacagcaacatggcaactccgtgataagagcagataccttgatagaaaccttgctcttgacttggttctccaaggcttccgtcatagactaatcacatagatgataacaaacaaaatgaggagtcgaatttttcaatagtatagatagtaataggtggaaggagatatggtaaagtagataccttatcaaactggacaagaacttgaatggcgagctccgggctgagggtgccgctggagaccatctcgtcgagcgtctcagtgaggcacatgccaatggtggacctccggtagagctcgaaggtggccatgggcgatgcgtgcgcctaaactttttggggtggggggaacaaacaacaaaactgttgttacttgtagtattaagagaggttaaggctctgaaattaagagcttcttccagatctagaagagaagagaagagaagctagggttaacgaacgaacgcgagcaaattccagacaaaagtagagagtcccggtgggagagagagagatgaattcagagaaagaaagaaagaaagaaagaggatggtcacctgcaggatcccctcccctgctctgctctgctcttcttgcccgatggagatcgcgagtcggcttgttggcgcaaggagaggaggagcggaggagacgacgagacgccagatttctctttattttacgccaaagagaaccattactcgagttattttacagggaatatttgccactcttggaaatgctgctatccgcccaaaaccaattttggaaaatttcaggaaacgaattcagattttctttttctcggaatcggaaatatttagtatttataattgcaattatagataaatatagctctttttctccaagaaaataaattatacacctagttatattattattaattgataaaaattataaatatcgatttattgtttcagagagatattgagctatatctcttcatggattttagaagttcagcttaaggggcttttatattccgataaatatctgttaccgtattcgctccattttcgtattcgataatatttgattccatttttgtatccgtggttttcgatttcgaacaaaatatggaaatggaaacgataaaagagtttttcgtctttttccaaagcgttttcatccctactcgagtactccacctttatctcaatttttttactactttaaaactagctatttctttatgattattgatggacaaatatattgatagtactcagagaaaaaaaatgcaacaaacaaggttggggattgtatcaacggcaaactccttagaccaccaataaccactagttgccgctccacacacaccgccaccaccgctcttttttccattagctaccaccattgttcctcctctccgcctttacatgcatagccacaccctctagtcatcgagatgtcttttcccctcccccgtcatcatgcacactattgttatggtcaccgttgaggttaggggctgtcgggtttgcagggacttggagtggcaggagctggcccgacaaagagcagggaagctagatcggactcctccttgctggatctgacgattccctagctttcaaaaggaaaaaggaaaaggcagaaagagttagtgcgtggaatggttgtagagtcaccggccttgaagatggatagaatggggtagtccaaaatgaaatgtaaagttagatgttgtgtatatgaaaaaaatggttaaacgatgatataatatgaacactttcaagaatatatagtacaaactgcaatttatcttttttttttctctagcacaattaaatatgagttgtccattacccgatagtctcgcgatatgctaagcacactacagtttatcatctgtgcacatccatggagaccttgacatccaggggggacgaagtatacgcgggcatagcgacgactagggaaatactctgtgaaaacgagctaagtgttgaaaactcgtgaaatcatacctaaaagtttagtaaattcatgaaacatttgctagagatatgtgtagatttgaagtacattctcaccaaatgtcaagtccaaactcagcttcatttgagagtaataaaaatgacaaatttcaagtggattttcattcccaaataaagttgagtttatttgtcttttttaccattcacctgaaaatagttactattcacctaaaaaatatttatttttactctcgaataaagctaagtttgaacataagattcggtgagaatgtaatttttttcatgatttttcacgagttttcaatacttaactcgttttcacggcatatgtcctcaaaatttagaatcaacaattaacaacttgttactgctacgggttatcttttggtaccaatataattaggtgtactactttatgtttgatgtactattccgctgcacgtcgtcatgttgacactttcactacagtagatagataatcatatcttcttcctcttctttttttttaaaaaaaaatcattttccttcttaaacaacacagcatgaactgcaggctgtagatgcgtgccgccctgtgcttgatgatatggttgcgtgttcgtatatgtgttacgtgtaattaaggttgcaaaatataaactaaatagagatatagccgaccgacaaggtgtatatacacttgaataattagatggtcactgcaggcaagcaattagatcgcagaggcacatcaggggaggtattaggcaactaaccatgttcaaggattgtagttggaagctccagtaccagccatcgctattgtcatttttgtcatacaataagcacttccaattatgaagcattaattagcggtcagcagtttaagccatcgatttaatatgaattctgcagggttttatagaattctgtgaaattctaatcagaaaggaattgagtgttttcaaggaaaacatacgcctgtaatttgcaggctcatgcatgaaatccaacatacggattttatcaggtgatgagaatttggagaaagataaagctggataaacgaagagggtgattaagaaacgacagacagctaagcattcttttgtttcttcttcagaaaacagatgggcattgtcacactacagtagctgtatgtagcagtctaatttgatacaatgaatgggtagcggtgcaatgttcagctaaaatttgagattaaattcaaccttatttttagcgaggaaattcaaattaaaagaaaaaaaaactaaacctttagatgtcatcttataactcaagaaaacttacaactcaatttgtcaagcattcaactcagatgttccagttctcatttaaaaatagcgtatcccacgattcaagttttttttaacaaatccaaagcgttatagtcgagataggaagctttcacttttgatggaaaaaaaatccaattcggcagttacaaatcggttaattacttatttagtggtaatttcgaacttctattgttttaatttttaagaaatgagaaaacagctagtagcagctatcgagaacttgttttatttcttcttcagaaaacggatgggcattgtcagactacagtataggatggggaaatctaatcccttgtttttcagatgatgggtcctccctggagtgtgggaaagggttgcagtacaaattttaggttaaattcaactatttaaaaaataaaccttgtgatgtcagcttatatctcaaaacagaacttatgactctatcaaatttgtcaaacactcaactcaagagatgagctttcatcgaaaatatagtaccatatgcctcgatttcttacaatgtccaatgcgttatagtcgagacaggaaaataaaacaacttaccattcgacagctacagatgggttaatcaatttgtttcctggtaatttcgcaaataaccgccttatcttctagaaatgcaaagagtttgtcgcggggagaaaagggttggggggcctttcttcctgggttcagttcagtagacttgccgtttaagttcttcagacttgacnnnnnnnnnnnnnnnnnnnnngcagaagctttaataatgcttggagccagcaacagcaaagaaagggaaatccatccattaaaaatgacattgcaaccaaccaaaaccaacaatggactacttccatccagaccctctcaagattcttgtactccctccatttcaaaatgtttgacaccgttgactttttaggacatgtttgaccgttcatcttattaaaaaattttgtgaaatatgtaaaactgtatgtgtacatgaaagtatatttaacaatggatcaaatgatataaaaagaataaataattacttaaattttttgaataggacgaatggtcaaacacgtgctaaaaagtcaatggtgtcaaacattttgaaacggagagagtactgcatcattttcaggagttgtattgtaattctgacaattagaggatagttgtagatttattataataaggttgattagttctctgtagaatataccatttgcagaaatggtctcgaacgactgcaggagccaataggaacttaacaaagaaaattaagaatgaaaataagattcttttttttttgagagagaagttgctagtacaacaatctgcagatttgagaaaaaggaagaaaagttttggatgggtttgcaaaatgcagagagagaagaaggaggaggaggaggaagagtttgtggcgaggaggcttccaaatcagtcgctatcatacatctccctcccttaaatctcatcaacccccccaaaatttgttactttcggagtatatttatttactagcgcgacagtgccaatttcgcggcatctactgcttctgctgctgcatgctcctcctcgtcgccggcgatctatctcgccgccctgcctccgccgagatcgacatccaggtacttacttgaaccctcctcttccctttcccggctataaagattcgtttttttttctctcgatctcctcgcacccctctcaactcgcccaaattcgccggcgtttcgtggaggtggcggcctggttggggcaaactccctccgtttaatctttccaattccaattccaattcggtggatgcagcggcgatgatgctttgcggcggcgccttgattccgcgctcgacaatctactgtttttatagataagatcttcagtgagcgagatgccatccctgcagctgctgcagttgacggagcgtggccggggactcttggcctcaaggaggtaacaaaagtgcttcgcccaaaatactttcttcttcttcttcatcatccttttgctccaacctggaattttataagaagaacaaggaaaagaaacacattcttgtttgtgtgggaacaggaaaactcttgcggttgtttctggcgcgctgcttgccggaggagctttggcgtatgcacgctcaagccaaggccaacggagaaggcgttcagagggtgacgatgccaccactgcattggccaggaatggggacaggatgggccaaaatggtgtggatggtagattggccggaacaaagcgaagaaaaggtggcctcagatctcttcatttccttgctgccatcctactgaagaagattggaccaaatggcacccgctaccttcttggcttgacgttaactgcggtaatttctgccattctatgctgctgctgctgcactcatttctctatgtacattcttttttttatagaaaaaaagaagatcatgataagttcttatcagtagttcccacgaaataatttcaagcatcgaacaatttgtagtgcatagagaaaacattctatgatatgtaatagtacctaacactggattttcaaaagctatacataaccttattaactaaacaataatataaaatattattgtcagcattataacaatttcttttgcaggtgttacgtactgctgtgggacatagattagcaagagtccaaggctatttgtttagggcagcatttcttcggcgtgttccaacctttacacgcctaatcatcgaaaacctaatcttatgctttcttcaatccgccgtataccagacctcaaaatacttaacagggtctttgagtctgcgcttcaagaaaattttgacagatcttgtccatgctgattattttcaggtacattttggatcaatgttgattttttattggttgaattatttgttacttcccattgcacacatacctcacttgcattcatcccctgtaatatcctaagagtaccttcctagcttctgtctatcaatggaattattccagctggtatgcctgggaggactgtgtcgtacattgttataatggttgaagaactaaactagtgaccactgcagccaagataatagctgataaaactagagtttttcatgcaaagcatagctttgctatagaacataaatttaaaaaatatcctaaaagtgtagtgaactgggggttcaccatgctatatttatgtgccaacccttatttataagaatgtgtaatttcattcaacaatttcaatcattccgtagttgatagccaagggtgtattattaatactcggcggatatcatcaaccgtgctaatcttggtatggaaataatgtacaaacatgatgctcacaacttcctgatatgtcaaaaagagatgtcttttcctcactgagaaatccaaagaaccggaaaacttttaaatgatcctgttgaatttgacttcatattttaaagtactgactcctgaaactgaaattgttgattcatatgtttctcataccccatcgagaaaattgattttaccagtttctgcctgaggttatcttccctggattggttaagaaataactttctatttgttctagctggtttcggtattgaattatcatatttctcatttgtcagtgattttcctatgctattggattttgcaacaaattatagatatgttactaattacattgtcttgtcataattaagattgcgaggtttcttcatttttatatttatgtagttccagatcagattaatttattttttttgttaattattgtggaattacagtagactaacttgtgtgtgcatcttttaggatagaaattagcccatcttttgataatttacttaacgccttccattatgatatacaaccttaataaggtatatcactgcttcttttttgctgtatggacaattgcagaatatggtttactacaaaatttcacatgtggatcatcgaatatcaaacccagagcaaaggattgctagtgatattccaaagttctgttctgaactaagtgaacttgtacaggatgatctagctgcagttgcagaaggattaatatacacctggcgtctctgttcttatgcaagtccaaaatacatgctctggattgtggtaattttctaattgaaaagcttgattgccatttcatctagtaatgataccctttaacaattaggattagtgatcaaattatgctacattcctcttcttttcactgattctgtaatgtagatggccactgctttctcaccttgttatcttattagaatattagatattattaaaaataaatgcttttcagggatatatactagttgcgggtggagcaattagaaatttctcccctgctttcggaaagctgaaatccacagaacagcaactcgaaggagattatcgtcagcttcattcacgattaagaactcatgctgagagtgtggcattttatggtggtgagaacagagaagcatattatatcatgcagcgtttccaggctcttattgggcacctgaattgtgtactccatgaaaactggtggttcggcatgattcaagatttctttctgaagtattttggtgcaactgtagcagttgtcctcattattgaacctttcttctctggccacctcagacctgattcatccacacttggaagggctgaaatgttaagtaatcttcgataccacacaagcgtaatcatatcactgtttcagtctcttgggatcctatctataagcacaagacgtttaaatattctaaggtaaagccatatcttctgcacactactgataacatataggtccagttttgtcattgcaggcggcattttgcatgcagaaattagtgggtgctgtgtgcggcctaccaatctaattatctgaatctgttttaatgttttctgtaaatgcattttatcaattggcaagtcttatgctgctaactaaatacctatttgttgcaatgatttcagataaacatgttagttccaaacttgataatttgcaactgcacatcaatgcagaaataatgggcttgttcactttgttgccaaaatcaacattaccaaaatctggtaatgccaaattttagcattggatgtgtttggtttgatgccttttcaaatttggatggtgtttttgtgagaggaagctttcggaactaccaaattttggtaggatgacattggtaagcgcatgtttagtttgttcccctaccaaaatttggtaacaccaaaattttgtagggttgaaagtggcgatatagacataaagtgaacaagcccaatcttattacaagctgcatgcacaaatgaactagttgtccagtgaagattctaccaactaaagaggtggtggtgggatgacagagtcaccaccatgactaggttctttaggcaggagagattttgtcacaaaccataaagatcataaaccagtcgccatttctcatgaagagcatttcacttcttggttgctattccaagtataactcatatatttgtctgtgtgtattgtttcggtggaatataagtatacatgtttcctgttcctaatatattttacatatctttgccctttttaatatttcattgttctgttgaaatcacacaatttatgacattgtatgctgttcatggggcaaacttaatggtgacctttaccaccatgggttgcatttgctatctttgaattactcattttcttccaacatgattgtgacgcaaatgaacttccactattttttttcagtggctatgcagaccgcattcgtgagttactggatgtttcacgtgaactgtctggggttcgtgataaatcgttaaatcataattcctctgctggaaattatatcagtgaagcaaaccatatcgaattctcgggtgttaaggtaataactgcataaactgaaggagggtcatagtcgctatctacttccaaagttctcatatcaggtccttgcaggtggtgacgcctgctagcaatgtcttggttgatgatttaactctccgagtagaaaggggttctaatcttttgatcactggtaatcctcccctatcaaatgaatttggtttagcaacttttaacttttgtgatgtaagctgcacttaacattaaattgattgaaatttgaccttctaaacaggagaagattgggaatatatgtaccagtgcatctgtgcatgtatatttcctttatattttgtatatcatcctaaatcatctgctgttatttgattacgtggttatgaaatagtatgtgtcatgagatggtagttgctatatccacgtctactctagcctctgttgataccactatgcaattgtgaactgttcccatgattgcctgtgccttccctcccaacacatcaaatatgtaaagtgattctgttattatttccattcttactttgtatttatctattctattttcaattcactatctgtgctcttagggcataaacaatagtttcaaaatcgtaggttctacagtagtaattgaaaagtcttgttgatgtcagaaattttctaaaagaaaaccaataaaaaaatactggcccaaggttaactacagcatcatattgcaagttctgtgattacattaacaaaaaattgctgctgtctcgaaaggcactcatttgctagtcatattagttaccagaggtgctactaccaagttgaaaccattactgcttttgaatggcatgctccaaatttaccgcttaaaattgttggattatcttattttgcatgttgtgttacagatatttcaagtttgatacatctttgcatgatatgataacaaacttaatcgtccattgacttctcttatttcaggtccgaatggtagcggaaaaagttctctttttcgggtccttggaggcttatggccattagtttctggtcatattgtcaaaccgggtgttggctctgatcttaataaggaaattttctatgtcccgcaaagaccatacacagctgttggtacacttcgtgaacagctaatttatcctcttacagcagatcaggagattgaaccccttagctacgatggcatggtggaccttctaaagaatgtaagtaataggattcatattgatactcaattgccatttatattatgctttattgatctactactgagtacagggacctgctggattgtaaccttgctccttatgcaggttgacttggaatacttgctagaacgctatcctcttgataaggaagttaactggggtgatgaattgtcccttggtgagcaacaaagattaggaatggcaaggttattctaccataaaccaaagttcgccatccttgatgagtgtactagcgctgtgacaattgatatggaagaacgcttttgcaaaaaggttcgagcaatgggaacatcatgcataacgatatctcatcgcccagctttagttgcgtttcatgacattgttttgtctttggatggtgaaggagggtgggatgtccagcacagaaggttgtaaccctgaaataactcactgaatgtttacactctaaagttaattcggtagaaatttaattttgctcatgattttgcagggatgactcatccttttctactgaagagtctgactatacattattggaaactgatcgtaaatctgatgcgcttactgttcaaagggcatttatgggcagggcaaaggtatatgatttctgaacatttcttacttcatattcttttgttaataactaatattgtctgtgccgctgttttatgtgtttttttccatactagagcaatgcttcatcaaggtccaaagaacattgctacactacaaaggttatagcaacttctcccaagttggaaatagaacaaacaatacaaacacatagagtcccgcatttacggtgcttcccaaggcctctgcctgccagagtagctgcaatggtcaaaatattggtatgctatgttctgtttggtacttcgctagttttctctcgttgttattcctcaacaagtcaatattcagataatacggtaccctagttactgcagatattattgctaggtaatacttggttgctcctgtctgcaagttaatgtatatctgcagatgctagaaatttttgtttcttagtatactaatgtaagtatatacttatggaacttgacaattccttaatccttatttgccactggaatttccatgcaatctcttatgtgcccctgatgtctcactgatatctgtccctggacccacatgtcattgaaagaacaaggggcaaataagggaatgggtaaactttcaggggcaaataaggaatttatctgggtaaacctggacatatatctaaccaagcatatggatttatctcatggaagcttgtctcagatgttaatatattacttaattctaatgctgttctgatttccttgctctccaggttcctaagctacttgacaaacaaggagggcagttgcttgctgttgcactacttgttttctctcgaacttggatctcagaccgaattgcttcactgaatggttggctttgttcaatatcttactaatgtcagaactcagaagagctgcaaatgaatttcttgtctgatacatctcattttgtcagggacaactgttaagtttgtcttggagcaggacaaagctgcatttattcgtctgattggtatcagtgtcctgcaaagttctgcaaattcttttgtggccccatctttgaggtaatctgggagtaccttcatttcagaaattattttgcacttttatcatggtatcttgaataatcactttatgttccagtatgaataaagcacctgatgctttctggtcaactctttgtctaaaatattatcatcttctctagttgagagctattgacctgttgtaaaattgaaatgctctttgggtgaatgtttagatgctggtagatttatgactatttctccatacaactgaattcatggttttaataatctgtattttcacagaacccttactggaagacttgcccttggatggcggattcgcctgaccaatcatttgcttcaatattatttgaaaagaaatgcattctacaaggtacatcctctagcggactgcatagtaatagtcttctttttagttgatgctcagtgacactcagaagggacggtctttaaacattaggaagggttgtccgccggacttggccccttttatgaggtttagacagtgcgtttgtcacttgatgtctcaacacttgctatgttcgcaccttgttttagtttggtgtgcagtggacctgggttttagagtttaagaatgaaaatgcatattgcaacagatgtaatactaagggatttttgactcaggctaagttattctattatatgcttttaggtattcaacatgtcaggtaaaagtattgatgcagaccaaagattaacacttgatgtggataaattgaccaccgaccttgctggcttagttactggaatggtaaaaccacttgtcgacattctttggtgagttatctttggtatcaagcattcatatctatactttgtttcacttggtacatatctatcatatctaaaaactcactgtaatataaaaatcaaaacaaatttactaggtttacatggagaatgaagcttttgtctgggcgaagaggagttgctatcttgtatgcttacatgctgctaggtttgggcttcctgagagctgtatccccagactttggtcatcttgctgggcaagaacaagagcttgaaggaactttcaggttaatactgcatactttctttcgtctttgcagacctgactgctttgctgatttttctagtttcctagttttaacctggtgaactatgttacaaggttcatgcactcgagactgcgaacgcatgctgaatcaattgctttctttggtggtggatcaagagagaaagctgtgagttccttcacactagatacataatacttaaaatttgtttatgcctgcttgccattgtatttgttatctgtcttctggttatattattttattgtgaatcatgaataacaatgggtaattcaatgccagttccgtatttcatacttaacaacgatatatattaaccatgatgtcttgtttatattttaatagttggcttctttagatatatccagttattaagtttgtgctgttctgtttgacttgtttatattctaggtaatgaaataaactatgattcctgtttctgttttttaatgcagcttccctgttatgacccattgttcttgcatttattgaatcctttttatcaaaacaaatcttcagaagttagcttttaggagaagctaacacatagctattgcaccctaagacaagaacattcataaggcatcctttgttgtttgtatgctttatgctttgttattttacatgctgtgttccataaagtatcaattgacttgctgactccataatatgatacaatggtgtacgttaccttttgttctttcaagtttttacttagctagactttttggttttttatttttcttttcaatagtgttttctgcactattttgttagatatgatgaactatagtttttctgctaatgatttattctcatatatcagattgttgaggctaaattcatgaaattgcttgaccactcaaagattctgttgagaaagcagtggctttatggtattgttgatgattttgtaacaaagcaactccctcacaatgtaacatggggtcttagtttgttatatgctctagagcacaagggtgacagagctttgacttcaactcaaggttaataatcatcaaaactcgaggggagttggcacaaccacattatttcatcttgaactacactaaatattctacttttattttgtacaacaggagagttggcacatgctctgcggttcttggcatctgttgtgtcacaaagtttcatagcctttggtgacattcttgacttacacaaaaagttccttgaactttctggtgggattaaccggatttttgagcttgaggagcttcttcgtgtatctcaaaggggtatatttcagatggctatgacttcattaattttttctttaatttcttggtgaaagcattcttttccagtacttcatacatagtagggtacagtgatcatgcatttcaatagtagcattacaaccttacagggcaatagataatcttctagtgaggctattctatggtatgcccctgttttccttaaagatctattacattatcctatgacatggcttttcttgaggagtctataagtgctgtgaaacaacctgtctgattcggttgaatgacaatttcatgttcataacgttatcaatcaactgatgatatgctcactttttgagctttcattatatctattcatggtagctaagtattgactttcgaactgttgtttccctagatacttttgtgccttccgatgccactagtgcagaagaaaccatttcatttcacgaagtggatattgtaacaccatcgcagaaactgttggctagcaagctgtcgtgcaatgtggtacaagggaaaagccttcttctgactggtatgtggcctttcttctggcaacctttgaatacctttaattgagtagtaacggtatgctgacatttttttttctttttaccttggttcctgcaggccccaacggtagtggaaagagctctattttcagagttctgagagatttatggccagtgtgttctgggagagttaccaaaccttcagatgggatgtttcatgttcctcagcgtccatataccagcttgggtactctgagagatcagatcatataccctctctcaagggaggaagcagagatgaagatttgttcgttatacaatgatggtaggtgtcacttacctattggaatatctggtgttgaataaataacaactgtatatttcaaccttgtattgttctatttacaatgatacggaaactcaacggcaatccaggtaacgggtctagtgcttctaatctgctggatgatcacctgaagacaattctagtgaatgttcggttggtctatcttctagaaagagaaggatgggactcaacttcaaactgggaagatgttttatcgttgggagaacagcagaggcttgggatggtcagtgtaaactctgtttcagtctgttaattgcgatgaccagttgccgcttaaatccctttttattgaagttggagctgctgttttcttgcaggcccgtttgtttttccaccatcctaaatttggtattcttgacgaatgcacgaagtatgtgctgagccatgactttgattgacatttcttctctttatttgctgataaattagtgcggttcctaaaagatacttcattgcagtgctacaagcgttgatgttgaagagcatttgtacaagctagcaactagcatgggcatcactgtgattacttcctcgcaagtaagtattgacatgattcttgtgataatgacctgctgtgatcatcatgattgttggtagcaaacattagtccactgtagcactgaagcttgtccatcctgaatgaatggctgaatctatgctagctaccagacaccttagcttttagtgttgctgaatccttaccctgttgtttgcagaggccagctttgatccccttccattccttggagctgaaactcatcgacggagaaggaaactgggagctatgcgagatccaccaatgatttgtctgaccggttcgcatttctcggcattcggcttcccagtcccagctgctggcctgctgctgcttgttgatgtcaggctgtctagaagtgtgtacaattgcaaagcagctgttgtgagtgaaaagtacaggttttcagtctcattgtctttgaagaaagaaaaaaaaaagaccttgtcgacaatttggcgtagaacatggcatttgtagtttagttcatacggaggtaggtgatgggagttgcagggatgagcatagagagatgtggtatttgtttttaagtagataataaatgataaggtgatagtacagtacagatcttccggcattgttaatattaattcgataagtaataatgtggcttccttcttgctgccatcaagttatggcatataatgtatgaaaatattgcatgtaaatgcctagtgattcttgaatattgggtttgaagttgtatcagagtatcagactgctgcttcttgtccccttcttgcaactgcgttatcgattcttcaagctttgggtttgtttgtctttacaatgctggttcctcatgaatgcctgtgtaataaattattgctcttggagatccgtaatatttttgaaaaatgtttgtaattgattattgttatgggagattcataacatttgtgaaaaataaaataaaagcaagaatagttgcgaaaggaggaattactgttctgggagattcataacatttgtgaaaaagaaaattaaagcaagaataatagcaaaaaaggaaaaaaaatgacagctgtgggatttgaacccacgccctttcggaccagagcctaaatctggcgccttagaccactcggccaaactgtctttgctggcttactgcatataagaattattttaaatggtttataaaaaactggattgactaaagtttctgcatgacagaagaacaacaaaagatgatttttactgttaaaacacgttagaaacttgagtgttttatagccatactcctactcgtattgtgcagcctttgaatttgaagttctaattgagttttcatacgaagtgagtataattcaactgattagcttacttataatggaacctgtccaccgggatttaagtccttgaaaagaatgcttgtatttattgctgtttcttttagtgttaggtgatatacccacaaacagtgaggtatctttagtgacttcgttaatcttgacatatgttggtctagtcttttgaaagtgcccgtaggagtaaggtgtgtattcataggggtgaatatgcgtatattgtgagcgcatatatttgtgtatttctaaattaattttacatgttgtttgtttcctactccatctgccctacaatgtaagcatttttgaagtttttgatggagattaaaagagaactaaaatttatggttgtgatgataaagtaaaagaataaattaaatgtgagatttttgtgattttcaagatgattagatgagaaagtccgtggagaagttgctagacaaattctatatgctgtaagttgtattttaaggtaaatggagtttcctatttagctaaaaaataattagatgtttgaagttcaaaaaagcaaaaataaaggtaattaaagaagttgtcatattctggtacaaattttgggtgttattttggaccaaaaattgaatgttagaagtgtttgaagttcaaaaaagaggaatgtttgaagtttacttaaaaccaaataattagataactaaaaaattgatatatctaaacatcaatgttgaatttggaaaattttaaaaaagacaactatataagggcccatccgggttcgaaccggagacctattgatctgcagtcaattgctctaccactgagctatggacccaattgctgttagtactgattgtattttatttatactgtatagtgctactgagctatggacccagttcactttttttattttataaattagattagataatggtgtggtgcttagaactatttgcgtgtccagcaaagctaatgacaaaagaaaaggaaggcgttgttgctttaattgcaaataactttgcggtacctttacgtgtgtacgcagcttatttttattttcctaccaaacttgcgtgctaccgagacaacttagatagaaggaaaattgttatgcacataagtcacattgattacaagaacgattcttctttccaattggcaacgaaccaagctcattcatattcacaagttgataaactcagcacaatcacgaggaatcaatagaatacctcgtcttcttctgccaataagtttacctagcggctatcaacagttcaatgagataaaaaacgaccgaccaacctagttaaacacttaaagctcttgccagattgaggcagagaaaacaatcggttaactctacttatacccattaggtagggtaaacctactaacatcatgtccaaactccccacatattcacggcgcaggataaagaacaattggttcgtttccttacttacataaaacccagctcagcaatgtcgtccagtgggatttctaaggcgcctgaaagatcaaagtcttgtggtacatcaagatcatcagtaagccaagaactgatatcgttgccctgttcgccaagcccttctgttccagcaaatatatcaaataatccaggcaaattggtcaggggagcctccggcaatcgtgaagcagcattctcaggatggttccttggttgctgggtaatttttgcacccagaggaactgacggtcgagggggctcctgcattgccggtgttggaaccgactccacagctctatcaagaacatttccagaagtcgataatagctgtactatcttttgcttcggctttgtcttgtttttacgttcaccactcctcccactgcctgatgaatgacgccctgacttcgtaccagaacccttggcagatgcatctctgctgtgttccctttccctatcacacttgttccattttgtgccacctaaaaacggataaaggacaaattgattagtttatgaagcacgagtggacttctagtactgcaaatagcaccttgtaaattttccctcatgattcccctagggccctaacaaggagcgtaagaattaccatgatttaaagtacttctgtcttgcttttgatgcttcagtctctctacgccttaataccagaacgaaagaaggcatgaaattatatttgattgggcagaaaaaaatgcatactaatctctcttatcaaagttgcacatgtattaccttctgtagattttgtgccgctgcttggcaagggcgcagatagaacactccaaagggaaggctcactgaagcagcttttctttgtttcctcaaatttttggcaccgcaagagagtacgcttggcaaaatccaaagcaagctgttttgcagccttgctggcagacttactagcaccagccttgtgactagaaccagttcgcccaccctacaattcataaagatacagtcagtgtccaagtcaaacagttttcatctgcattaccctttctttttgctggaacaaaaatattgcaattagaaggcatcatcaacatgggttgacctcacaaggattaataaagaaataaaaaaatatctatgactcaactgattaactttgcataactattaagggaacttggattttagaagaacaagtagtccaacataacattgaaaaaccaatcatgtagagataagtttatactaccttaagttttcggtatgccctttcaaccaatttattcattgcatgttgctccaagctcctgacagaaaatcttaatgttagccagtgaagcaactcaatgcactaagcctctaagatctaatccaagaacataaaatccatacctctcctcgatactttttgtatcttgaattgctttctctaacttacttaatttacatttcttttgcttcacctgcaatggtaccattttgatatacataaataagaggtaaagtgaaaatcataaaagtattttaatcttccagaatatagtaatacatgaactgatctcaaaacaggataacaaggatcatcggccttagccagtaggttgaatctagaaggtttactggcttaaatctagaaggtttactggcttagagccagtcattggaattttttaaatgacttatttgaattattccactttgcatatataccctttcatcttatagtgatctggcagcctaccttgtcaccttgatatatactattccaatctggtcaagcggctgtgacgctaccagcattacaagcaggaattaatcaaagtacgatggcattcaaataacatctgatagttatcccagaaaataatcgatggcacattctcaatctatattttcccatgccaattgatgtcacttaatgcataattttcatggctcctatacttctagcacatgttgatacaagatgggcaagccaacttcacaaattgtccacgtgtttcaagaaatattttggaaaagaagtccttagaacaaaacaagtttcagtaatatgacaaatattttgatggtttacattttacaaggatctaacgcaatcattgtaaaataatagatgagtataagagtaataaggtaagcatccagatataattagagttgaggacataatactaggagtggttgttgatgtaacctgatcatgcagccttttcctcaactctgaaatcattttattgatgttattgtcctctccatcatctagctttggctgaaaagggtagtatttgcaagataagacaagaatcacaataggaatttactaggtaattacataaacttcaacatcctgtgaaaagattttacaaagaatgcaacagaaaatgacattagtcaccagaaataaataacacttgtgcactaaatacaatcctatagattctttttcatggataactaacagagtatagtgactgcatactgtgactaccaatgtttaggcttaactgataaagaactgaatatcattcagaaatcatcagtgttgatggctactttacaagattccttaaactatgacaaataacaaccatatagcacagcttcccactttaacctttatcttgctcatgatgagattcacactgtccgacaaaaaataattctatgcataaaccacataaggaaggatggcagggtaaatagatgcaacattaaagaaagagaaaaactataatcaccatcaaagttgctaaaattttgtcaattacaaagttgctacttttaaattttaacaagtttcctgaaattttggcatacagacttaaaagaactgcagaaagcagaactgaagtattgcgatgcagatactttccccagaaatgcagagttttaagtaaccataccactgcctccgggaaaatgccaatactttgaagctcgatgaaaatcttatcattcacagacatctgtccatattggtattcatgtggagatgaagagaagttttttcctggcttttgacgtagtgaagaagtctgcggtatcaagttatcaaaagggccattttcagggtatacgaaattgacttcatcagacaaattatcattatggactgaactttgactacttgaactgatgaaactgctggaagatgtgaacccattgctcaggctttgatgtacaaccgaagaattgtttgagttcatgaaatcaacactcaatccaaaattagatgatatggcactagcctgaagttcatttcctaagaatctgcttgcagcgcaaggaacatggctattagaaaattcaaaaagtatatccctttgtacaacattgggttccgagatgtcctcttccataactatagctgaaaggagtctgtgttccattgggaccatctcatgaaaccatttgtcagcttctatcttttgtggtacatggtgttggttttcctcactaggagaaaaacagtcaatagttccttttaatccaactccattggtttcgctttgctcaggtaagatagacgaattagatggaactagctcctgacatgaaaactcctgcagatttttgggacatgcgatgtaaggatacacactccatgagagatgaattgcatgaaaggagggaaagatttccctctcttcaaatagctaatggcacaaaaagtaacataccgtcgtttgctgcctgctgtaattggtgggtgctaaaacatattcaccatcaggcacgcaagacatgcccaaatcaagctcttcaacaatgtcaatctgtccacaaactctcaataagtgagaatccatcccaatccaacaaggaaataagtagtcaatcatcatgacacatcagaagcatactgggtaccaacctgtttttttaagaaagacaaattttcagagcttatgaaagttagcatgggttccattttcttccaaaatgggccacaatatgcaccaactgcacaaaaaaaagggaataagaaaggtataaagtgtcaatccaaagagatgctgacaaagttcatcaggcaaaaatcagataagactgtatacacaccaatagcgccgcgagcagcatttacagcagctaaaagttcttctcggtcatctgtgtgttcacctgcattgcaccactagttagtaagatatataagctaatgccaaaatttaatgtaaacggccaaagtacatagataagcgtttcagaaaatctttagatgtctagactcacaattaagagcctgagggaaacatgacaaattgttttgatcagaacctttcttcattgtgggacgccccaccttactgtacagacgtttaaagaatcaaatcagttctacatcgaaagtaaaatgcagcaagttgccaacccttaccaaaaggaagcatgagtacctttcattcttttcagatccaggtcgcccacctttgtttggctttcttgtctctgcagcatctaatttttctttcgatatggaagaggaagagtactctttaacatgcatagtacctctgccactcctcccttgacgacggacaccaccatcttgaagctcttctttcaaaggaatcgtatttttgtttgatgaaactattgatcctgctgaattacggactagatttgcagcctcgttctccacctcaccattgtttgtagctttctccttgaccttgcgttctttaacagctgatccctcactttctgacaatccaacaggagaagggatatcattcattgtgtttgccatttgtgtattgctactagttcccttttttgtaagcacaacaccgcaggactctgtagatgttggtttagcagcaatagctgtatcaagtggtgatccttcagataggacttcatcaaaatttgagaccggagaaacaacgtttgctcgtcttgtccgtgacattttctgtggacgttgaccgacccaagcaataggaggtgaagaagcatttgaatgtatggaacgtttgcggtttgtcatgcctcccaaaagtgatgctttatttgagtatggtatttcttcccattcgtcgcttcctccagttgaacgttggaaactagaagctgaacccatgccgtgtgaaccggttctcggtgccctgcatgctttagccttgggcaaaggactgatgcttccagtttgcatatcttcagaagcttgtgctctatacatgtagagttagcagatcattagaacaatgatagcattgtactgctcattcacacatatataaaaaacaataattgtaaactatgaggagaggaattctatgggtatacgccagaatgaagtaatgaactgtgcttacctgtttccttttaccataccccgctccttttcaattccaacataccgctctcttctttcatttggcagagtggcatgatccatatctgtcttgcatagaatacgggatgagttgctattctgctgagaacttccatccatcctgctacctgcatattctacggcagatgctccatgtctgcaatgtaaggataaagaagggtgagtagagacaataagctggaacagatcaaataaccacatatagttctggaagaggattaaaagtggaaacataaacagcatatattcaattgcagcttaatacaatctacatgggccaaacaaaataaacagcagatcagcccaaggtagaggtcaaaaataaaatctcaaaaccagtcttctgatgaggggcatatatatagtaatagaaccaatgtttgacttaacaatgtagtgcatgtcagccccgttccctattcaattcagtgtactaccgctcaattagtagagaactcattcacctaattatttgtgagtaatttccagactattgagcttaagtttggtattcaattagactaatcgcctgagagaaagttgaacatggctggtctgtcacaaaaaaaaaanctttgatgangtactgtacgantgacaatcaatnnnccacacttnnnnnnnnaaannnattaaattctgataaagaatatatgagacataacaactatatacgatcgtcctataattcacacagagttacatacgcacattacaatacactgtaaccagtattcgtcc

SEQ ID NO: 67367 - DNA, 1438 bp, Oryza sativa
gggagagcagtacagggcgcgagaagctcgggaaaattgggggaaatggaaaggggaggccggggatgctttttatgggcttggagtgacgggatcatgctcgagagaggtggcaaccggccggcgagatgggcggggcatcgtggggtggtggagaggttaaccggcggcgattttcatggggagagtggggaaaagggtggaggacgtggggcgacggggtcccacgaccggcgggcttgcgcgcggggtggatgaggtcggaaacggcggcgtcgtggggtggctcgggcggccctggcggttgcagccggccaaccagaggtaggaggaggagctgacaggtggggcctcgggtcccacctgtcggggagagagagaggggaaaacgggcgagggaggtaaagcagacttgagggagagagagagccgagcgggccgagggagaaggccggcccgagagggagagaaaaagggcgcgtgggccgcgggagggaaggaagacttgggccgaaaatggcccaaagagaggaagggggaattttatttgttttctttttattttaattgatgaaatgaaatttgtgctattaaaactatttctcgagctccgaaaattcacggaaaattccggagagtacattagggcacaaagaatattacaaaatattcccggccaatgatttttaaaggaaatttttaattccctcaataattcacttgattaagttgatttaacttttatttaatttctagaaaatgtattattaattgatttttattcccgaacgaaaatcggggcgttacagcttacaagttatggagatggtcggagctaaacatgtggaggcttttggtgattcggaattggtggtgcaacaagtcgccggagtctacaaatgcttggacggatcactaaataggtaccttgattaatgtttagatattattgccaattttgataattttgctattagacatattgctaggcatgataattctagagcaaatgacttggcacaacaagcatctggttataatatgaaaaagggataatttctggtattagtagagccggtgcttgattttaaatctttgtgcgatattggcaaaactggagaccaggggcggtctgaccggcgttgcacggccggtccgaccagtgaccaggggcggtctgaccggccgcatgtcgccggtctgaccggcgaccccgtgcggtctgaccggccctgtgtggccggtctgaccggttctggacagagcgctggggggcaagtttcaatcaatttggaagccgaattaattgtgaattcgtacatttgtgcctaggaaacagaagaagattggagaattcctttgattcaatatttgaaggatcccacacttaaggttaatcggaaaattcggcggcaagcgttcaaatacacattgcttg

SEQ ID NO: 67368 - DNA, 4050 bp, Oryza sativa
attgcaagcatcactagttctcctctattttagtaatattgacggtcgaaattgatcgataacgaccgtcaacaatgatttcaccggtaggattgcaagggggtaactcctcctttttatattagtatagatgcagctcgactgtgatcaattaaaaaatcaaactaaattcacagataattatgataccataacactgataattacttcattgccatagtttcgtgccaatataagcaaatgcacaagcttgatttctttacatgcatgtagtacaaggtgagtgttaggtcaacacaagaagcatactttattttacgtacatcgtacggtatattttctattgcataatttgttgaaacaataaatacacaacaaataatggaattacacgtgcaagtttgatgtggattagcaagttttcattattggtcattgtggtttcctgatttttctttacacatacaccaaaattattttttgacttaaagtattgccatggctttgcctcgcaatatgattttcatttaaagcaaaatatttacaaaacacatacaccaacatttattaaccatcttgaaattttgatattaaagcatataatttttttggttttcataattcttcacatacatttattctcacattgcaaatcatcttgatattttatttcagtttgaaatctatcattaacaaaacatttagagtaggttgtatatattaagtttattttttatgttatctaggccatttgtggattctgtacacacatttgtacaatatttgccgatttttattagcatatgctcacagttttgagtgattggtattcaactatctttgctgttccccattttactgcatgattgcattaaaacacatgccatacattgttaaaaaaagatactcctatgtagttactcctacttttgaatgaatagtacactatttggttggtacaaaatatacttgtgagtgaaataccataacaagagctatgcccccaatctaatacgagagatagtaactcaaatcaagaagaaaaccattgtgtaaaaattgtgtgtaggtacttttgatatgaaatgtatttgcatggtaaagtaaaattatacaactctataaaagatactcccactatcataagaattttatttacagagaaacacaaaatagccatgtagcaaatgcgtgggattacgtctagtatctcaaaatattcagtgacaagtttattgcaatactccatattccatcatgttattttaatatagttgaggacctacctatacaaatttggagttttcaattaattcaatgctaagagcatctccagtagaggtcctaaacacaacccctatactaattttgagagttgagactaaaaaatcaggtccaacaaggcccctacagagcatctccagtagaggtcctaaacacagcccctatactaattttgagagttgagactaaaaaatcaggtccaacaaggtccctactaaagcccctaaagtaggaaagcctccaaattatccccttaggcccccagtccctggggctttctccgcagcccccatccgcggcagagacgcacgggcacttcttttttcgtgcgaaatatcctgctagcggcgcctccacggatctacgccgctcctcctggccggcgccctcctcccctgccggcgccctcatccttggtggcgccctcctccctgcccgtcacactcctccccggtaggcctcctccttcccaacgtcctcctccttgccggcgcggcggcaccctcctcccctgtaggcatcctccctggtgccctccttcctggccggccacctgcccacccagcaatatcctccctagatcctgacgcccttctccctggcgctagttgaaggtatcatgttttcatttttccagtggatttgtggattgagttatatggtagcacctagcgtgttcgagagaaaagttgtcagtacgaaaatgtatatttggagaagaaatgggtaggaactaaccttccacgatgagatggttttgtttttttattatgtgattttgttttcctcaaatttttgactattaattaatacaataattaatctcataatccatatgtaatacaaatccgagacgaactcgaatccaactctttccaaagcgatttagccaaagattccaaaggagaaaaggtagaggagatcccggagattgtttcccctctattgattcggccggagaaggaaaggaacggccggatttggaagggaaacggcggcggcgcgaaactagggtttcgggcggcggcggccgaaggtagacgacgactgacaggtgggccccacctgtcagcgacagcgagggcgcgcgcggctgcggcggactgggccggctgggccgaggagagagaagagaggttttgggccgaagccaaaagaagactttttaaaacctttttcaattaaaattatttcttaaatgcaattccatttattaaaaatactttcttagctcaaataaatcccagaaaaatctaggaattatagaattaagcaaagtatttaaggaaattttatctgggcccattttatattggaatttattaattaaaaaattagatcttcttttcaagactttttaaaattatttctaaaaattccaattaaacaacaatttacatattttgaattttcagggtgtgacaaacctacccccctaaacagaatctcgtcctcgagattcagaagaactggcgaacagatgcggatgagctgacttcaattcatcttctcgttcccaagttgattcttcttccgagtgattactccactggactttgcaaaaacggataactcgatttctggttcttctctcacttgttgccaagatacggattggtttctcaacataggtcaaatcctcttggacttctatctgttcaagattagcttcttcggtaggtacccttaaacactttttcaattgcgacacatggaacacattatggactcctgccaaagattgaggtaactccaactgataagcaacctctcctcttctactgacaatcttatagggtcccacaaaacgcggtgccaattttcctttggtatgaaaacgatgaactcctcgaaaaggcgtgacacgaagatacacataatctccttcttcaaaactcaaatctctacggcgattgtcggcataactcttatgacgagattgagccactcgcaatctttcctgaattattttcaccttttcttctgcttcccttaggatatctgtcccgaaaacctgacgttctcccgtttgatcccacaaaagcggagtgcggcacttccgaccatacagtgcttcgtaaggagccatctgaagactagcttgataactgttgttgtacgaaaattctgcatagggtagattcttatcccaacttccaccgaaatctagagcacaagctctcaacatgtcttccaaaatctgatttaccctttcggtttgtccgtctgtctgcggatgataagcagtactaaaattcagcttagaaaccatctcttcctgaagcttcttccaaaagtttgaagtaaactgactgcctcgatcagacactatcttcttagggacgccatgcaaacacacaatccttgccatatacaattccgccaatcgacttccagaataagttgtctttaccggaatgaaatgagccactttggtaagtctgtcgactattacccaaatagagtcatggcctgatgacgttctgggtaaaccagtgataaaatccataccgatttcttcccacttccattcaggaatcttcaaaggctgcagcaaaccggcaggtttctgatgttctgccttgactcgctgacaaacatcacatactgctacgtattctgcgatttcacgcttcatacttgcccaccaaaatctttccttgagatcctggtacaccttagtactaccagggtgaatggagtataaagtatcatgagcttctttcagaattgcatcttttaaatctttgttgtcggggacgcaga

SEQ ID NO: 67369 - DNA, 6454 bp, Oryza sativa
cattgcaatagcctttcctgctaagagcgtctgctacaacattagcctttcccgggtgataatgaattcccatgtcataatccttaattaattccaaccatctcctttgtctcatgttcagatccggctgagtaaagatatactttaaactcttgtgatcggtatatacctctgtacgagtaccgaaaagataatgacaccaaatcttcaacgcatgaactactgcggctaactcaagatcatgagtagggtagttcttctcatgcggacgtaactgacgagatgcataggcaaccaccttcccatcttgcatcaaaacacaacctaacccaagtttggatgcatcgcaatacacttggaaacccttctttggatcaggtaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtcttcggttgtttccagttggttacggattccacattactaggatcaacggcaactcctcctgctgagatgacgtgaccaaggaacttcacttcagacaaccaaaattcacacttgctgaacttagcatacagttgatgctctcgtagcttctccaatgcaaggcgaagatgttcttcatgttcttctttggttcgagagtagataagaatgtcatcaataaagaccaccacgaacttgtctaggtattccataaacaccttattcatcaagttcatgaagaaagcgggggcattggtaagtccaaaagacataaccgtacattcgaacaatccatacctagtggtaaaagctgtcttaggtatatcttcctctttgattctcaactggtgataccctgatcgaagatctatcttggagaaaacggtagcacctttaagctgatcaaacaaatcatcaattctgggtaacgggtacttattcttgatagtcacatcatttaatgcacgatagtccacacacatcctctgggtatgatctttcttttccacaaaaataaccggagctccccatggtgatgaactcggtctgatgtatcctttctgaagcaaatcgtccacttgcctcttgacttctgccaactcattggctgccattcgataaggtctcttatggattggagttgttcctggtaccagatctattctgaactctatatcccttttgggcggcattccaggtaaatcatctgggaacacatcgggatactcccggactataggaatctcttccaaagttatttgattcagtcttgaccttaaagactcagaagacaatgcatgaacagttaccactcgaccatcattactggtgagagttacttttctgttggcacagtctatcacacctctatgtctggctaaccagtccatccctaggatgacatcaaggtctttggattctaacaagataagattggccacaaatggtactcctttaatttctattctgaccgaggggctacgctgcaaagagagtgcttgattacttggggtactaaccatcaaaggatgtctaagatcttctacttccatcccatgatttcccgcaaaactcatagataagaatgaatgtgtagcacctgaatcgaaaagtactgttgcaggaactgagttaacagggaacgtacccaaaatcacatctggagcatcttgagcttctgcagcagcgacatgattgacacgggcctttgatgctggtacagcagagttactctgggcagggacaaccttcacgcgacggggcttcggacacttgtcagcataatgtcctgggtctccacagttgaaacacaccacgggcttgctgccttgctccctcttggcaggctgttgctgtgttggagctgcaacaggacgtggagcttgattgcggatgttgttgccagcattgttgttgaagaactgacgctgcggacgaacaacagacgaagaacctccctgtggcatagactggggtcctaaagtaaagcgcggcttctgattactcccctgttgtgccttgaagtgagcaatccgacgtttcctctgctccatgcaattgtacttgtcctcctgacgtatagccttatccactaatttctggaaatcaggataatctccaaccatgagtgggtaagaaagctcgtcattaagtcctcccaaaaacttctcctggcgctcttcatcattgcgcacatcttccggagcataacgagcaagacgattgaactcgtgcagatactccgtaacagagcgagatccctgagtaagcgacctgaactccttcttcttgagagacactactcttgatggtatatgcgtcttccggaaagcagcagtgaattcaagccaagtgataggttcagcagtagtcctattcaggcggaagtgatcccaccattcagaggcagagccatgcaactgatgtgatgcaaaagataccttctcctgatcagtgcactgaagtaaatccaacttcttctctatggcatgcagccaatcaccagcttcaacaggattagtggtactagagaaaataggcggcctcacacgaagaaattctgctaacttgttctggggaggtgcatggttatttccttggttctgctgattctgaagttgctgcatcatcatgttcataagctgtgtctgttgagcaagaacttgggccagagttgggttctctccattgttattgttattggggttgttgggaccattcccgttgctgcgagtattcaccatctggcaggaacagggcacaagaagagaaaccgggggaaaactacttaggatagagaattactttaacttttattgatcttaactgagtttcattattacaaactgaagactctcacaccactaaactcaccaacttcctaacactcaaaagcaaacaaacgcatgcaattacatcccaccactgatgtaaatcacatgcgagccacacacaagcaaacctaaagcaaacaaactaacacaacgatctaagacaacgacttaacaagtcactctagttcttccaagcatcggaggtcgattgaaggctcgttcggctcgtcttcatcatcttgggttgctacccactcaatcttggaattggtgcgcttggattcttcttcttcatcacttatgatgatgaccggaggatccgcttgggatgggcaacttctttctccaccacacgaacctttggcgccaattgatagcgagggacgaatagagctctcttccttgcggtaagacgaatcctggccttctgcggtggtgcttctcccttcaatgcggctagctccttctccaaacgatccaccttgtcttctagcttgcaaatcttaccacgattccggtcttcacgatcttgagctgctaacacagtctccgcacgactttcatccatagcccacagcatctcaaccaaatgccttgtggtagcatcattctcaattccttcagtctcaaggtagctgccacggtcacttccctggggttgacgaggatggtagcgatactcagtgtcggccaactgatcactgtagctatcacggagttctcctatggcgatccttgccacttcctgacatgcatggacgtagtttcttcctccagcttcgaacatcactgaggggacctcttcactattgctgtttaaggtgactttgactcggcacttctcttcatgacgatcatgaggaatctgggcataaaaaggggcagtcccaaatccaatggcaaaggacatcgtacgcaactcctggacaaaaccctcaacaccaaacaggtactcaggcttgtagcgcggcatctaaagacaagtgaaaggagagagttaagacatctatccaattaacagcacaagtttttggattaacttgaataaaatttgaaaatcaaagtaaaaggtaagtaaataaagtaaaccaaacttgcaagataatttgaaatagttgaaaacaaggttacaaattttgtactttttaacaacaagtttcaaaagaaataaaagaaagttataaaatcatcatgctaaatttattttattgcagcaagattaaataaaacaatattgtaaaacttttgctgataaatgagccattagtacagtaatggatgtacagtactaataacactggaataaattttgaatgagaactattaaaagagattatgaaatgcatgtgccattagtttggtttaattaaaagagaaagggaggagaacagttctacttttccaatatttttagagggcttctatgggtaaccatttggcataacctagggtcaaggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaaacaataaagatctaagcagcggaaaataaaataaacggcgcagacggctccactccacaggcagcttgaccaaggctactcctaaacctccactccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaacaaaacagttaagtaatttaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgaaactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcacataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattatcaggttttagttggcacattaattaattaaccaatcacgattgtccatcgtgaactatcaataagccatcatgaaataatagtgaatcattagttatcccataagtgtgctaaggtttctaagcagggctaagcaattatatctaatatctagttgaaccaatataaataaagctcaactagtcaaattattataacccaaggtatcaaggaataaagtaatcaagaacaaaagggctataacaaacaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagtacataaacaagcatgaacagtacatgtggatatttttaatgtgtagatctcaattttagaaaaatttagagacttgaaccaactaaatcggatctaagatgaattagttatgaattttttaaagatttaatcggattaaaacacttaaatcggttaaaattgaattatgacgcaataatgaattatttttgaaaaggaaaagagggtttattgcgtcagcggctagggttttggtggaccgagcgtacgggcggcggttcacgcgaacggacggccgagatcgatccaatccaaaacggacggccgagatcgaacggtccacgaccggctcacggcggacgaccccgatgacgtcggcaatgacgtcaccgacagcggcggcggctcggcggagcggacggctcgggcggcgcatgctcgccggcgaacggcggcgcgaggacgcaaacggagggcaccagcacgtagaggacgacgcgacgaacacaccggtgaccaaaacggcggcgga

SEQ ID NO: 67370 - DNA, 23990 bp, Oryza sativa
ttgttacggctaaaatataatgaatttgacgttaagattttaaccctaggtgtaatacaattgaaagtatgtgtatgattttttctagattttttggtgacattttttagttggtgtgcacgtgtgtacacgtgagggcatgtgtgcataggatacgctcccggctttaaaataaggtttattgctggagatgctctaaaacctcttgttttgtggttctaaattttgaatttttagttttataacaaacttgagctatggctagtttattatgaattttgtagtcttgtaaatcttcgtacataaggaagaagaaaaaaaagttgaaaatagatagcctaaataaaaagaaaagaagagaaatgacgtcggaaaaaagaacacaataaccgacggtggtccccgctggcagcctctcacaccgcctcctgtctcgcctccccaccttgggtttgacctggactggacgtgccaaagccaattccaacaccgccacgacgcgactcacgcctataacgatagcccccctctcttccctcccctctcctctcctctccgcttcctaattcccctctgcatcctcctgctcgacgaggtacggacaccccccgctcttcctccctccctccctcccccgcgcctcgcctcatcgaatcccctgtgtcccgcggggattcggcgccggcgtccgcccaattggtcggcctcggctcgggagaccaccgattcagcgcctcgacttggtcgggctccccgcgggatctttggtggttccttttttcgggggattgttctttcatgctggctgctcgattcgcctcttgggggtttcgatccgctagcgttagttgttcctagggtttcttgggcgatcgtctgggtcggtaggtggattcttcacctagggtttctagtgaaattgcgtttaggttttgggatgatgttgtgcgccggcgatgggtcgagcagctttttgggttgttacggtcgcggaagcttcatcccgtcgtggatgcagcgtagttcctcggttctgtttaggctatttcccccctttagcgcggtagttgagtgtggtgtctggtaggctttactttgtactactaagctgcatgtttttacctcttgagatttggtgttgacttcttgttaattcccctccgcagcgtagttgaccccatatgtgattgatggatgatgaccgttccgatggataaagctactgcttccccatcatcaagggagcttgcacagcggctcttaaagaaggtttgctcttttcaatgtttctgcaatctgcattgcctgtgagtttctgtagtagcatgcaaggaaaagattaatggtatatgtgtgaagttgtcatgaaccctcttcaaacagctaacatgcaactgtttttggcatactgtggtcctgtgagctgagttgcgcagatgatctcctgtcaccatccatctcattccatgtttacagtcatctctatgtgactgttccttctgtccttcgtcccagacattgcttactgagcgttgactttccctatctgtgtgtgctatcgctgtatacatcgcattgctttgtcttcctcgcaccagatcatacgatcctatctaatgctcactatttcatctatctgtaactgcaattgtctaattgtgtttgtcggtttgtccagggctgttatattttcttgtaaacaatgcaatagttacatctttggttattttctttctcctaaaaacatcttttgttacctgcctttgtcacctgttcatgcatgtgtgtaggacatttttctgtatgtacttttaccattagggaaaatgcagcagaactgtgcacattatgtcttgtcccctttgtgatatgcccttggttctggcttcttcccatttataccgcattcgtcccacggtgctagttagcttgcacattaatcgatagttgcacacacgtgcttgagttgtaactgaacttttgtgcccacaaatttccatcccctttaaacagtttcacttgaccaaatgaaccacattagcatggtcagcattacaatttgcttgattgaaaaatggaaatgttccaggtgatgaatttaaaacattcacttgtattaaagctaacagttttatgttcctgtgctttgtgatgtggcatttgctagctacagctagctgtgaagtggattaattatggggcaattatttagtcatattggtaaatagatatagagcaaatggggtggtagctatatattttatatttcatgtttgtaacatatgtattttgtggtatatatatgggttcctgtgttgatggggtaaactgtgtttcaaacaatgctgtatttttaattcatatttgttgaagccttgtggaaaaagcgccaagaagtgaaaaacctctgtataatctactactagttggcatactggaatgtgtattcgttttcctctctgtgggttaatgctatctgacgatgtccgagagaagtttatgaccataatcacgttgttcatggaactgagttaactttaaactagatgcagatttgaaatgtatgtgatctccaccaaatgaaaaagctgtccatggttttgtggaacagttgactgctcattgttcataatatgtatatagataggtcaccttttttggcttctgagttgagatgttaaagcttttagaattttgatgtccttgatctagctttggagtgcctatttccttttactatttattggatgcatatggcctatttccttttactatttattgaatgcttatgtctgttccttttaattccttcactaaaattctctcctggtgctttcacatggtgtttcttccacttctatagtttatttcaagacatgaaaccttatgttgaaatagatagtgtatacgagtgagtaatgataatgatgttacttctgcagaacgctgaacatgaaagtcgtctgcgaaggtcagcacagtccaaagtgccatcagatcctaacatatggtttcagatgcgtgagaactatgaaaagataatccttgcgtgatcatgacttctctgaaaaacgtgagatagaatatcttctgtggcagttgcactacaaaagaattgaggaattccgagctcatattgtctctgctgggaagaacaatgccaatcctgatcggatcaagaggatcagatcttctgttagaagtttcctctcagaagcaactggtttctatcatgacttgatgctgaaaattcgggctacttatgggcttccgttgggctacttctctgagggtcctgatagttctgttgttcctgataaagatgggaagaaagtggttggggtgaaaaaaggcttgttgtcatgctatcgctgtttgatatatttaggagatcttacccgatacaaaggtctgtatggggatgtggattatgcaagtcgtgaatatgctgcagcctctatctactacaaggaagcagcttcgctgtgcccttcgaatggcaacccacatcatcaggtatgcagcatgtcgctgtagtaattttctgcaccattagtacaaaacttgttttgtgtgcttgaatggcgatggtactgatgaaaaggtttttgtgttcttgctcagcttgcaatactggcatcatatgctggagatgaggtaacagctatctataggtacttccgtagcttagctgtggataatcctttttctgcagcgagggaaaacttgattctcgcatttgacaaggtattatgctaccttcatgatactactttagtatgatccttgttttccagtattgtgattgggtgttgaagctatttttccttggtgaaccttgaaatgatactgcatgattttatctagctaggagatagtcgatcttgttggattccgttgttcaacagtttgtacacagaaaattcgtatctttactggtgtttagcctattattatccacttgtggaattcttatttagactagaaaaaatgcccgtgtgttgcaacgggtgaaggctattttagtcttatttttattgttatacggtttatcttgggtgaaaatcattgtgggaattcgcttgtatatatatatttttagaaaatcatgagttgtaattaggagtctgactctcgtctcaagttagcatgcgagtttttttaaaatgatttcttatacgactccttttgtatttccaaaagcgtcccaagttagcatgcgagattttttaaagagatttcttataagatgtcttttgtatccaaaagcgaacgaacttaaaaaccgactcaaacacagatctgtatttctaaaagtgaacgaacttaaaaaccgactcaaatacgaatgacctaccaaaatactgataaaaacatcttcaatttttataatcttatttagattccataagataagaaatgttctgcagtttaccaactgggtcaataaaaacgttcttacttatattattattgtacagctgttctttcattgattgcagcgtgtctttcatacttcctccctagaaaactatagagtgtactccctccgtggggtggaggaagtataatattttgaaaaggtcactttttttttattttgaccaacggttgtcaaattataagtatatttagtgcatagaagttataccaatagattcatccttctaagagcttttataaaacattattagttttataagtattgtaaatatattttataataaaacacatcatataattttctcaaaagacttcttcaaataatatacaccctataattttttgagggagttctttatagtatctgatgcacataacacaagaatggagaaatgcaccgtttagccttgcagtagatttggaccagtgtgtacaagtgcctagggggtttctcctgtcagcttcttattatatttgatgagcaaattcagaatccgaattttgctgtgcggtggatctcaaacgcttatagtttcatatgcagaatcatgatatctatgctcagctatcaggtaatagcaaggttcccaacgctaagagcttgccatccagatcagttggtagggccagaggaaggggtgagacaagatttcagcccaaaggttctagtacagaagaaaattcaaaggagcgagagcacagtattcaagaaatactgaaggctttctatattcgatttgttcgcctcaatggaattcttttcacaaggacaaggtacttcgtaaaacacttctgtgactcatcttattctctctttctttgtctcctaaaatgtcttgcttttttcctctaatagcttggaaacatttggggagttgtctgctacagttatcagcgatttgcaaattcttctttcatctggtccttacgaggagcttaattttggtgttgaggctgctgaaaacgcgctttctgttgttaagcttattgctatccttatattcacagtgcacaatgcaaacaaagacgcagataatcaatcatatgctgaaattgtgcaacgcagagttcttcttcaaaatgcatttgctgcagcctttgaatttgttggataccttctcaaaagatgcgcagagcttcatgatgttgcatcaagtatctacttgccagctattttggtcttcattgaatggctggcgtgccatccagattttgtggctagttctgagatggatgaaaagcaagccgatgcaagatctttcttctggagtcaatgcgtgccatttatgaataagctcattttgactggtctcgcacatgtcgatggtgataatgatgaaacttgcttttttgacatgggcacatatgaggagggtgaaactgggaacaggcttgcgttgtgggaggatgttgagttaagagggttttcgcctttggtacctgctcaaggtatcttggacttctccaccaagcaaggttttggaagtgatggaggtaccaaggagaaaaaagcacgtgtagaaaggattcttgctgcagggaaggcgctgttaaatttcgttcaaattgatcagctgcgaatatattttgatgcatcctcaaaaaagttccttatggcttcagaacctcctcctcctgcttcttctgttcctcttgttgtatcttccaatgcgcagacaacaaatcacatacaacaggaacctgaagtctccagtaaaattggttctgtcgcagaagatctaggtgtgcttcagtcaaaggcacaactctttcttgatggagatgatgatgaagaaatagttttcaagcctccagtttctgaaaagcttccgagagttacttcagaacagactagtaatgagttattacagccagtggtggtgtctgatgtcaattggtcaaatgatggtgcaccaccaccaatgacatttcagagcaatggaccggttctgactcccaatgtttatgttcaatctctcccaatctcttctcttggttgggcagccaatgctgggcaacatgtgattcttgatgttggtgcaaggtcaacatctgatatttttgagtctctgaaagcacctgatcataactgggtaagcactggtgcaccacttgttggctcactggatacagtccctatggcgagcttttccaatataatttcggatcagcgtacacctccatcgtcactcggttgtttcagtaacccagataatacagccatactccctgggcaagattcattcttattgagtgcattaaacaatgttaacataggtgcaagtggatttctggatcaaagagtgaatggtggactcagtggattacagtctgtgggaaatgtgcctcaggtatctgctcaagctactatgaatagtacaaatccaatgattggtcagtataaacatactgaagttaccatcccttctgccttctattcagttctgccgtcagtagtatcttctgatggtgtatcaaagaaaaatcctgtcagccgtcctggaagacatgttggccctcctccaggatttaacaatgcccctccaaagcgacaggatgattccattttagctggcaatggccagcatgttcagaccaatgacggcatctggttggatggctacaggtcatcactggattatgtcaataatcagcgttttgcacattcaaatgttaccactgccagcagtactttcaccactccctttccttttcctggaaaacaagctttcagcatgcatcctagaggtagcgatgaaaaacagtggcaggatttccacctttttgggcccacaaagcaacttccagaacttaattttcagcaagggaaccagcaaaatggtccactggcggaacaattaccagcacaatctgcatggtctggcaattaccttgtgtgactagcttgtaccatgaaggttaattttttttcttgggtgcctcaattttgatagagtttttggatgcagaactcacctccttttgttgtacaaatacactgaaattctctggttcaaatgtattatattctcttttggtttcaggatttgctgagaatctgttgggagtaagtggcgaagattgacacttgaattcggccttgataagtacagccctgtcatgtaatgtttcttttggaagatgcttgtcttggaagcataacaagtgctacccttggaactggtaagttttgaatgcacttaattgtggtactccatttcattttgtaatgcttctattccttgttttgtcctcatttatcagtctctctcttacactaatatctcacctaatacacctcactaacaccatcatctctcctattaccaagaaatttaagtatagtatgggtagcatggtcattttactcctttttcgctttgtttcatactcttatgaatgagaagacgcataaactttatctagccctacctttgccccattagactgtttatctaagattatgtgtttcttgataaatgaataattgaattacatctccttgattcaatcatttatttccttgctaatattaggagttcatttgtaatcccctggagacgattgtctctgtcacaattctttaattgatttataccagctaaattaatagtgcagtttaattactttttagttttgatattttgttttttcctattaatttctgcctcatgatacgctagaatctgaagttattatcaaattttaacttgaaaatttgtctaatcttttaattgaacgtcagtccccaaataattcaactaccaaccacgtgctcagatgatgtaattatccagagaagattcttcaactaataaccaaacgtatcatctaaacaactaatgtatgctaaacaatcagattatgtcaattacagatgtttacctgttgacttactgatttacagggtatggcaggtcttccaggctatgaaggggattttagatgatcccttccattgtctgatgagaatatgtacggagagttctttaacttctcagacccagggttttgacctaatgagtaatctgcaattctgcatacgggcagttactgagatgcgtcaggtaagtccgtggattggttgctgccgtggaaactgaagccttcacgaacgaatggatgaaattctgtttttggtggtactcttgtcgatcagagctatgaataaagttggtgatgactgcttcatgcttgtggatgttctttccagctatattgttcatgtggtacattgttactgcaaagtcattaaatacacttaaggataaatcattatgcagttgctatcatatgatgtgctatggtagcaacgtttcgtgttggtatttgtgtgtgaaccaaatgtattatcagcttgatgagctgatcttttaaaacgtattgacttgtaatatgttgtacagaacgtcttgcttgttttaataccgaatgtcgtgcttgttttaatctctttggttagttgcttaaacaaataattgaaagggtcatttaggtttagaagggggttgttgtgaataggctaatttaaaaactcaattaggtgcggaagctgaaattttcgaatatatctgaaggaggttcggatatttctgaaaatggcagaacagcgacaaacgcaatagaaaattggatctagctagtcacaataaaaaatatcaagcacaaacaatagcaaagctagggaaaaggatatcactgaaatttgttccttggaagtttgaatccatgagggggttataattttctttgaggagctcacaaaaacctggtcttcactgaccttttcctcgagagcttatacaaagcattatttcttccattagtggtatctcttctctttcggaggtgagattcgaccttcataaacttcactatttttttccctagtgatatctctttcttttcggaggtaagattcggccttgacaaacttatgctagctaaccatacgtagattgatagctcaaaagtaacaactagtcttctagcacttcttaacctccaaaagtaaaggatggagcaagaatctcaatgggataaaatacgtcctcaataaatcttcacgaagtcaacacgaaacactcacacgaacttaaatccacaactttcacacaaacgcacacaaagtccgagtttgaagatcgatgcagaggagaaataagagagcaaggctcaaaagtggatctcaatgtaaatcaagccaaagacaataatgttcaatagcaccagcaaccttggcttggaaggggaatgggggtatttatagtcgcattctcagatctgcttgttggtgggtaaatattctctttttgtcatggtggccagatgatgggtgtcctacaaatcgacgccggcatgctgccgagctcgcctccatggatgctagcctcctgtgctcctggcgacgacgcttggtcccggagagccaccgtcatcgtgcctgtccctgcctcctgtcgctccagctcctgccgaaccctatcccctgttgcttttgctgtattgttgacggtgacgcaaggatcgtcgacggctcctacatggcgagacacggccccgccgccagcggcatcccccgcgtcaagctcggcggcacgtggtggagaaagccgccgctgacgactccgctcagcggaaagaggcgaagaaggccaccatggcggtgacaacgaggatgtggacggcggcattgcctccgtcgacgcgtcgccgaacctccttcgccctccggcctcctccccacccgtcggccgccctgccgcttgcccagtgagaacattgagagaaagaggatgaagggagaggaagggaaataaaagaggtgatgaagtgacatcctgacatgtggggcccacgtgggtcgctgatagccaccacgtcagacaaaaccggggtcaaaaccaccgaaggacctaaagtgaacgattctaagtggatggatgtcctatatctggtttttgcggttgggggatgattttgtaactcgatgataagttgagggactttcggtgtactttttccttaattgaaccccattacatttgtttgtttgttttgggtggcctgcaatcgaatacactgcaatcagatccgggcctagtacaaatccgttaccgctccaaaacgagtggtaaagcttaacgatacggagcggaagcaacgcttgtgttgtcgcgagtctcgtgacctagcctaagcgccgccgccgcttcgccttccccacgcgggtcgccggcgcccccagcctcaccggtgttgctccccctccacgcgctcgccaccaccgccgctccccgagtcccgtgcgcgccgctgtcgacaccggagcttggccacctcggcaaggccggtgacctccaccacctccagagtttcgtctctagtccattcatggattcgaccctaacaagcggcttgacttcgccatcttcaaggagactgacctcatcgttcatcgacatctcttcaaggaggccccgctcccctagcccctagccgaagatcctgaggtacacagagaaggtgcccaggaggttctcttaccatcaatcactatgttttcgtcgttttcacggtcaatcactactccttgttggtgagaacccctgctgaaaccatctttttttgtccaactctgcaacctctgaaattttctaataacatcttgggccaatccattcttttaatcagtagtgctcaagatttatgatgatatgctttaatttgatgcaattttcttgtgattgatcttgaagtaagaattaagggatggtttatttttagcaaaagttaatatgtactcttgttcatttgagtggcagcttgatgtattatgtgtgctaccgggatatattctggatataggtttaataattgttttgatttgtatttttttataaattactatggctcatcatcccttcccttaagtactaaaatctggagaagaaatgtaggacttagaaatatgatgattgatattaaatttagagtaaaatacagcagcggtccttaaacttgtcgtgaggtttcacttaggtccacgaacttgtaaaacgtacgtcgagatccctaaacttggtttattgtatcatcccggtccaaagtctcgtttgaccgtggtcttaccaacgtggcacgccacgtggacgatgacatggaattttttttctcccttcttctttttctctcccttcttctccttttttttctcccttcttcattttcttttctctccggcggccgctgcaccacgagctccacagccgggcctccatctccttttccatcagcctctactccactcgccgagccaccgtgccggaggcaagcacgcgacaggagggaggacagtggcgctgacgggagggaggggacggcggcgactcggggaggaggatggcggcgctgacgggagggagggggacggcggcgcatagatgtcctcctcgatctcctccggggtgagtgccaccaagaacggcgcgctttctagcgtcgggacgaggacggcacgggcaccgccgccgcccacaacatggagcggctgggcgccgccgtgtccactgtagcaggttccacggcctcgctgcaccgtccgcttgcggctgtggcagggcgagaagtggaggcggaggcagggccttgaactcgggctcggagtccatctctgcaggtaggctctcgggctttgtcgtcgtcagcggcagcggggggtggggggctaggctggggcacgcggagacggttggcggcgtctcgtaggtgacccatgagcttcacccaaagctcctcgatcccaccatcgaagggagttggcggcggcggctgcccccacggctcgaggtggtgcgtcgacgtcgcggcgggcggcttcgcccgcggatccgccgtcgccgctatggccagcttatcgtcagcagctacggtggcacggcgcggcgcggagaggcggcggtggcggcggccgagtcagcgaggaggagacgagcggcagaggagaggaggttttgaggccacagcgggtccaaaaaaaaagggagaagagaaaaattccatgtcatcgtccacgtggcgtgccacgtaggcaagaccacggtcaaacgcggctttggaccgggatgatacaataaactaagtttagagacctcgatgtgcactttgcaagttcgtggacctaagtgaaacctcctgacaagtttaaggaccgctggtgcattttactcttaaatttatgttttttcctgaagtggcgaggctgtaagtagacacttcaatttatttctcaaatgtaacaaacattttttatatttgtctgaattaattgtatggaatttctaattatttgcaaataagaactaaaaaaagaagtttgtttattaatgttagttttctgttgaatttctgttagttttctgttgaatttctaatattgcagtgttacggagcttccttaaagtctaggcattatgcgtggaagaggcaagaacaaaaggatttgaaggtattgtttgagctttctttggatccaaggtcgaaatcaaaagggggtttcaaaaatggataccgtcaagttctagagagcgtacttggtaagaggttgccaaattcttgccttactgctgttctgcacattgagtcatgagtgatgcactttaggaccaagtttggtgcaattgagtcaagatggtgcagtgcgagaaacaacaatatgatgatcatggcagagtaagtcattgaactaattattgatgattatggttgcatcattattctggctatttttatttcatgaattgatcccagtgacattagatttcatgccattctattaagtatttaacaattaactcactttattttcttatgttaagatttttttagtatcgcacgaaatctcactttcttttactcactttattgtactgcacatctacattgtcagtagatgactaaatgcatgagtattatgtaacctcgcaatatcttgcttttactaacttctgaaattttttattaccagatgaagcaatgaagaaaaattcatgtgatggctatatgtcatttaatctatcagatgctcattacgagattttgaattcgtaggtcatttgacttcgggattagaggcctgcctttatttttcatgagcatgttcattttcagtactttgaaattttataagcttgcactatgacagtttgtaatattgtgcagttggttaaaagacgataagactgctagctactatcataaacatgaatgtcacaaaatctggtactgttgtataaattgcgttcaacagcttggttgtcacaaaatgacttctaaaacagagaaatagaggatttaatttgtgttaggtgctttcaagcatgtgcaaattttaaagttgagaacttttcatatacctttgatgagttggagacattttacttgtttttatgcctatattcttgtgcaattagctatgtaaatcgcgtggtttactcacgtttgtttttttctttattacatgaagatgagatgttaatataatgatgcgtccaattctctgctttgtgatgcatggtgtccaatatttactcgagtctgaagtagatctacaagatcttgttcagagatcttccaggatatgatgctaggctgatattagatacaatttcatgacttctaactagctgctttcaaatatttgcatgccgaaatttgttgagcttctttatgtagcttttgatgtcagctgctattgatatagtactggagtgtatcttccgcgaatgtttcatagcatatgccatgcgcttaattgcatacttgtataccagcttcatttaatcagttatttgatcaatagttgtctggaagcaagcagttctccaagcaaatgatcttcccaaaagtttctgttccaaatttcgaatcgtgtcctgtggatcggcctcccgttccttggctgcaaccctcaaccaaacgccgtaatgtaaacaaatgatgttaccgtctgcaaccaaactaaccgtgtaatcggatacaatggtagctgttacggccggtggcaataccatgagagtttacgttaccacttccgaaccaaacaccaccctaaggtacttcagacagttcaccacccgccgtaagggtctataattgccgcttcttcctctgtggcctctttgctggggcagcacttcctcctttgtctgacgagcttttcgcctctgctggttgctttggatccctcctcttcccttgttccgcgaccaccttatcaactgcttcatcatcactgtcgtcgtcaccactaccctcagaagaatgatgagctttcttccacgagcccttcgatgtctttgctggttgcttccttcctctctttgattcttttgtatcttcctcatcctcttggatctcatgggttgccttcactaattgcttccttcccctcttggcaggtttagcctcttcctcatcatcgtccacttcacgagcagctttatttgatttgctctgttctttgcttattttcgctctgcttgctgttgcatcaatcccgtccagcttctgcaactctggcacatatgctgaagtctgaacaaacaagtgagaatgggatcagcgatcagcgcaacgcatgaaagatatattgagcttgatccaaatgggtaaaggacttaccctgccaccaactgtaatgaagtcaattttcttccctgcaagcaacaaaactcaatcttcaataatgctaagcatcacgaacacatgttttaccaaagaaaagatgatcagaccctccacaaaggccttgccgggtttcttctccctggagtgaaatatccagttttctggatactgactgctgttgcaaccaacttctaaggacttttcaatcacctagagtcatagacacaaaaataagattatcatacacagaaatggactccttatgccaataatgacattgcgatattattgggccagtaaagacattgcgatgaaaatactcaacaggtaaaccagattcctattgggcttaatatgccaatatgttgaaacatttctaatattcagttatattttcaatgtatatgctaacatgatacattatataagaggtgtttttcttgagttcaggcaagacacaaaaaacaactgtgcatatctagtattcagatatcagtatatgctaacatgatacattactcagatatcagtatctaattcgtatataaaatgcaatcatttttttatatatggttgaattgataaataaatagaaaatgcacccaagttcacaaatcaactagatgggtacccttcgtgttgccgtgggagaattgtgataaaatagtcgatatgagttataaaattttcttttttacttattataccattttctttcatttgcttatatattttgtacattaatcaattatccaaaggttataaatgattgagttgtatggtgtggcttgtggggaggagatgcaatttgcacccttgatgaaatcatctaaaggccaaaaacaattaaggtgatgtagcttcatgagagaagagagaatagcattaactaaacttagtggggatgaactttataaatatataggatgccacatgctatccattcctaaagaacaaccatgtgacacacatcacactaacctctataatgcactgatggagtgccttgcatttctccttagaaatcatcgatgctgtttgcattggatgaatccttgcctacgcatcaagcaagcaaaggatgaaacatgcctatgtttttttatgaaaagaataacacaaaaaataacctagtattatacaatttagatgcccaaagaaggttatgtctaaaacaaggccacatctttgttggttaaatggaagacaaattttactacaggatgctcaaaatttgtgtaatttgctggcagacatcgtaaaaacatgtcatggctgaaagacactaaaaaaactaggaatttgccggaggacactttcaaaaaggtgagaatgcccctaggccaaaaaacttctgacctgaggatgtcgtgaagatggaatatgatgtatgctagcaatgtagttggggtaacgacagatttacagttgcatagttttcaaatattcactccaacaccatgtttgaagcctatggctccaggggtattatcccctatttgaagaatttctcactccaattgagttgagaatgtcctccggcaagctaccgattttctagggtgtctttcagccgtgacatgtttttgcgatgtctaccagcaaattacacaattttttgggtgttctgtagaaaaaaatgcctaaatggggatacatgatattcccatagaagtagcactttatttgacacaatcacttaaaccaaagctaaatcccacatgttaggttcaacatcatatctcatctatggcctatatcatgaggattgggtacatggaagaaacaaatggctcaggattgatggcccggagaagagaatgtgttacgggcttaggtcatgggatggagaagagagaacgatatatgggtaaatatattattctatggtcaaacacttaaactcaaataaagctgcccattttatatgacgagacaagcccaaataagaatatctagccaaccagataactaagcaaataactaatctttagttaacaaattggagtactactactaaacatgtaattcatgcacaggtactgcaccatttccagcacagccgagctgcttgtgacatgtgccaattgggcctgctgccgtggcctccaaacaacctatgaagctaaggccctgtttggatcatttagtctctggactaaaattactaaattagtccgtagactaaaaactttaggcccctactgtttggattcagggactaaaagggactaaaggcacgtggaccgagggagagagaagagaggctgccactttagtccctataagttcctccaagagggactaatggaattttagtcccatatgcactttttagtcccttttagtcacccctgtttggattcttagggactaaaatggagggactaatggattagtcccatgaaccaaacagggcctaaattattttttacaacactggatacaatattcaaaattttgtgtgtttgggcagcgaaaagtttttggtcagcaaataaacatgtaatgtgtttgtacagtgacagttttctgtagtttcaagccaactctagggaaactgacctgataaagcacttcatctgcaatccaattgccaattcctgatataaagctctgaaaaacatgattcagaaaaacagtcttagaagctagcagaatcaaaagtgtagtatttactgtggtatttagactacatttgggtataaaattgtaatatcttaatttactagtcaaacacacaaattactgactttcaggttcactaaccaaatctgggcaacaattgacaaagacaactttttagttatttctgattcccacatatataagggaaaatttcgccttctgttactaagcatgcataatttcagatatccaattgttacactgcagatctttgatcagagaacggagcattaaagattgatacctgatcaagcaaaagggcttttattggagcttttttcctacttagtgactctacaaaatcatcaagatgaagaggttcaaataaggcatctggtccaagctcagaaattggtgggacagcttctggctattataacatgcagacaaaattccaaagtgaattactgcagcatactgaagctataaactttgaagtcaaataatcactagagagttacattgtcaagaaagcgaatttttgcaaaacgcctcttatcagtgaaggaaaactccaaaccatcatccatctgtgatgttgacagaaataaaaatgaacctgatgtaagttaaagtgttaaacggatcattagttgacgtctgcctcaggactgaactgcatggagtatcatgagggattagagcatttccaaacagaaagtaatattcttttcacaatatggagagaaggaaaaacaattaaacatgcaagcaaagtcaccaccaaaagtatgaattccaatataatatatttactagaatccttcaataaacttaagtgcaatgcataacatacatatttcaatcattaataaaattaaaaagactgaacaagataaatatgtccaagaagcagaacccagagacaggtcacaaatcacataatcctacatgaacaacccctataacactctcggtgttaacttaggtgctaggcactagatgggtggcttgctagcacctaatgcatttctgcacttctattaatggaataaattcagtttgacagcacacttcccacggtgaccttatctagaagtagataatatatgcaaaaagtacataaacctcacacaaacaatattgttatacttgcctttgaaagtattttcaaaacatgtggatttagctcctacaatttactagtacattactataaaatcaatgcagtcaaagtcttggattgaagaccacaaaaacacaaaataatctttatttggatatggaaggagtatttcaaattcatcagtgaactggcggatgcattaaaaaaataggtgtggaatagaagattagaatccatactacaacaagcagcttggaatacttcaaaggccattcctcagtcgggctcactgcagacctatatcaaatgccacacgaaaaatatgctaaatattttagttgaactagccaaagtgtccgtgcattgcaatgggaagaaaatggaacaaattgtgtacatggagagagagcatgatcggcaaacaaccaagtaagatggcaatgtggaaggagagatagagcggttgttctacggtaatgaaggcgacatatgctagagcaagaggggatgggattttgtttagataaaagaactgaatttctagcataataagccgattatgaactaataaacaaaactttcaatctttttatgttcttttatacggtacatacatcaattagtctgccccatgagtagtacactattcaaatcatgcccaccttcctaacaaaaaattatacaaggaattttcattataaatactgactagccaaaaaattgataaccggcacaggcaccaaccctaaaaatatgtatgtcaacccctatatttatgtgaaacaataagaacttaattttattttaatatacggtttgagtcctttttttgtcattcggataatttaattcgtttctaaaaaaagataattcaactcgtatttttttcatttaccaattgaccatgcgatgggtcctccagggaaaaaaggaaattgtttcttgcacactgcgggcctaccttggagaggcagcccacagcatggcttgcaagcagcagcacctcaccgagtcctatacggacggcaacaaaaatacttcaaatggaagccagctagctatgggcctagcccaggcaacaacacgggccatacgcaccgacggcagaggacaagagtgcacaacgcatgcaccaaatgggaacacatatacaacacggacgacgtaccaaacgtttggcaaaaacatttacagttcttataatagtagagataaactacaactattccaaccaatttaatagacctaacggacacttattaacacttagcagacacaaaattctagtggatatatattatatagacatgatcacatattgaaattctacaagactgttgaagtattgtcacagaggctggtccactggacataactagattgccgctcaaatgatttttttttttggtttatgcaagcatattgctttaataatatcccaaataactcttatcacgaaataacatccacccatacaacccaaggaaggcatattcacattatgttttctctagtatcaatgaaaaatagaaaaaagtatatgaaaacgttgaccatctatctactaaactatttgtcgtcatagcttttcacagatttttctgacatttctaaaaaaattacgacaaaaaccataacagaatagaatcagcacagggtgtaattaacagtgtaaccaaactatgtatttgattgtgtctctccagttatgtcaattggaatcataacactttcctgaaagtggagtaaaatcatctattcgccaaatatagggcttcctaaggttccacgatttcatggaatacaccaatagatgaaaattttcttttgcagaatcaccaacaggcatcaagaacattaggcggctgcaaatgtttcagtacaaattgattgtatctgctaatgaagaaaagcatgcagaatagtcctaaatagttaaatataaagctaatacttaatattgtatgattgataagccatttcattgtcttgtttaataaattatgtgccactgaccttttgtatttgctcagttccacacccttgatgtaaatagctccagccattcctgtaacagaaactaacaattaggtactgtttgtaactttgtatacttagaacttaaaagggttaatgcactaaatgacccctgaaattgacagtggcctcaaattggtccttcaactattaaaatgtccaaaagcagccctctaaacatcaaatttggcccattttaatgtcaatgctggcacactgagttagtgccattgcacttttgctgagtcagaatcacacatggcggaaagactgaattgtaactcggcaaaaactgtaaaatcaagatttttttttctctcgaaaacgcagttgagctgcgtttcatttcattaataaggaagaaaacgtatttacaaagaaaaggggcaaagagaaactgtaatcaagattttggtggaattttcactagtcaaaaactgcactgaaggttccagtacaaattttactcaccggagttccttaacctgaactttagctagtcacacctctccttcagtatttgttcaccttcatttcttttttattgttttttagctattgcgtacttaattttgtgtttccgtttctttaggtaagacacgaatactaagatccagatagctgtagcacgtggagaaagactagaagtgtagttgttgattgacaaatatgttgtgatcaaatgctccaagaaagttgacataacacaaaaaaaatgaggtgcctatgataatgccggattaccaaaacaaccattgtgcttaggcactccatttagcactccaagagttgcgcatttagtttaatagtaattaattaccttataggcattctgtacaaaagaaaacctacagatatatatttacactactaccagaactaaaataagggactcgctaagagcagcgtcaacgaaacatgaaaaatccacaagaacagcatgacacaagattccaaaatgtcacaaataaaaaacaactcaagaaaaaccctaaacctcctgaagaacggttctatcttaaaaaataatagtaataaaaagaaaagcaataaatggtccattgcggaaaggaagggaaatgtgactatagagagggtgtggagatccacggaccgaactggaaggaagggaagggcggagaatcaagcgcaagccacagattcttgcccttgcggcgagcagcggagatggtcctcccgacaagcgctgcctccagccgcggcggggcgacgccgtcgatgaccttggtgtcatctgcagccgagcaccgcacgatcctcttcccgacgcagtgctcctccagcgcccgtcgcgccacctccacctccggcagctccggcatctctcctcaacctctccctcgttgggtatatcctcctcttctcttatttttgcaccggttggatcccagaatccccagattccccactttagagcctgtttgggagagtttgtccccgctgcagctttttccaaaagccgcttctgctagaagctgcctcaagcagtccatagcttctgagaatatgtagttacagattctaaaaaatgaactaagaagccagaagctagagaagctgggttttagagcttttccagattctcggaagctggctaccaaacagctgtttctcagaatctaaacctcccccaaacacctcccccaaacagacccttaccccagtctgaaaaggttaatttgaaaaggtaggagacccctcctcttaccgcttctttgacaagaggattgtaagggcaaaagcaatgtgtcatccatttattcagccccggaggaccaaatagatttaagtcctttaaaagtctcaggatccacaatgcaatatggcctcaaacaagatccaaacctatctatagccacacatggggatacacagcccacagtggacgtgaccaagcccacatagccaaagcgatacgagctaaggcgaaatgacctgggtaccctcaaaaccgtgccctttgactcggtctcgtgagtggggacgaacgcatcgcctcttctcctccgtcgatgcatcgcctcctctcctcctcacgcacctcccatgagccgtctgacgtcgccgacatgaagctccggagtggcttcgtgcacgaccggacatggccatgggctattgtcccagtggtgcgggtcaatttgttgctgtttgaaggtggagagccggcggagagctcggacttgtcggtggagatgtggaccgaagatggcgacgacgtccaggtttatccagatggtgccacttcccgacgtatggcgccgccactttccccaaggaagccccaccaggacgtggtctaggttccatccctctctaggtcgtcgcggctttccccaatgacacttgccccacagcgcgcgtgtcacgccctgaagttttccttcctagcaaaaattcaattgataaattgttttaagaaattatttgtttaaaggcaagagagaaaccctaaattaataaatacagttaataatcggaatcggcgtgtggaatttttcttggattctacgtgtcaaaatatgctaataggatttttaatggaattttcagagccttggaaataattttaactaattaaaaatgagcatgtgtaatatttaaatcctaggaaaaatcttttttcctttttcttcttttctttttccctttttcctttgttgggccgtcggcccactcctcccgcacgcccgccctcctctcagctgggccggcccaagccgcctccctcctctccccgggtcaccgacaggtggggcccacctgtcgcccccgtcttcaacctctgacaaccgcagccgccgccgaaaccgcccacgccgccgccgtttcccgcccttcccgcgcccactcctccccactccgtgccgcgcccacgtcgtcaccccctctccgctcctcccgccctcgcgcgcccgagaatgggcgggattcgtttcgaatcccccaaactctctctccccactcccccacgtcgccggccaaatcggggggtttccctgccgtgtccgcccctctcgagcccctataaggcttccccgcactcccc

SEQ ID NO: 67371 - DNA, 20358 bp, Oryza sativa
  unsure (1)..(20358): unsure at all n locations
cgccgtcgtcgtcttcaggttcacatggccgagggctacctcgtccacccctcctccatcgaattccgccatcggaggccgctgttcgccgcgcgccggtgagcccttccatagccgccaccgtcggccatggctctcgctcgccgtggactccctctctccctctaagctctctcatttcctctcttagggtgtcctggagctcggccactgttcgccgtcgccctccggtcgctcaccgtcgccgttcgtcgtcgtctcctcccgcgccggctgaaccccggtgagaactccctcctcttctcttcctctcgcgcgcgccgccgttcccatatgcgcgtcaccgcgatgcgccgtcgcccgcgtcgccggccaccgccgtcttctcgccggccgccgccgtcttctcgcctgtcgccgccatcggtggacgcttgccgccgccgccgtcggtggtcgcttgccgccgccgccctcgccataaccggccggccggcttgaagctgagccgaccaaggccgtcttcctcctcccctttaagccaccacctggtggggcccacccgccaggtcaccaccctctctcttgtgccgctgacccgtgggccccgcctgtcggcgccgccccaccccttggatgacgtcagccctgggacatattgcgcaataaatacattaaggcttttctttattagtaaaaatacagataatcttctaaaattcatatctaattcatccgagctccgttttagtccattcaagtctcagtaaattcgtaaaaatgtatagaatccattaaaaatggttttgtctcctgtttcagtagacttatagcatgttttgcttgtgtgctttgtttttcgcgtagatttcggtcgtttcgtcgatccgtggctcctcgaagacgttgctatggtctcatcagtggaagagcaaggcaagtcatgtattacaattgatcagattgtacccaatttacaaatgtcccgcatttctattaaatgttgcattgttttacaatatcatgtgggatgggtcctactactcagccatatattgtttaccttatgccatcgataacttgggtatcaaaatgattagatgttggtttagggaacgcttagccatgcttagttcaactagtacacaaaggggaatcacattaatgcatagactttgattattggcatagctttggattagtgccaccgcaatggtgttagttaattaaaatacactacatggtgggctgtgggtgcatggttttgctagttgtgcccatggcgattaaggaccggttcgcgggaaaccctggaagaatttatcgtgcttaccacaagccagcgtgggcaacgactgggcttgtagtatagcttccctctagccgacgtacccaggcgagggtgggtgtgatggtgttgggtcggccggggtgtccggttgatcggcttccggattcaccgcggcacgaaaggggggctgcccgttgcccgctggggacgggggcgaaccctaaggtgtggtgcgatcggttagagggggttatgcgaagggtcctgtcacggcctcttttcagtatgtcgtggtggcatgtcggcgcacggaaacgtgtcgtggggctgtgtcttgtgggtacagttgtacacctctgatcagagtaaaactattcgaatagtcgtgcccgcggttatgggcggtcgaccagatttaccgtaattagtctcacccctagttagctaatggaactggttagttcaggtggtggtttgggcctgtcttaacgtggtgtagcgttgagcagtgattggttaatattgattaattactgcaactgttttactgctttcaactactgcttttaaatgctagctttatgcaaaagaacctttagcctcccttggatatatcctgcatcatacctcctcttctggtatgacttgctgagtacagtgggtagtactcagtcttgctctctttttcccccacaccagagttgaagttcttctcagttggtgatgtctcgaagaggttggtttcgtcgctaccgtcaaggattgcctgtggaatggagtcgcccgctgcaggagtcaagtcttcaggcttatctcgtttttttcttttccactgcatttgtaatcttttatatttttgtaagacgtagatttgtatgtcaacaattgtcgtttgtgtaccctggctggtcctggacaggggtttaatgcacattcagcttagaaattctggttcgtgaatttttgggcgtgacaagttgttatcagagccgaccttgaccgtaggacaagccaactggaaaccctaagagccctctgaaaccttttcatctgcacatgccttttgcacttggatttgttttgggaaaattttggggtttgctcttttgattcgtgggaaaaatcttgatcgctatttcaattggatttatcgactaggaatagtatggtgttttagaaaaacattatttggaatttatttggcagtcagtcgggaatttgttaggtgatatgcactaagtcgtgtctaggttcgatgggcaattttatgtgtgtattatagctatgcatctattttgtgcattaatttatcgtttagtcagttgcattagtatctttgtctgggttcatgaaaaatgttccacgcataaaaatcatcatgctcggcgagttacttgagtcatttgttgctttatttaatttggttttgagcatgtgttggttcctatccttctgtcctctttagatgttagacctgttcctcgttcgcaagcgacgctccaagcttcagagtcgtcgcctttagccttatcatcttcttagttttgattgcttgctagtttctgtgtttaggtttgttgcttgtgggttagtcggcggtcgatatcaagtgccagtggtatggctgccttaattaggagttgtttgcttccttttcagttttttaatcaagattaagataattgcacttaaatttacaagaaagattagttgccgagccatctgttttattcctttctcttatttctacctatcctcgtccagatggtgaagacaaggaacgatccccgtgactccaacgatgccagtggcagcgaagagcagaccgatggagctcataccagtggtgcatctagcagcagtccatctccaccgcccgagaacccaatggtcactcagatgatgacaatgatgatgcaacagatgcaacaacattaccatcagatgttgcagcaggcgcaacagaaccaacagtttggtcccccaccatcccacttgtccaaactgttagactttctccgcatcaagccacccactttctcaagcaccaccaacccaatggaggccaacgaccggctccgtgctattgagaagaagctgaaccttttgcaatgcaacgaccaggagaaggttgctttttctacacatcagttgcaagggcctgcttctgcctggtgggacaactatgtggtaacccgtccagatgcaacggaagttacttgggcagagttttgtcaaagcttcaggaaggcacagatccccgaggggattatggcacaaaggaagagagagttctgtcacgaccggaattaacccaacgggcgttccttacgtgcgtgtattattccttgtcccaggaggcaaggtacaacaaaagttgatacatttcagagtttatcaagcggaagcgtaaatagttaatttattacatgggcggcgaaggcccagcacacacaaagacaaacgagaaacagcggaagactagggcgatgaccataggcgcttgacggcaggcacgagctagacaccaaagccttcatcttccaggggctcctcttctgggtttgggaaaaattgagcaagactgagtacaaccaccgtactcaacaagacacacccacaagtgcagaataaatgcaagggagtacaagggggttataatataaagggttagggtttgcagtaaacagcattaaaagacacttagttgctcaacgctattttgtaaacacgattctagagctatacaatattattaaacaaggccgtgaacccacacgaacctgccttaacccaaggcctacgatgattcagaccgaactggcaacccgaccctgggtcccagctcgtcccaagccaacccaggccaactattccacattttagttgttaagcaggttttaagaattaaaacactaacttgggtacattgctaggcatgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcatgtagccttcatttgtcctagagatgtccatcgacccccgacttcatccatctccatccgtgtacttttttttataaccagattgagccacaaactaagccttacccactagacatgtggaagtacggtagtgctttgcaacagaggccccgaagaccggtccttatatggccgaggtgctactatcaaaaccatgcaccccgagcccagcctaaaaccattttgagggttttgaatagagggggaggtgtgaatccaattccacaataatccaaccattccatattgtccaggtgatgagaatattcccaaagtctagagttgtaaaaccacctaatgttgcctaattaaccagcgaagcatctacctaaaatcatactagtggtaccatgagtagagtgtctactagttggggttttgtttattctagggtgaacaaggaaatattaacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcactttcccaaacgtcggcttcaacctccacgaagagcggatcttccgaagctgcaacgtctacacgaccaatggaaaataaaagggcgtttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggagggggcgcgcggacggggtccacgagagtggggcccacgcggcagcctcacggtccacggtggaccgggcgcacccgggctcacaccggccggcgccgtgggtcccacgcgtcagccgcacccgagggcgcgggcggctgacggccgggccccacgcggtagccactcggcgcgcccgagggcggccatgccggcacggtcggcgggagacggcgtgctcgcgacccgatggtcgccgccggcgaccaccggcgcggcggagcggcggccgagagaggggtgggaagggggaaaggaggcgatggtccacggctcaccccggggcgatggcggcgacggaggagcggcccggancgaaggnagcggncggcgcggctcgggtcgacggggtcgacggcgttcggcgggtcggcgacggaaacggagaggtggacgaggttggcgaggatgcggcgaacccgaagaaggcggcgccgaggtgggaggtggtccggggcgacgacggcggcggaccggagctcggcggcgacggcggagagagagagcgacggcgcgagctcgaatctgcgaggagaaagggcggcgagaggcggaaacgaatggaggaggtgcggggagggtttatatagggttggaagggggagagggcggccggaggggaaggaaaccggcgcggcgctctcgggctccatcaatggcgccggcgggattaggggagggtttccaaatgaatccaagggagagagggagggaaaattggggggaaagggagagggaatcacggggaataattcccccctattgattgcacgcggggaggacgggggcggcgggattcgcggcggcggcggcgctagggcgcgggcgaggcggcgggagcggcgggaggaaggggatgacgggtgggccccacccgtcagcgaggttggcgggcgggcccgcccgtcagcggcgcgtgcgcgggcagaggccggatgggccgcgtggagagcagagggagggggagggagatgggccgagccggcccaagagggggagggagggaaaggggacttttagggtttttcttttttaaaaccttttcaactttgtttatttcttaataattattatttgtgctctgaaaattccactaaaatttatttacgcattttaggctttttaggaaatatacaaaaatcctctaagccttgtttgacttttaactttgcacattttaattgttggaggctttcacacagattttaattattctaggcatcatttagaggatatattttagggtcgttttgggacgtgacaagttccgtgcactccagcaaggaaccatgtcagttacagagtacatgcacgagttcaaccgccttgcgcgctacgctcccgaggacgtgcgcaccgatgctgagaagcaagagaggtttttgtttggtcttgatgatgaattgaccaaccagctgatctccggagtctatgatgattttgagaagcttgtggacaaggctatccgtcaggaagaacaacgtaacaaaatggaccgaaaaagaaaggcagctcagatcagctttcctcaggggaacaatcagaagcctcgcttcatgacgggacagttaggtgagccttccaccctgatcgtccgtcagcaccgtccttaccactcgagtaacttcaacaacgactacaatagtggctgtcacggcagcagtaagcagcacaaccacaactcgactccacccccattaatggcaccaactcagtcagatccgccagctatgtcagctcagtcagaacaactcaagaaggagtctgcaggaaagccaagaccctgcttcaactgtggcaagcacggccactttgctggcaagtatccgaagccgaagcgcgctggacctaggttcgtccaggcctgcgtcaatcatgcgtctgcagaggaggcacaggcagcaccagaggtcgtgctgggcacgtttccagtgaattcatttccggcaacagtactttttgattcgggtgcctcgcattctttcatttccaagagaattgctgggacacatggattatcggtagtggaacttaaaatactgatgcgggttcatacccctggaaatgacatgaacaccacacactactgcccctcagtgaccatagagatcaaaaggtcaccgttcctatccaacctcatccttctcgaatccaaagacctagatgtcattctcggaatggattggttgaccagacacaagggggtgattgactgcgcaagccgcaccatcaccctaaccaacgacaaaggggagaagatcaccttccgttctccagtgccacagaagtccgtagcaagtctgaatcaggctactatcgaggatcagacagaaatagcggagaaaaatcccaagaaattggaggatatacctatagtacaagagtatcctgaggtgttcctagaagacctcactacaatgccaccgaagagagaaatcgagttccggattgatctggcacccggaactgctgcaatctacaaaaggtcgtacagaatggcagctaatgagctagcagaggtcaagaagcaggttgatgaacagctgcagaaagggtacatccaaccgagtatttcaccttggggtgctccggttatctttgtggagaagaaagacaagaccaagaggatgtgcgttgattatcacgcccttaatgaggtcacaatcaagaacaaatatcccttgcccagaattgatgacctgtttgatcagttaaaaggggctaaggtgttttccaagatagacctgcgatcaggctatcaccagttgagaattcgggaagaggatattcccaagacagccttcactactcggtatgggttgtttgagtgcacggttatgtcatttggactcaccaatgcaccggctttcttcatgaacttgatgaacaaagtgtttatggagtttcttgacaagtttgtcgtggtgttcattgacgacatacttatttattcaaaatcagaagaggaacatgagcaacatctccgtctggtactcgagaaattgaaggagcaccagttatatgccaagttcagtaagtgtgacttctggttgtcggaagtcaaatttctgggtcacgtcattactgctcaaggtgtggcagtggatccatcaaatgtggagtcagttacaaagtggaccccaccaaagacagtttctcagattcggagttttcttggacttgcgggctattaccgtcggttcatcgaaaatttctctaagattgccagacccatgacacaattgctaaagaaagatgaaaaattcaagtggtcagttgagtgcaatcaaagttttgaagaactcaagaagaagttagtatctgcaccagttctgattctgccggatcagacgaaagactttcaggtctactgtgatgcatctctcaagggctgggatgtgtgctgatgcaggaaggcagagtggtcgcatatgcttcgcgacagttgcgtccacatgagagcaattatcctactcatgatcttgagttggcagcagtggttcatgctctgaaaatctggcggcactatcttattggcaaccgctgtgaagtctacactgatcacaagagtctgaagtacatcttcacgcagcctgacttgaatatccgacagtgaagatggctggagttaattaaagattatgacatagggatacactatcatgcaggcaaagcaaatgtggtagcagatgcttttagcagaaagagccattgcaatacagtatataccgaaggcatgtgtgacaaattgcaacaagatctagagcacctaaatttgggcatcgtggaacacgggtacgtagctgctctagaggcacgccctacgctcgtggatcaagtcagagatgctcaggtaaatgatcctgaaatagctgagctgaaaaagaatatgaggattggaaaagcccgagattttcatgaggatgggcatggcacaatctggttgggagaaagattgtgtgtacctgacgacaaagaactgaaggatctgatactcactgaagctcatcaaactcagtattcaattcatcccggtagtactaaaatgtaccaggacctcaaagaaaaattctggtgggctagcatgagaagagaaatagctgaattcgtcgcactctgcgatgtttgccagagggtaaaggcagaacatcaaaggcccgcaggattgttacaacctcttcagatcccggaatggaaatgggaagagattggaatggatttcataacaggtttgcccaggacatcatcgaggcacgattcaatctgggtagtcgtggatcgactcaccaaagttgctcatttcattccagtgcacactacctatacggggaaaaggttggcagagttgtacttagcaaggatcatgtgtttgcatggggtacctaagaagatagtatctgatcgagggagtcagttcacttcaaaattttggcagaagttgcaagaagaattggggactcatttgaatttcagcatagcttatcatccacaaactaatggtcagaccgagcgagtcaatcaaatattggaagatatgttgagagcttgtgcacttgactttggcggagcttgggataaaagtctgccttatgcggaattctcttacaacaacagttatcaggccagtctgcaaatggcaccgtttgaagcattgtccggatggaagtgccgcacttcgctcttctgggatcaaacaggtgagcgccaactgtttgggacagaggtgctaaccgaggcagaggaaaaagtcaggaccatcagggaaagattgagaatcgcccagtctcggcagaagagttatgctgacaaccgccgaagggagcttatttttgaagcaggggattatgtgtaccttcgtatcactccgcttcggggagtccaccgcttccagactaaaggaaagttggcaccacgctttgtgggaccatacaggatcctggaacgcagaggtgaagttgcttaccaccttgagcttccatctaatatggctggtatccacgatgtgtttcatgtatctcaactgaagaagtgtttgagagtacctgaggaacaagctagctcagagcacatagacatttaggaagatctgacatatgtggagaaaccgattcgtatcctcgaaaccagtgagagaaggaccagaaacaaggtgatcaagttttgcaaagttcagtggagccaccactcagaagaagaggccacctgggaaagagaagatgagttgaaggccgcccatccgcacctcttcgccagctcttccgaatctcagggtcgagattctgtttaaggggggtaggtttgtcacgccctgaagttcttctccctagcaaaaattcaattgataaattgttttaagaaattatttgtttaaaggcaagagagaaaccctaaattaataaatacagttaataatcagaatcggcgtgtggaatttttcttggattctacgtgtcaaaatatgctaacaggatttttagtggaattttcagagccttggaaataattttaaccaattaaaaatgagcatgtgcaatatttaaatcccaggaaaaatcttttttcctttttcttcttttctttttcccattttcctttgttgggctgtcggcccactcctcccgcgcgcccgccctcctctccgctgggccggcctaagccgcctccctcctctccccgggtcaccgataggtggggcccacctgtcggccccgtcttcaacctccgacaacggcagccgccgccgaaaccgcccatgccggtgccgtttcccgcccttcccgcgcccactcctccccactccgtgccgtgcccacgtcgtcgccccctatccgctcctcccaccctcgagcgcgcccgagaatgggcgggattcatttcgaatccccccccccaactctctctccccattcccccacgtcgccggccaaatcggggggtttcccggccgtgtccgcccctctcgagcccctataaggctcaccgccgccgccttctccacgcctccggccgccactagcgccgccgccgagccgcgccgtcgtcgtcttcgggttcgcacggccgagggctacctcgtccacccctccgtcgaattccgccatcggaggccaccgttcgccgcgcaccggtgagcccttccatagccgtcgccgtcggccatggttctcgctcgccgtggactccctctctccctctaacatctctcatttcctctcttagggtgtcctggagctcggtcgccgttcgccgtcgccctccggtcgctcaccgtcgccgttcgtcgtcgtctcctcccatgccggccgaaccacggtgagaactccctccccttctcttcctctcgcgcgcgccgccgctcccggcatgcgtgtcgccgcgatgcgccgtcgtccgcgtcgccggccgccgccgtcttctcgccggtcgccgccgtctatggccgcttgccgccgccgccctcgccataaccggctggccggcttgaagccgagccgagccaggccgccttcctcctcctctttgagccaccgcctagtggggcccacccgccaggtcacctccctctctcttgtgccgctgacccgtgggccccgcctgtcggcgcagccctaccccttggatgatgtcagccctgggacatattgcgcaataaatacattaaggcttttctttattagtaaaaacacagataatcttctaaaattcatatctaattcatccgagctccgttttagtccattcaagtctcagtaaattcgtaaaaatgtatagaatccaattaaaatggttttgtttcctgtttcagtagacttatagcatgttttgcttgtgtgctttgtttgtcgcgtagatttcggtcgtttcgtcgatccgtggctcctcgaagacattgtcgtggtctcatcagtgcgagagcaaggcaagtcatgcattacaattgatcatattgtacccaatttacaaatgtcccgtatttctattaaatgttgcattgttttacaatatcatgtgggatgggtcctactactcagccatatattgtttaccttatgccatcgataacttgggtatcaaaatgattagatgttggtttagggaacgcttagccatgcttagttcaactagtacacaaaggggaatcacattaatgcatggactttgattattggcatagctttggattagtgccaccgcaatggtgttagttaattaaagtacactacatggtgggctgtgggtgcatggttttgctagttgtgcccatggtgattaaggaccggttcgctggaaaccctggaagaatttatcgtgcttaccacaagccagcgtgggcaacgattgggcttgtagtgtagcttccctctagccgacgtacccaggcgagggtgggcgtgatggagttgggtcggccggggtgtccggttgatcggcttccggattcaccgcggcacgaaaggggggctgcccgttgcccgctggggacgggggcgaaccctaaggtgtggtgcgatcggttagagggggttatgcgaagggtcctgtcacggcctcttttcggtatgtcgtggtggcatgtcagtgcacggaaacgtgtcgtggggctgtgtcttgtggatacagttgtacacctctgatcagagtaaaactattcgaatagtcatgcccgcggttatgggcggtcgaccagattcaccgtaattagtctcacccctagttaactaatggaactagttagttcaggtggtggtttgggcctgtctcaacgtggtgtagcattgagcaatgattggttaatattgattaattactgcaactgttttactgctttcaactactgcttttaaatgctagctttatgcaaaagaacctttagcctcccttggatatatcctgcatcatacctcctcttccgatatgacttactgagtacagtgggtagtactcagtcttgctctctttttcccccacaccagagttgaagttcttctctgttggtgatgtcttgaagaggttggtttcgtcactgccgtcaaggattgcctgtggaatggagttgcccgctgcaggagtcaattcttcaggcttatctcgtttttttcttttccgctgcatttgtaatcttttatatttttgtaagacgtggatctgtatgtcaacaattgtcgtttgtgtgccctggctggacgaacgcatcgcctcttctcctcctccgtcgatgcatcgcctcctctcctcctcacgcacctcccatgagctgtctgacgtcgccgacatgaagctccggagtggcttcgtgtacgaccggacatggccatgggctattgtcctagtggtgcgggtcaatttgttgctgtttggaggcagagagccggcggagagctcggactcgttggtggagatgtggaccgaagatggcgacggcgtccaggtttatccagatggtgccacttcccgacgtatagcgccgccactttccccaaggaagccgcaccaggacgtggtctaggttccatccccctctaggtcgtcacggctttccccaatgacacttgccccacagcgcgcccgcgaccacgtctcctagccgcgcgcggcttcgcctccgcccaagaacacgttgcttgagttggacgcacggtcttccttttggtgggcccagttgcaatggtggcacctaattctctcgaattgacgacatgtccgcccaggcagaatgccacggtggagcattgtaaaggctgtaaaagggtgagtttgaggagaaggggatagagaatattggaaagatacgcaaaacgaggtgagctattagtacatgattaattgagtattaatttttttaaatttcaaaaatggattaatatgattttttaaagcaacttccctatagaatgtttttgcaaaaaatataatgtttagtagttcgggaagcatgtgcgtgaaaaacgaaacaatctcactatttgctgctgccgaacgcagtgtaggctgtgttcgggagaaggggttgggaacccctcctccccggcacgcgaaacgaaccttgtattattgcatgattaattaaatattaactatttttttaaaaaatggattaatataattttttaaacaactttcatatataatttttttttataaataacaccatttagcagtttgaaaagcgtgcgcgcggaaaacgagagaggtgggttgggaaaatgggggaagaacacaggcttagagaagagaacaagatgattggaagtttagataagacaattgtaatgacgagattattatgaggatttgatttttttagtcttattttttttttggtatagatgtgaaaattgacaggaagttcagatatatgaaaaataataactaagatttgtttaggtaaagtaaagtagaaattctctctcaattaccacttcctaccaggtattgaaaaggcaattacctcttcctaccagatattgaaaaggagggagttcctctctcatttcccattccatcacatcccatcaaaactcatttgccttctacctgtatatatccaatggtaaattgtatcttattgttcacatccaacggctaatattatttaaatgacgtggcacattcacgtcacatcatgtgattcacttttccatagttaagatgtaggtaaggatgttattgcacagagatgcaactggggttggagtagaactagctcccttttaaccatctttcgtgctcgtcgatgatgtgtgcccccaactcttgggcataaactacacgaagtaggaagctcaggaccacatgtcacgcccggaacttctatccaaaattccaaacgcttacatgtgtgtgaaccctcgtccaggaatcagccgatgcacacaataacaaattgataatagagtacaaatattactctaattaataagcgaataaaatgtcattacagaggtagatagttcctctcaatcaataaagttctaagcagcggaaaaaaaataaacggcgcaggcggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatctgttactatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataagtgtaataatgtttctaagcagggctaagcaattatatctaatatctagttgaaccaatataaataaagctcaactagtcaaattataataacccaaggtatcaaggaataaggtaatcaagaacaaaagggccataacaatcaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaaagtgtaggtctcaattttagaaaaatttagagacttgaaccaactaaatcggagctaagatgaattagttatgaatttttaaagattaaatcggattaaaacacttaaatcggttaaaattgaattatgacgcaataataaattatttttgaaaaggaaaaggggatttattgcgtcagcgggctagggtttggtggaccgggcgcacgggcgacggttcacgcgaacggacggccgagattgatccgatccaaaacggacggccaagatcgatcggtctacgaccggctcacagcgaacggccccgatgacgccagcgatgacgtcaccgacggcggcggcggctcggcagctgggtcggctcgggcggcgcacgctcgccggcgaacggcggcgcgaggacgctaacaaagggcaccaacgggtagcggacggcacggcgaactcaccgacgaccaaaacgacggcggagaagcaacggacggcgacggcgacgaggaaggagcggcggctaccttcgggttgacgacggcgacgatgctccggcggtctccgacggcagcgaaggggcggacgaggacggcggcgacttggcgagcacgacggcggtcttcccgagcggcggcgacagctggagcgacggcggagcacggctgaagcggcggcggcgaaggcaaagctagggcacacggcgctagggctactccggcgacgagaggcgaaggcgagggtggcggcgagaagagaagagcacggggatccttttaaaggggctcggaggcggcggcgaaggcccacggcgacggcaacggcgaaggaaactcgcggcttggaaagagggaacccgatccgaatcgaacttgattccaccgctttccaaagcgatttagccgatgattccaaagagaaaaaggtagaggagatcccggagattgtttcccctcaaccaatttggccggagaaggaaagaggcggccggattggaaggaaacagcggcggcggctcggcggcggcgcgctagggtttcggcccgaggaagacgacgggcctgacaggtgggacccacctgtcagcggctgcgagggcgcgcgcgcgcgcgggcggctgcggactgggccggctgggccgagaagagagagaaggcggttttgggccgactttcggcccaaagccaaaagaagactttttaaaaccttttcaatttaaattatttcttaaatgcaattccatttattaaaaatacttccttagctcaaataaatcccagaaaaatctaggaattatagaattaagcaaagtatttaatgaaattttatctggccactttttatattggaatttattaattaaacttagattttcttttcaagacttttaaaataaattctagaaattccatttaaacaacaatttatatattttgaattttcagggtgtgacaccacagtagggaaggattcgtctccctctaactaagggatgaatcaacgtggtggccttcaccagtttgggtctagccatcttcttgttgtcggggcatcatatggtgattgtgccatgtgaggatgaaggagtagaacgcagttaaggtgaaggcttggttcacgcttcttgccatcctcttgttgctcaaccatcttctttagcttgtcgacctcccgcaatgcaggtgtctagctttgtcagcttagacatgttgaagaagtggtggccatcgcctcatcggtgcttggccttgaaaatatttccaccttgttggtgtcgaacagatgatttccattgcttttgccttgtctgtgcccaacaatggaaattgatttgcatcatgagagttttcaagtcgatgaagtggcttcgccttgtcgaagcgtagccttgaaggtcccccttatcggtgtcggatagatgatttattttgactttgccttgtcagtgctcgacaatgtaaagagcttgagtcgtcgatgtagtcgataatgagtcggaatatcatcggcgatgtagaagaggtgggatgttgtgcatattgctcccgatgtctcctatgatgatagctggattgtcatcagctacgtagaaggacatagggataccctagtgttgttgatgtagttgacaacgcgcttgaatggcaacgtcgcgtaagggaataaggaggtcatatagcccccaatgctagtgtagttcgtgatgcgtcaggatgaaagacgtgggtctgtgtagtccccggtcttgttgaagtagatgatgaagtactggaagccatcggcagtgtagatggaagacgggtcgatgatgtcatactgagatatcgtcagtattgtagatagaagagagggttggtgttgccccctaccatgaatatgatgatgttgtgtcaagataacattggcggcacataaggttgtgaaggcttcaagtgaccttcttatgatcaatgttggtggaggatgctccgaagtagacaacgatgcatgggtcacatttttttagtgcccattggccgccttgatgtgcagactttgcatcacccgtatatctttatcacatcagactcgatcagctctagggcctctttcaattgaatcatttgcatctaggcaacaccaactactccttcatatagagattagtgccactcctgaagactgtcgaagaagagagtgactcaaattaggtcacttgcagcgtttaggagtagctggtttagaaagatccaacatagattcggatcttacatgaccaccgctcttattgaaaatcatcatgcatcatcatgttgtttataggttggaggagttgacgaagatatagacgatgaccactaaagcacagcaaagatgggaggataaccaggtcccactgggcgtgccaatttgtttaggacagaacaaataacaacgataacgatatgcgagggcgtgtcagtgtaactaagtacacaaaataaacaaagaacatagggaacatgtgttttattaatctcaaggatcataaatacaaattcccaatgtaacatgtatatatgtgtgttggtggctgttaaatgctaattttacgccgccaatacctgcgtaaatcaaggaaataaaacatccaacatagtaatagggtttaattctaacatattccactagtgttggtgtatatttgaatacaggtaataaaccgccaaagttggatgaaattcagacttaagtgaagacgaagccctatctatacaaagagtgggctagaaactacacagtaatatgcttaaaagggccttctactcgtagaaatggatactaaaggaggaggagaagcaacatgctgctgaagtgtgggcctgttgggccaggcaatggttcggccgaacccatggttcggacgaaccaccagctgcactgtcggatccatgttttggcgtggacagtccagatctcctcctaatggtggttgaagggctaaaaggacatttcgcgttttcctaaccatcatacctaccctatataaggacttcaccttttcacttcactcacacactc

SEQ ID NO: 67372 - DNA, 24400 bp, Oryza sativa
tatatcggatagtccgatattttttagccaacactcagacaaagatagagggcaaagttctaagaaatttcggatagtctgagcatcggatagtctgatcaggatcggatagtctgacaggaataaaataggaacagtccaaataaaggattttgagaactagtgttctaccaattatatgcatgtggtatccctcttaatagtacggcatcctaatacaaaacacaagatatacatggaatagaagacaattaccagaaaatatgccgcaaagcttgtaaattcaagttccactcctttttatccttgcatccatctcaacaaagagcattagtgaacctctaattgtgttgtcataaacaccaaaataaatgaggggtcctagatgcactttcaatctccccctttttggtgattgatgacaacacaattagaaataataaaagattaggatttaggtggagctccccctaaagataagctagaaaagaatatgagagctcccccttaatctatgcaaaagattagaaatcacaatataacctcatgcatatgcatatgacaagatacatcactcatttaagcatggataagagataatttcatataacatgcacataacatcatccaagtctgcgaggttcaacaagacataaacatgcataataaagactttaaacatgacacaaaagcccaatgttcaactagccaccacgaaaacgagatagattttttttaaaagttttgataggtaggttggttctccccctttggcatcaaggcactaaaagggaaaagagagtggatcactcatcctcatcaaaatccttgtcctcctcacttgactcctcatcattgtcatcttcctcctcttcttcttcttcttcttccataggagccttgccacgatctgcacgagaggagcttgcctcagctgcaaaggggtcctcaaatacatcctccccactgtcctcaacctcaaacccatcgggagaacacagctgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccactcccgtttcggccccgagggctggggcgccccgaccccctgtggttttggcgccacgtgtgtgggttaggtgagcccaccgggctcacctaaccgcatttatagcaggttggacgagcgcgccacgccgcatttaatgcggcgcagtgcacgcttatccggtccgtgaccggtcacggtgtgtgaccggtcacagaccggtcagatcgcaggttaggtggcaataggcggcctgtcacacacctcgccccgtcccgtcggaatgatgagagcttcctggctctcgtccctagccggagccggtgtgctaactcctggagttagtatgtcagtcccggtcagatccattccaggcttcagcgcaagtatggcaaggaagtcgctggccattaaatgaatgttgaaatgggcgtccaccggaaaagcgggcgagcggggcaggaggcgtgtgctctgcttgtcagaggtcacttccggatgtagactagccctcattgtaaaaagcatgtttcttttcttaggcagcaggaggcccgtgtggtgaccccggaccagataaaaaggaggcccaggcctagagggaaaaaaaaggaggagagaaaagagaaaggggttgggactctggcgaatgggttctagagcctgaactctctctcgctctccggctctctgtattccttcacgcacagatccaccagaacacaggagtagggtgttacgcttctcagcggcccgaacctgtctacgtcgcccgtgtcttgtgcatttcctctctcgctgacgttcctcagatcgagggcgaagaacctcacttagcgcccccggccgaaccggcaaaggggggcctgcgcggtctcccggtgaggagccccacgctccgtcaacagcaaatgggcgttgtgaaggaggttcttgatccgccgagtgtccttcttccttgctctgcgttccttggcttgatgaactgagatggttttgcacatgttaaagatggacttgaagaaccgcaaagaagagttggagtccgacgaggtgacagtagcggagggaccagcacgagaagaagcacgagtggttcgaccagccggcacggaaacagccttgatgggacgaacttggtaaccggtgtgagccacttccttgtgaaacttcttcttggacacaatctcaatcatcttcataatgtaaggcccatagccatgtcctcgcttaggtatcatggagataagccagattttttcaaagatgaagtcaaaagcatcaaagagctgtgggtgtgccttcatcttgtggagcaaatttcttgtataggcaaggacattgctagcatcaccttccttaggattaagagttttgcgcaagagcttgttgagataggcatagaaaggaaggagacctttgatggtgcctaactcatagtccacatcttggtacaagaagtgaagagaatttgtgtccatgggcttctcatcatgaatcttgacacgattggtgcgagagcgagccggaaaccccaaaatggcagcaaacttggcatatgtcactgagtatatgatgccatctgtcatccaatggataatcttttctttgtttggctcaaagtaaacggtagcatagaattgtgcgatgatctctttgcaccatgggtattgcaagcccattagttccttcaagttttgccgagcacaagcttcaatgacttcattaataattggatcatgcaactcctccatatacttccaatcaacccactgcatgagaatcgcccccttcttaggtgcaatcactgtctcatagtagtcctgctgaaaaaggttccaaaaccgaggatcagtggacaactgttgatatttgtagggatctttcttacgctctttctccacttcagtccacttgcggttccaccttgtgactctccgatgataattaggatctctagagggagcagtgacaaagaaaggcccttcttcatgagcggcttgctgagcggcaatgtcctcttctaactgaatctcttcctcaaaggatggagcatgagaaccactatcttgccccagatcagaagaagccgtggggttgcctcgcctcactttgctagttggagcacttgagccttctccactgactcggctgcggcgaggggggaagaggagcacctcgctccacatttgccacttgagctgctatatcttcagaggcttgagcttgcgtgtcaatagcatctttgcgggattcggacattcgacgtatagcatggcgagctttggaagtgggagaacgacctcgagaactcattggaacacggcgagagtaaacttgattcttgaactgacccttgatcatgaggatacactgatttagaacagaggataatgattaagaataacttggaaggagaatatttaggcatgaatcaaaagaactttgatctaggccaaaaggaggtcggatagtctgatttgccgttggactatctgatggcatatcagacattccgacagccatttgccctagaccaacaaatctcgattcacacaaaaatatccgatggaatcaaatgatcttctaggaactaggtctaggcactaaaacaagatggttcaccgaagggaatatagaaataatgcaccatgacggagatcgaagaaaaacaaggaaatacctcaagaaccaccaagaaaatcactagggaaccagtgatttggaaggagttgagggagggaaaccaccccaaagcgaaggaatagcagtcggagacttcgaaacgaagatttttggtggccaagaactagagttttgagtggagagagaaaacgactgctccaaatgggtgaaggggtaaaaaaaattacccctggggaggttaagtccccttgccctcggccccacgtcggatagtctgatttgaaatcagactatccgatgtggtcggattgtctgacatcatgtcagacagtccgacatcctttggcagagacaataaaggatggcacaaagagaatgaacttgatggctagactattacttgggcaaaagcagcacaagagaaataacttagcaccctcgagagagggaatgtacgaatctatagcaaattgtgcaaggaccaagattcattagagaatgagacccccgtacacatagattcaagctatccacatagattatgactagtgtccattcatgaattgaatgtgcactttgtcatgatgtggcatgcaaacttattctagtaaatgaaaataaatgtatgcaaaagatcaagccacattccgagaatccaagatatttagttcatttctcaactcacaaaacctagcttcatctagaggcttggtgaagatatccgccaattgtttgtcggttctcacatgttggatgtctatgtcgcctcttgtggaatggtctctcaagaaatggtggcgaatatctatatgtttggttcgggaatgttggacgtggttattggctatcttaatggcgctctcattgtcacatatgagtgggattttggacacatttaggccatagtctctcaaggtttgcttcatccaaagaagttgagcacaacaactcctagccgaaacgtattccgcttcggcggtggatagggtgacggagttttgcttcttggaagaccaagaaacaagggacctacccaaaaattggcaagtacctgatgtgcttttcctatccactttgcacccgacataatccgcatcggcatagccaatgagatcaaacctcgctcccttaggataccaaagacctagattaggagtgtgcactaaatatctaagaattctcttcatggccacaaggtgacactccttcagagcggcttgaaatcttgcacacatgcacactaatcataatatcgggcctagatgcacaaaggtaaaggagtgatccaataatggaacggtataccttttggtcgacgtcttttaatggccatttgatggcatgggagtgtggattggcttcgcattctccattccaaacttcttgagcatgtccttcaaatactttgtttggcaaatgaaacttcctaccttgagttgcttgatttgaaggccaaggaagaacttcaattcactcatcatcgacatctcaaaacgcttggtcatcatcctactaaactcttcactaaaagacttgttagtagaaccaaatataatgtcatcgacatatatttggcacataaaaatatcattatcatgtcttttagtaaaaagagttgaatcggctttcccgatctcaaagccgtttttcataagaaaattgcgaaaacactcataccaagctctaggggcttgcttaacccgcagagtgccttgtggagcttgtacatgtggttgggatattttgtatcctcgaagcttggtggttgctccacgtataccaactcgttgataggcctgttgaggaaggcgcttttgacatccatttgatataacttaaaattgaggctagtagcaaaagcaagcaatatgcgaattgactcaagtctagctactggctcaaaagtttcaccgaaatctaatccttcaatttgggtgaacccttgcgccactaacctcgccttgttccttatcatgaccccggcctcgtcttgcttgttgcggaagatccacttcgtgccaatcacattttgccaaggtcgctccaccaaagtccacacttcattccgggtgaaattgttcaactcctcttgcatcaccatcacccaatctggatcatttagagcttcttccacccttagaggctcaagagaagacacaagcgagtaatgctcacaaaaatttgcaatacgagagcgagtggatactcccttattgatgtctcctaagatattgtcggtggggtgatctcgttggatactttggtagattcttgggtgagctagatttatcggagagggtggcacttgctcgccttcttcaccttgatccaagcttgaagtagagggatcgtcggcttgggtcgatgtaggtggctccacttgtgttgaggaagaggccccttgttgtggctccctaggacgtacgtctccaagagccaacctcttgattgcttcgctagggacctcctcttcacctaacacatgcgagtcaacttgatctacttgagagccgttagtttcgtcaaatgtcacatcacgcgtgatctcaacaataccggaggttttgttgaaaacgtggtatgcacactcatttaacccatacccaagcaagaacccttcatccactttaggagcaaactttgaggatctagccttcttattaagaatgtagcacttactaccgaaaacacgaaagtaagagacatttggtttgttaccggtaagaagctcatagggactcttcttaagaagacggtgaagacagaggcggttgatgacgtgacatgcggtgttgatggcttcggcccaaaagcggtgcgatgtcttgtattcgtccaacattgtcctcgccatgtcgatgagagtccgattcttcctctcggctactccattttgttgaggtgagtatggagccgagaactcatgcttgatgccttcttcatcaaggaaactctcgatgcacgtgttcttgaactccttgccattgtcgcttcaaatgttcttaatcttgaggtcgaactcgttttgggctcttcttgcaaacttcttgaagatggcttgtgtctcactcttgtcatgcaagaacacccacgtgaagcgtgaaaagtcatcaacaataacaagaccatatttgttacctccaatgcttagataagcaattggcccgaagaggtccatgtgaagaagttccaacggtcttgtagtagtcattacgttcttgaccgggcgatgagctccaatttgtttcctggcttgacacacgctacacaccctatctttctcaaaaagtacatttgttagaccaaggatgtgatcgtgctttagaagcttgtgaagattcctcataccaacatgggctagcctccgatgccaaagccaccccatgtcggacttagccactaagcatgtctcatgtttggctttagttgaggaaaaatccacaagataaagcatccccttaagaacacccttaaagactaccgaggagtcatcccttctaaatacggtcacatcaacatcggtaaaaagacaattgtagcccatggaacataattgagaaatggacaagagattatagtttagagattttaccaagaggacgttagaaatggaaagatcattggagattgcaatcttacccaatcccattacttttccctttccatcgtacccgaagagtatgttctcttgcaaagtgccatttggatcaagggaagaaaacattgattcttctctggtcatgtgatttgtgcatccactatcaatcacccaacttcttccaccggagagatattcctacaagagatcaatttctagttttaggtacccacactttcttgggtcatcttatgttagtgacaagtgccttaggaacccaaagaactctcttgatggaaacatttttgcccctaggcccaacatatttagcaaccacacgaccactagcattcttcctaagaacatatgatacatcaaaaggacaatgtgaagcatgaccattaggaaggatacttttggccttaacaaagatgctaagaccttggggcttcttgatcaacacactcttgtccacctttccttttggtggaggaacatacccaaggccttcatggttgaagttgtccctttgatagcctaggtatttctttagtaccttactacccatatggcacttaagcaagccattgtgaaggagtcccataagcttctcattttgcttttgcaaagcacttaaggaagtagagttagtagcacaagcatcaatatcaatatccttacacctagcacatggttcattgcttggaacaattttggaacaaggtgcctcgctagggagagagacactattctttaaggtttcgaacttctcttcaagagagagataagcttttgttgatgtaaaacatgaggcctgggagatctgcttaactctagtgcaggtccaaagctcgccttcgggtgtgttagcgtgccagttgatttgatcctgcaatcaacaagaaatagagacaaagaaaccgcggttaaacctataaatgatagacgatcggctaagtgccgatgacatatcatttatctttgagccgatgtcatatgtaaatcgatcggcggttataaatagataataaagtactaaacctactcgatcggctgtagatatcaacaatatataattttatatctatacttaaattgagtgattgggatagatcggtcgccatgtcgagacagtataaatcacttagattgaaatatatattaataacagaactatatatgtttatagcatagccgatcggatagatctagtatgtatcggctaatactccaatacaacactatgttaagatgttgaaacaaacagaatataccaaacataagcttaatatacttagatgcaataatatcctgacataaagggcagatttaacatgtcaatgaaacatataaagcaaatataattaaatcagataagatcagctgaaactccgatactaccctaatcggcaaccagaaggcaggctagagattgatattctaagcatgacttaataaatcaaactcaactgatacaacattaagtatgaaaagaagaacaatatctagacaatcaagtcgctggaagtttcatagagtggtggatatcttatataatctaaaccaacatcgatatttaacctaatcggctgccctctattaacagatgttagccgattgtaggctagatggcgatatcgttagagattatgtaagatatatgataactcagcaaattacataaacaaaattagagtatcataaagatggaaggactaatcccgagaacacaagccgacataacaagttttacctcttgttgaagatcgaaaccgatgcagctcaacccgaaagcaagaactcatcgaaataaaactaaagcaaaaagggtggcgatgcgccgaaattgtattgaacgtgtgtgttaaaaattacatagggctcggggtctatttatacccgagaattacaagatatgtccataccggacacgactattatctctaacaaactctaagataccataagtccttgcggcagacttttgcccatatttatctgtaaaaaatttatataaaatatcataattaatagatacaattgccttcccaggactttatccatgtatggcaatcatcttgaagtacgtcaactcaaacccgatatcgaatacaagtcgtattgtcggaatcggctgcatcacttaacccagtctgacttggacttaaccgatactaatcgtagccgatctgggctccagccgattcttgctctgttctcgaatcgatctccgccatcggctccacttcgatctaatcctcttttccgatgctgatattaccaaatttggtcgttaacacatgccccccaagtccggaatatttggtaatgtttcggattttcttaacatcgactccgagcaagtttcgcactttaccgttttccgactgttattcaagcgctttaaatactagggaaaattggaaccatgccattataattttgcaaaatttgagatatgccatcctgacccacatgtcattgactcatgtgggtcctgcatgtcattgagataccgatggcatatctcaaactttgcaaaattataatggcatggtttcaatttaccgatgccgcagagaaatcttacaccattactcccgttttcaccgctcaagtgaaactctgccttctctctaacggcgattcttccaatgcacaaagcgatttccaggcgacttcacccttggcgagatctccgcccgcaacgatgtcgtcctccgccagcccgtttgctgcgccatcagctgagtatgccgaggtaagtccccatcggctagatcccctttctcaacagcagatcgattttccttacctcacattgctcttcttctttccggttgctttggatttgcagcatctttccaacctaattgcgattcccagcttgtcgcatgaaaaccactattttctgggtccaatcggcaatcttgactccactgatttttcattggtgaaaccaataggatcccctttaggctagccaaccctaactgagccactggaaaaacactttcaagtcttggccatctcttgagaaaaccacccctgagaaaagttggatcacatggtaccagcgcgtatcggctaataagaaagttcactgggatgagattggaatcggccaagcacttgacctaaccatagcaacttagctaaggacgagcccttaatggcagccgcctcttatttttggtccaacaccattaacgccttcttgttcaaccaagggccaatgactccaactttgatcgacattaccatgatcaccggtttagatgtaacttcatcggctaatcccatgagcatgaacaccaaaaatcagtttgatttcagaaccaaaagcataggtggctggtctggctatatggcggcatatatgggccaaggatctgttacccctcgagagcatgtagctttcttgctcatgtggctagaaaagttcctcttctgtggatccagttgtggccctacaaccaactagcaatttgtagccgaagccttagaatcaaagaaagaatttccattaggcaagatcctcctcggttacttataccaaacattgaacaacgcatcggccaaaatagccgttggctcagtagttggtgcaggtagaccatggtggctgctacaaacctggttgaacctgatggttaggaaagttttcaatcagccgcctgtgacagaagctgagttcccattgccagagccgattgtaggagacgatggagaagaacgcactcatcacatatgcacatcatacggagaatatacatccacacaaaccgatgctcgagcgaagctatcggctgagctactcaaggactggttctgcagcttctacgaaggttttaagaaagatgcacgggtgtggttttcttatgaagactcagcagatcttgaacttccatcagactttagatttcaagacattaatcatgaaaaattccaaaaatctagagaagttcttacagcttcaatcagtccatgcatccttcatgtcaacattcaccaagggagaaacatctaagtctcctacgaattttatcacccaatgagctcggccagacaacttggattgtgccaactcccaatcagcttattctttgccgacaagattcagtgccgaggagaaatcacatccactctaatgatggatcggctacttaacctaccaggaccccttctgggcagtattgataatattgagttggcaggatttagaagcaaaaatttcgacagatggtggggtgaatggaagttgcacttgtttcatcaatcagcttcgatgtatatgacagatctattccctgatgtcatacctcaggtaaacctcaccattgttagcttgaataattgttagccgattcattacttgactaatctcttgtttttgttctacagacaatcgactcttcggctaattactcatagactttgtggttgcagaagaagaaaactgctgtgaagaaaaaaccagcagcaacaattgtcaagtcggctccaccagtaagatgtctttaattcttttacttaatcaatctcaaccggctctatataacacttgtctattctacagcctcctcctcctccttctcctcctgtacagcaaccgtcaagtgaccagactccatcggctgtggagagtcatcacatcgaggaggaagaacaaccagctgctcctgctatcccaataagtttttctttgtctcaataattagatcagctacattttacccagctcttactctttccgaaattgtctctgcaggttttagccgatcttttctcttttgacatcagagattatcttgataaggcagaagaagatacttcaagcaaagctttagctcctctatctgacgatgtaaagataacacttgaagatatctctcaacggctagctagaagcctcttctttagatagcttggtagttgactgcggatcaattaggacacggctgcatgaagttcaagctctgattcccgaagaattggccgatgtcctaactccagccgcttatcttgaacaacatcagttcaagctggaaaaagccaagctaagactagccgaacgccgtgagcgcaaggagattgaagccacaatccaggtcaatcggcagcttgtgcatgaagaaaaagtcaaactcgatcagctatctgagggtccgattaagtccaatattgatcggctcgaagctcacaagatcgatctcttggcacagcttgaagaatgcaatgctgaactggatatggagcacaaaaagctagccgatctcccaaaatctatcaaagaacaaaaggcaaggctcaaatcgactatcaagaatgttgctgacctaaccaagtccctgaaggtcatctctggaactgatgctcaagatgcccaagccattgaagaagttgaacaaattaggctatccagcagtacttatctcaataactcttgtgtaataggacctagaaatttttgtaatcggctaagatgccttaataccccgctgttttaacactacctttgtgccgattaatacaacttctaaatttgctcaaaaattttcactttcatcatgcgatttttgaatatatgtgccccccctaattttataatgtcaacagcattaataaaattatacaagcaacttagggcgatatagtaataccggccattgcacatcggtaaaccataaccgattacaattggaaaaaaaaaactaagggcgatataacaatatcggccatctctaggcgatgaaaattcatcggctatcatgtatcggcaacatcagccgatcatgcattaacccaaacacttaggtaatatttcttcaaatacttgccatttagtaattccgttcttctagagccgattctaacctcccatggcaaaatagcctcatgtccataaacaagcttatagggagggacttggatcgatccatgacacgccatccgataagaccacaatgcttcgtccaaccgagtatgccattgccgaggataatcagaattttttctcttaatcaatttgattaagctcttgttagatgcctcggcttgcccattagcttgtgcataatatggtgaagaattcaacatttgatacccatgctatcgacaaactgaacaaactcatcggacacgaaaattgaaccttgatcggttgtaatagtttgaggaataccaaaccgatagattatatgttcttgaacaaattgaattgcatccccagaatcaacttttttcaaaggaatcgcctctaccaatttggtgaaataatcagtcgccaccaatataaacttatgtccttgactcgatggtcgacttatcataccgatcatatcaattccccaacctctgaatggccatggcttaataataggattcatagccgacgccggcgctcgctgaattgctccaaacttctgacaatcttgacaccctttataatatttgaaacaatcttccagcattgtcggccaaaaataccttgcacgccgaagtaaccacttcatcttatgagccgattgatgagtaccacaaattccttcatgaacttcgccgattgcaactttagcctgatcggcactcaaacacttaagtaacactccatcaatcgtccgatagtaaagctcatcatccaatagagtatacttcaacgccttatatctcaatttcctagaagctgattgagatggattatgtaaatattgatgcacatcatacctccaatcaccggctgttattgctgcaatttcagccttaacatctttgatcatcggcttataccccgatgccccctgggccaaatcattagcttcaatattttgttctcgagacacatgctttaaagtaaccagccgaaattcctgcatcagttcttggcacttctcattataaaccattaatgtatcactcttgcattcatattcccctgccaattgactgattaccagcaaagaatcccccatgatttcaatagcatcggcttcaacttccttgagtaattgcaaccctttgagcactgcctcatactcagcttgattattagtcgcataaggttttatagtataagcaaacttgaaacatgccccccgaggggaaattataaccaagcctataccacaatcatgagtacacaccgatccatcaaagaatgaagtccatggcacaacttcaaccgagccgattgaatcatcacaatgttccacaataaaatcggctatagcttgtcccttaatagccttcggcgactcataccttagatcaaactcagttaaggaaaatatccactttccaacccttccttttaaaatcggagccgataacatgtatttgataacatcggctttgcatatgacagtacactcgttagatagtagataatggctcaaccttgtacatgaaaaatacaaacacaagcacaacttctccataggggaatatctagtttcaacatccaagagccgacgactgagataaaatacaacgcgctcttttccatccaactcctgaatcaagactgagccgattgacttctcaccggccgatagatataatctgaaagatatccctttctgtggaggaatcaaaacaggaggagagctaagatattctttaatatcatccaaagccttctgttgctctgccccccaagtaaactgctgatcagcttttaatctcaacaatggtgtaaaaggctctaaccttccagacagataagaaataaatcttctaacaaaatttatcttgccgttcatctcttgtagttctgtcttgctctccggaggctgaatcttcttgattgcattaacactcctttgagtcacctcaatcccctctcatgaacaagaaatcccaaaaactggcccaccgatacaccaaaagcacattttgtcggattcatcttcaggccatattttctggttctctcgaaaaccttcctcaaatcggctatatggtcctctatttctttagacttaacaaccacatcatcaatgtagacttcaaccaaccagccgattagatcatgatatatgtaattcatggctctttgatatgtagctccagcactcttcaagccgaaagtcatcacaacccattcaaataagccgattgcaccaggacatctaaaagctgtcttatgtatatcttcttcggccataaagatttgattatatcctacgtttccatccatataactcaaaattttgttccctgacgcagcatcaaccagctgatcggctactggcattgggtattcatccttcggggtagctttattcaagtctcagaaatcaatgcacaccctgaccttaccattcttcttaataacaggaactatactagaaacccattcagcatatcggcaaggacgaataaaacaagcatcatataatcgtttaatttcaactttgacaggttcaagcatatcggctttgcatcttctcagaggttgctggtgtggtctaacccctggtttgataggtagccgatgttctacaatcgatcggctgagtccaggcatctcataatactcccaagcgaagcaatctctgaattctttcaacagctctatcaacttggctctaaattctgtagataaattcttacaaataaatgtcggccttggtcgatcacctggacctatatcaatttcttccaaatcatcggccgatataaaaccctgtccttgtttgtcatcgagatcatctaccgtgtccttgatgtagacatttgaaccctccacaacgccctcgaaataacagcttgggttctccatcttcaattggctgtatattagaatcggacacttttagaaaatctctatcccaaacttttccagataaacaatcgagaccatccatctcccaaagagctaaatcagcactagcaacattgactgacctgtcggctggcacaatctcaatcttgtcgtcttgccactgaatcaagcattgatgcatggttgaaggaatgcaacaattagcatgaatccaatcccttccaagcaacaagctataagaaccattcccatcgatgacaaagaatgttgtagggatagttttgttaccaactgtcagttccacattcgaaactcctttggtttctgatagattgccgccaaagtctatgagcaccatgtttgtcttgatgagatcttcaacgtttctgcccaactttctgaatgtagcataaggcatcaagttaacttcagccccaccgtcgaccatcatcttggacattggcttcccattgacataaccatttatatacaatggcttaagatgccgattctccgtcccctctggcttctcaaaaattgcctgctctggcaacaaaatcaatttggctgattcttcttcaacttcatcgacatcggcttgcttggtcccaatctcagcaggcaacgtgaaaccatgttgaccgaagcagttacgacacttttccccttagctaacctttttgcctcctcagctgtagcttcatcggctacaggaacctgattcttaacacgccactcctgcctcgactttgttttctgcagccgatggttaatttcctgttcaacctcctaaaagcactccctgttcctcaatctttgaacccttctcttttgattcttcgtgaaaataccagaaggacaccactgatttttcctgatttcattgtcctcttggccatgatcttgattcactggacccaatctttgatgaacaggaactcttgtctgccttagccgattgcccctaccatatgatcggcttgaattcttggcaatatcactgcacccaggacagtcttcaatagacggcagccttagaccttcatttcaacaaaatctaaagaactcacaacctcaatgaggatcaaaaccatcgtcatcttcttcatgatgcttctcctgctgcttgtcatacttcctctgatatttgttgataatcttagccgaattcacctgaaaaccccttgcacggcccctatcggctgttcagccagctgtatgcaccatattaacaggaaaaggattgccatcaaccttcatcagcctcttagagtcgtcaaacttgattttgcctccctcaatagccgcttggatctgctgcctgaagaccttgcaatcattagtcgtatgagatccagaattatgccacttgcaatatcttttcttccctaattcttcagccgatggaattgtgtgaccggcaggaagttgaatctgtttctctcggagtagcaagtcgaaaatcttatcagccttggatatatcaaagtcatacctttcctctttacctgagttctttacccattggcatggtataaccttcttactccttacccactcggctgcagctatctcagaatcatcatcttcatcatccgatccatatttataagggcaaacatgattaaccttcctagaatttttcctagcctctgcatacctttgttcatgcaaggctaccttctgtgtaagatgtgacaggctttcaaagtcttcagatgataacttctccctaattggagcaatcataccctgaaaagccaaatcggctaactgggcgtcagttaaactcaagctgtaacacttatttctcatctccctaaatctctggatatactcatgtactggctcatcatgcttttgcttgattgacgtcagatcggacagtttcatctcatgaatcccactatagaaatagctatgaaactgcttttctaaatcagcccaactgttaattgatccatatggtaaagaagaaaaccaagtaaaggttgacccagctaaagacaaccggaataacctaactttcaaagcatccacagccgatgcttcaccacattgagctaaaaatcggctaatgtgctcataagttgatgtactatcttgccatgagaactttgaaaaatctggaactttgaaccggttgggcaaaggaactctctcaaaccacttaggatatggctgccgatatagatttccagcatctttcggcctaagcctgaactgctccttcatgacatctgcaatcaaatcggcccatggccactattgaggtgtcccttgaggttgttgtggcatcggctcgaattggttgtattgaagaacaaattggggctgagccgatcctgcttgctggtattgaacatgaggtgatggtggctgatattgataattcaaattgccccctggtaattttgaagatccggctgaatattacgcaccaaatgttcaggaataactagcggaattaccgtgccatctggttgtacgtgatgtactaaatgctctgggacaacctaatttgtagcatgttgcacaggctgcccaccaggtgttgcaaaccctgccgatgaattcattgaaccttgctgttgaatcggctggacaacctgttgccttaatggagtttgctgaaccggtcgtacaactcattgagctaggggtgtttgctgcactggttgcacaatttgttggatttggggtgtttgctgaatcggctgttgcgggttggatcaacagtgttttggggaggcaaaaacatagatgcaacctggtcttgtgttagccgatccacattttgtccagcgtgttgtggctgttctcttatcagcaatcggggattgaccaattggcctggagccgaaggtggtacagtaggtgcgggagccgatgctggtgccatcggctgagccgatggtgcaatagaaggagctgcttgaacggatggatgactgttggtgatcaaaggccgataatttggaaatactcctccttgcaaataaactgggcctgcagcttggtattcagctattgtaccatcgaccattgacttcatcatatttgacaatgtattgactaacatcccagattgattgatcaaagcattgtgcacggcatagtcaacccgatcttggaagttattgaaaaactcctatgatgcattgccatcctgattaaaatttcctccacgcaacccctaagcaacatcaccttgaactccatgcaccccatcaccttgaaccccatggactccttgagaattgtcacgttgacctcctagagaaccgtctgtagcaccattgtcactcggttgagccgagccgtccggagcttgtttcccgtcttcacctttagaagaatggtcccaggatcatcggcaactacctttactttatacttctgaaccactgttcccttgctagtctgcatgaatgagttcaagaattgatcccgtgcctgctgcatcatcgcgtcgaaatctttcttctgatcaggtgtgaatttttctggatcgatgggcacgacgtttccttcattgacgtcggtcaatcccaacttctggatcttttccttaacagtgcttggactagccgaggatggcgatagcggtggtttctcggccatgaggaagaattgcttgctgacttcttcttggtcccactgggcatgccaaaagcgtgttgacgtaaaacacgaggcctgcgagatctgcttaactccagtgcaggtccaaagctcgccttcgggtatgttagcgtgccagttgatttgatcctgcaatcaacaagaaatagagacaaagaaaccgcggttaaacctataaatgatagacgatcggctaagtgccgatgacatatcatttatctttgagccgatgtcatatgtaaatctatcggcggttataaatagataataaagaactaaacctactcgatcgactgtagatatcaacaatatataattttatatcgatatatacataaatcgagtgattgggatagatcggtcgccatgccaagacagtataaatcacttagattgaaatatatattaataacagaactatatatgtttatagcatagccgatcggatagatctagcatgtatcggctaatactccgatacaactctatgttaagatgttgaaacaaacagaatataccaaacagaagcttaatatacttagatgcaataatatcctgacataaagggcagatttaacatgtcaatgaaacatataaagcaaatataattaaatcagataagatcggctgaaactccgatactaccctaattggcaaccagaaggcaggctagatattgatattctaagcacgacttaatagatcaaactcaactgatacagcattacgtatgaaaagaagaacaatatctagacaatcaagtcgctggaagtttcatatagtggtgggtatcttatataatctaaaccaacatcgatatttaacctaatcggctgccctctattaacagatgttagccgattgtaggctagatggcgatatcgttagagattatgtaagatatatgataactcggtgaattacataaacaagattagtgtatcataaagatggaagcactaatcccgagaacacaagccgtcataacaagttttacctcttgttgaagatcgaaaccgatgcaactcaacccgaaagcaagaaatcatcgaaataaaactaaagcaaaaagggtggcgatgcgccgaaattgtattgaacgtgtgtgttaaaaattacatagggctcggggtctatttatacccgagaattacaagatatgtccataccggacacgactattatctctaacaaactctaagataccataagtctttgtggcagacttttgcccatatttatctctaagaaatttacataaaatatcctaattaatagatacaattgccttcccaggactttatccatgtatggcaatcatcttgaagtacgtcaactcaaacccgatatcgaatacaagtcgtattgtcagaatcggctgcatcacttaacccagtcttactcggacttaaccgattctaatcgtagccgatctaggctccagccgattcttgctctattctcgaatcgatctccgccttcggctccacttcgatctaatcctcttttccgatgctgatattactaaatttggtcgttaacagctttgtccaagccatccactctctcttgaagttgagcatttgccacctcaagattagcgtgagactctttggtttgcttgtaaagccgtaccaaagcctcatttttctctctccttagcaagctcacccttgagttcatgagaccgctctttctcacgaatgagtaatgcctcttgcctcctctcaagggttgcatactgatcatcaattctcccaagcaactcactcaagtgtggtagagactccttggttatggacttgaacaattcctcatccataacctcatcctcaacatcatcctcctcatcacaaacaagatcaacattgattgacttgagggaggaaggtaccttaggctcttttgccatgaggcaaatgggagcatcctcatcacttgagtagttgaagagtcttggtggtgatgaaggcttgacggcaaacgtggcaactccttcatcacttgagcttgactcggagtcggagccgaaaatcatcccaaggtgagcttggccataacgttcccgcttgctatgcttgtgcttctccttcttctcatccttcttttcgcccttcttatcttccttgatgtgggaaccatccttgaggtaagggcaatccgcaatgaattgcccgggctctttgcacacgtagcacacccttgcagaatgtcttccacttgacttgttggagtggtgcttggaagaacttcccttgaagaagcagcttcacctcatcaacttgccgaacttcttgacgaagagagccatttcttcatcatcgatctcctccttgctcttgctcttgcggctctattcttcttcttcctttgccttcaatgccaaatcttccttcttgatgcttgtcgttgagctttggttgatgtattggatgacctccttggactcttgcacaagcatgtcatgggctaggatgcgcccgagcaaatcatgaggtgtgagagtcttgttgtccagacgctcacgaatgatagttactaaggtagagttccttggagtgattgctcgaaccatcttcttgaccacaacctcatcggtcatgtccttggagccaagtcccttgatctcattgacgatcttgctcaaacggtcatacatgtcgcttgggctctctccatccaacatcacaaacctctcaaattgccctttgaggatctccaccttggactcgcgaacactatccgtgccttcatgcaaattccgaagcgtgtcccaaatcaccttggcactctcaataccgtccacgcggttgaactcacttccactcaaggcgctaagtattgcattagcggcttgagcgttcttgtgctcgttctcgtcatcctccttggtgggatcctcaggtttttgcaaaacatagcccttttcgactattctccaaatagatgggttaataaacttcaaatgcatcttcatcttatgtttccaagcggcatagtccgtgccgttgaagtacgaagctttgccgctataggtactcacataagaggtagatgtggatggatagtcataaggaaacgtagatcccttatcaccatctttgccatcccccgtttggcccgacatgatctctccaagcggttaagcctaattagtagattaggctctgataccaattgaaagggtcaattaggcctagagggggtgaataggctaatttaaaactttatgcggaagctcacactgagttagggtcggaaagtctgatccacagtcagaccatctgaaaatatcagatagtctgatgttggatcagactgtctgatccactaaagaaacacaacaagtagatctagtgcacaaacaggagtatagcgcaaacagcgactagatctatagcggcacaattaagcaaagctaaagaagggatgaagagatatcaccaacaatgaagttcaccgagttgttcccggagttcaaatccttgaggggattctactctccgttgaggagctcactaagagcggggtctttgctaaccctttcctcaagaggttgcactaagcactcctccttccactaaggggtatctctttccttgcggaggcgagatccggccttcacaaacttctcccggccaaccacacgtagatcggtggctcgggagtaacacctagccgtctaggagtcctcaacctccaagagtaacaaacaccacacaactcttggtcaaaccctagtgctcaagatcgagtgaaacagacagtaggccctcaaacaccaaatccacaaccaccaagatccaccacacaaagaacgaggagggatttgagagagggagaaagagctcaaatatccaaagcaccttagcaccaagctcaacccaaagtgaatgtgaatgaatgagttgggtaaccctagaaaagggttaggtggggggtatttatagatcccccaaaatgtggccgttgggagaaaatattttcatcccacctcggaaagtccgaggtgacatcggatagtccgatgtttttgacccccaagcacgccagagacagagaacgaaattctggagaatttcggacaatccgatcgatcggatagtctgatgttatattggatattccgttatttttgaatcatgaatttcatcctctcacagagactcaagttccattgaatttcagagtctctgggtcatccgatactccgatcacatcggatagtctgatttgaaaaatcactcaagaggaataaaaagcaattcaagacagagagtgaagttctgagaaagttcagacagtccgatgtatcggacaatccgaccttatatcggattgtccgatattttttagccaacactcagaccaaagacagagggaaaagttctaagaaatttcggatagtctgagcatcggatagtcttatcaggatcggatagtccgacaggaataaaataggaacagtccaaataaaggattttgagcactagtgttctaccaattatatgcatgtggtagccctcttaatagtacggcatcctaatactcaagaacacaagatatacatggaatagaagataattaccacaaaagatgccgca

SEQ ID NO: 67373 - DNA, 724 bp, Oryza sativa
tagaatcttatgataggaacagcgcagaaacctgcaatggaaatgaaagatcaggcgagtgtggctgctacgcacagccgggtgcacggagcgccggcggtttcggcgggagaatccccctcggcagtagcgcatgatgggacagcaggctcgggatctggaatccagggggactagcagcagcgctctcctgcgcgtccgacgcgttcgccgatgggaggccagtcagaagctggcacgtcgcctgccgtcaactctccccgctagcccagcagcatcatcacgtgcccagagcaggacgtgcagcagtcccatccacctggatcatctgtgcaaatggaggccgcacaacagggtgtgtctactgaggtaatgagaccgaaaaccaggttacaaagtggcattagaaaggataaaatttatactgatggtactgttagatatagttgctttacatcttctggggaaccacaaactttggatgaggctctaggggataaacattggaaagaggcaatggatagtgaatatcatgctgttatgaaaaataaaacttggcatctagtacctcccaagagaggtttaaatgtgatagattgtaagtgggtatataaaattaagaggaaagctgatggcagtctagacagatataaggctagacttgtagcaaaagggttcaaacaaagatatggtatagactatgaagatacctttagtcctatag

SEQ ID NO: 67374 - DNA, 26026 bp, Oryza sativa
cttgggatcccccacacttcgccctcttccgtcacttgttcaacctcaagccccagccttcctgagcaaatccccaggtggttggaggcgtcgtccaccagctgtggcccaagaagaagaaggattacttcaatcttcccctcaaatcttctttgaaggggtggaattttgagtgttttttactactcaaacccctccccttctcttcctccgtatgctagtcatgcccctcttatcttctttcaacaagttgaaggaggcgaatctggccgacgtctacatcgctttgaacttcgtgcttcggcacatccaaacactcaagaacagggtgcatatgagttttgagtattgtggcccccacatatcccacttgggaattggatgagaggaatagggacaatgaggccaccacctggacaaaaatcttcaagctaggcgtagtggttactaccaaggggtgcccatactctttcaacatcgagaatccacatctttaggtaaagctcgcacattattgtctatgtccttcgttttacttccacccataactgttagtcatcatgctaagatctttatatccgagcccctaagatggtcggagaagggctcctgaaaaaggcccgccaaagatcccgccgagttcctaagctccaagcgtgcagggaaaaagctaagaagcaggctcccagagtagccgctttgcgtggccccaaagtcggtagcctttgggtaggcgtgaggccacccttatccctcattagggatacgtcaacaaaagcctactaccccgcaaagagagctatctgaaagttcaagtgacattgatttggttttgatgattaataacaaatccaattatgtgagactaatgtttttataagcatttctttgcctattctcatgtggatatgaaattggagtgttggtggacctaaatcacaaggatgaaatgcatggagatcaagctatatgtatcactctttctcttcatgtacatattgatatgttcgtatataatatttccacgtgattggcatatgcatgtgagactaatgttttgtttgagtattatctcttatttagtctatttacattgagaacgtggagatgatgaaggtatatttttattttaatatctatatttgagaaatgccttctattcttgtataggataagctctcaatgtttaatatcttgttatgcatgctcttgcttcacacaaatattttgtatgcatacatttagggggagcaaatcctatactttagttatgcatgtaatcaatccaagttattcaccttcatttaattgggatctttacatttgaacatatatttgagtatatgacacttgtggtgttgattaatactcatcatttattcatatccttttatacatgcgatcggttggtcaacatgtggaggttgacaaccggatcattgggactaataattttattgagttgaatgaaagaaataggtcccaaggattacaaaggtgttgatgctcaagtgatatcattacacctaacaataccaagaatgacaaagtgaagatattgaagatgtgtgatacgaagtggctattatggcaagatggtgaagggcaagcgatgctcggtcgcgatggaccatgcggcggtgaagggcaagcaaggggcttggcgccgaaggaccaaatccggtggtggtaaagggcgagtgacggctttgtcatgatggaccgtgagagaccatttgaagctacaagtaaccgcatcaatcatttgaagaatatatggtgaaacggtatcggcattggcgtccctctagacaatgaaagaaggatgaaaaaaaggcattcctaatggtataattatcttcttatttacatttgagtttaggaatgccgtactattaagagggatgcaacgtcgaggtgtttgtgtatgtctcggtgctcaaagtgacctatcatagtgctaccttgagagaagcccaagctttaacctatcctttgagtggttttagaccttgtttttggttgagttgggtagtcctctgagtgagctttctatagagtccaagttcatcgaaaacggactcccgagtgaaaagttatagtcgttttactctgtgcttttcggaaagtccgaaaaattaccggaaactccgaaaattttcggacattccgaaagtggctgcgaatatgagatttgcttctgtaagttttcggacttgtccgaaaatgcttttcggaaactccaaaaattacagtcttggcctccaacggctagtttttgaggggctcgggtatataaactcctccacccctcttttgaggggctgctgctcttggggagtattagacacatccaaagccaaatagccatccccatttccctacctttgtggtgcctctttgtgagggggatttgagaaggggagagagttggattgagagagtgaggagttgagagctagtgagcttcactccatcctttgtgtgcctctttgtgagagggatttgagaaggggaaagagttggattgagtgattgagaagttgagagctagtgagcttcactccatactttgagcactcgagttcatagcaagcaaatcttcgattgtgtttgttactcttggagactaaggtctcctagacggctaggcgttgccggtgagcacccaaggttgtggtgtgccatggaaagtttgtgaaggcttcgatttcgcctccgcaagggaagaaatcaatagtgaaaccgaggagtgcatttgtgcaccctcgtgaggaaagggttgaaataggcctggcccttgtggctcctcaacggagacgtaggatccgtggatccgaacttcgggaaacaaatcacgcatctcccctcttggtttgcccgttcttgcattctctcatattgtgcttgagcttgtttttacctgatctacttgcatgcttaattgatttagtaggtgaccttatatcttgcttagataccttatttgtcaccttttgattcatatacattttgtttgtttgagctacaagttcatagctagtgtttattccgttatccgccgaacttttcgattgagaccggaacttccaatcccataccggaagtttcgatttgaatcaaaagttatcatcactctgatatgctatgaagttgtgataatttttaggaacgcctattcacccaacctctaggcgacatcaaggtcctttcactatccactcaatcatgtgaaaacgccaaggtaggcacatctactctagcactcatcgccaagagatttgcatcgctcgaggctaggatatctactaccatcgatttatcactgtcctcaccacctgcacattcatctcataggctcgaggctaggatatctgtcgttgccgcacgcataggcaagagtaggggtgaaaacggtacagaaacggatagaaaccatctttatcgttttcattttcatattttttttcggaattggaattggaatcgaaaacctcggatacgaaagcggaatcgaatattatcgaaactgaaaacgaagcgaaaatgaatcggcgcaaatactgtaacgaaaatttatcggaataaaaaacccatcaaactgataaatccaattctcaagtctcaacggtcaacgatttatcataaaacataatcatataagtccaattgttaagtattaacagtacatcacaaaacacaatctatgaaaaaaattatctatgtttaagagagtaatgatgttgataaatcccaatgtaggaaaaaaatattcttatgtaattttagatttgcataaaaaatattttttaaaaaataacagtaaaacaccatggtattcactattaagtgctttaaaaaataacgcagggtatttcagttacaaaatttttggaaattccgaaaaaaattccaaaaattccgagaaaatttttggaaagtttccaaccgattccgagttgctacggaaacttcccttatcattttcgattccgtttacgagaaaatatttcctcgtttccgttttcgaaaaattccgaccgtcagattccgttttcaaaaataggtccggaatccggaaagtttccgtaccgtttttggccttaggcaagagacactggtcctttgcctccacatcatacagaggagcaaggtgaggcgtcgagactcagctatcgtggcgctcccaccataaagttgtcaacttcttgactttggcttgaacttgcatgtgatgtctttgagtgtatcttgtatagctgtgatctatgcaggtggtcatcgaaagaaattcccgctacaaatgttagcgaaccatccccaagtgatgttgcgtcctctcaagagggaggagagattccctagccgagcgccacctagccatctatcccgactcctcgatggtggaagagtagccaaccaagcctggcccgtgcatgggctctggtgaggaacaaggttctaatcttctgataggtatttataactcttgatttggcggacacttgacacacatgatccggcttccaatcaacacgatccaaaccctacaatcgcaacaccacgtctcctctggtaatcaaccgtgtgctacccgattggcctcttcgagaaggctaatccctgcatgcgaattgaagaactcaagcaagaacaaggtatattacaacttattttgcagatgaatgattaagaacttaaagttgggtttccacaaactgaacttgcagcgaaactgcaacgacataaataatataagaaaaatccggctataaaactatgacagctaatgtgaattccgcaaagaggactaggctgggggttagccctaggtcgtccaccccttggacttagcccacgatatatttacaaggcccaaaacccaaatcagattcagactggattatgtatgtgacttgttttacatattctctacagccgagttgaaactttaatgtgggaccaaaaccatctgaaagtatgccgagttggaactttaatgtgggaccaaaaccacatgaaagtatgcgcatatcacggggttaatctaacgggttaattaactatttgccatttttaagatgtgaaatttaacaaatttgccattggatccggtggtaaatcgttaaatactacattgaagaatgggaaatagttaaatacctctaatctaacggctgaaaaatggataaattttaagggaaaaacctttgaaaacaaaaccgcaaaaaatggcattgggttcagtttgggccgaattttcggggcactagcccatcactagtagtacgagtaggccgtacgactccgcgggcccacctaccagtaccagtccaatacctccaacccaagtcttcttcctcgtctcgtccgttcgtctcctcgcccagatccgccaatcgcccatggagtccccaccccaccccctcctcctccttctcacgctcctcgtcgccgccggcgccgcctccgccggcgccgatgacctggtcgccgagctgcaatccctgcggtcccgctccccgtcgggcgtgatccacctcaccgacacctccatcacccgcttcctatccgccccggcgccgcgcccctactccgtgctcgtcttcttcgacgccgcctcgctccactccaagaccgacctccacctcccccagctccgccgcgagttcgccctcctctccgcctccttcctcgcccacaaccccgcctccgccgacctcttcttcgccgacatcgagttctcggagtcgcagcactcgttcgcgcagttcggcgtcaactccctcccccacgtccgcctcgtccgccccgagcacacccgcctcgctggctccgagcagatggaccagtcccacttctcccgcctcgccgactccatggcggagttcgtggagtcccgcaccggcctcgaggtcggccccatcgtccgcccgcccctcgtctcccgcaaccagatgatcctactcgtcatcctcttcttggtctccattccgttcctcatcaagaggatcatggacggggagaccttgttccatgaccgacgggtttggatggctggggcgctgttcatttacttcttcagcgtgtccggggggatgtacgggatcatcaggcacacgccgatgttcatcaccgaccggtccgatccaaacaagctcgtgttcttctaccaggggtctgggatgcagctcggcgccgagggttttgcggttgggttcttgtacactctcgtggggctcatgatcgccatggtgacacacttgctggtgagggtggagagcctgcagatccagcgttttacgatgctggcggtcatgataattgggtggtgggcagtgaagaaggtgattcttttggataactggaagactggatatagcattcataccttctggcccagcagctggaggtaaatgcttgtacaatggcagacgatatggatggtttcttccttcggtttctgaggtatggaatttcaccttcctttcatgtctgtaattttggatgaaatattgtaacttgaacgtttggcatgactgtgctttttttagcaactacttgttatgtttggtgtagattttggtaattcagaaattcttcttcagtcaaacactactctgccccaacttctgagtgacataacagattcctaacataaatcgaacaacagaatcaaagatcattcaatattttgtgcaggacttgctagcctcgttatataacactagttgctcacccgtgcgttgcacttgacagtattgtaaaaaatgtaaatatctgtcaaattttaaactgatgaataagtggttgaatgttttttcttcaaaatccctttgaatgattgaacttaatatttaaacgctaagagccccatcggttggcctaataagccaaagcaaaagccaaaatttgaatttttgaacttgattttgagcttgattttaagatatttttagcgtaatttctttttagtgttggcttttaagtcgctacaaacaaatatattaaatttttacctataaattaattttttattccctaataagccgtttgggcttattaggaaatatgggcaaccgatgaggctctaaagcacttgctgcaattacaaactcataaagagtaaagtccatcaccggtccctaaacttgtaccgctgtgtcatcccggtccctaaactcgcaaatcgaccattcaggtcctcaaacttgttcgactgtgtcatcccggtccctaaatttgcagatcactcatttagatcctccaacttgttcagttgtgtcaccccggtccctaagctgccatgcatcgtatattcctcttcttgctttaatttgcttcaatgcatgcatggccaattaaaagacgcatagtggtatttgattggttcatggatagaccagaatgcttttatttgacactgtgatctcgctttgtcttctttgtcttcactgttgagttctgtgccttcatgaatcatgatttcatgcaaattagtacatcattctctatcttctaactcagggcctgtttactttgatgccattttcaaccttaccaaattttggtaaagttgccaaaaaagtggctacatttagtttgctgtcaaattttggtaactatataagaaatcctgccaaaattttggcaagttgccaaaattttggtaactatgccaaaattttggcaatgccaaaatttggtaaggttttttttggcaataaagtgaacaggccctcaatcccacctacattcatcattttggttctctactactgttgtccatcgaattccgcttttgatccaatttgtgtcttcacccccaccatctgctgcccgctgcctcaatgcaatacaaaatcacaatttattgacggctttttctccataaattcagtgccacctaactgctttgtcgccacaccagctacagcggtatgttgtgttttgcggcaatatgcagcaaccctgctgctttgcctctcccaggtgtaccgcgaagctaagaaggcgaaggagatcgatatgccatgtctcgcagtcctagagtggctgtcgacgatacagtcgcgggcagagccatgaatttctacgatactgagcctgatagagatatcaatgtcattatggatgtagagattgcatccaaagagtccacgatattttcaggtcgtgttttatttagcacaaatcctaaatccaatctacggttataagaagatgatccatctaattaacggttagatctttatggttaacgtgggagctcctaggaagtgcccaatttctataggtggatagataggcatatgcatccttagtagttggtactttgttgtagctatgaagttccacgtattttgctattggcttctctaatggaaaaagggaccatgtcctttctgaagagccttaggatatgtatactacagtgacgccttatatgtgcttaatatgcatgaatttgctgttgttctaattgtcttttgtataacgtactgctagatgataagagcatgtgcatcccttaagacctattttaggtatcacggtggatgctttagcactttctccctcaagatgcttgttagttttttgtgctccatcgaagatgctaaggtcaatggtagatcaaggaattttatactattgggtcaattcttacccatatttaagtgaagtcatatctaattctttctggatttacacatgaaaatgaagttttacaaggtggttctaaaaagctgcggggttgagctgaccccacaatttctatgtggacagagttgtggacctgtcactggctaaggttatcaaattttgacagtgttgactaaaatcacgttgaaaaaaatatgtttcttagcactaggtgttactgtgttaatcttagatggtaagcatttttagctttcaaacctttagccgcacctacctttacattccttttttcatgaatacatatcggctccacattgcttagacccatggtagctttttttttttaattcttcgttagcacctttgagcacctaggggtgcttatgttctcatcaatgaactcggatgaaatgtataattaggcatcaaagtgtttagtctaggattgatgctatattgtttcttttagggtacattatgtttcccatgtgctctctatattggctttgctgttccacatcaatgcttcagtttcatcctgcatttgtaaacaatatgtgatccgtcatatagaacatgtgatcagctttttgccattgaccttgtctattgaaacatcttgtgtggatatgattgatgttcttggattttgggtttcttgatgctaatgcatgaacagtttcaaagactcattcaccaaggtttgtgtatagatactactagatttggctgtctcaaccaatgcctacttaataacaaattcaagttctactagctagatgctttgaccgcagtcaaaatattatctaaacttgtatgtaaaagtagtggctacttgtagaagttactgtatgttcaaacatttttgttgacacgaaaggagaaaaatacagtgcaagcttgggtcagtcttttttcaacttccctcctgtcctatttacaattagtttgttattactaagtaactcagagtagatgtaacaatatattttctttgactgtgctactctgggtcatactgttgttcaactccaaggggcataatgatttggccatttgggtggtgtactactatactctccaatcacgaccaagtgtcagaattggaaatgtgcagttaaaccattttggctatatcattatgaatagttgtagcagtcaataggattgttgaaagccaacgcagttcagattttttttatcctgatgatctaatgataggcacagtaatctcattgttgagcatacagttaactaatactttttttcaaagaaaactgatatgctcaatagtattttggacattttagatatgttaatagtctagctgcaaaattgttttggattccagtgcattcagttgatgatttactattacctgattgcttctactctgaaaacatgtatttcaactgtttgtcaagcaaatgggactctgctgatggctcagttgcttggcctgaccttacccacttgaacgagcaactccaaagtgccatgtagctaaaaaattgccatgttattttatgtcttaatgaaaataaattacctgcaatccacactccacacttttagaaaagtcaaacatgtagggctaatgcggccataccatattgtagttggaaaacacaagaagctatagggtttaaccattctgttcctgagcaacaaaagcttaaagcctaaaaatcatgtgtgcagttgggaggaaggcttaggcttggttgtgggcgtttcctaatgggaagatggttggggtttaacataatgttagttctaatggaaactttgggatttattaattgtgtatgcaaaacattattttgcaaacaatcttcttttatagtatgtttttaatgttcgaagattaatatttcattactttagtcttcaaaatgttttcaatattctggtaaatactagaaaagcatgataaaataatttttcatgataaatggtattagcattttcatataatctacatacttacctgatatttttagcgaacatcaacatcctagaagtggattgaaaaaaaatacaaatgccatgcatgaaattgtttcatatgccctgccattgataaacataacaagtagccaatgaatgttgtgtgtgatattatgcctatcagtatttggttcatttcacagtgtctagtctactctattgccagacaataaaaatgcatttgttctgattagtatccatgatggagctataatgtgattagatctcttttaagttcacgatcaattcgctgtttagcctctcctttgtgaaggccgcaaaaaagtgaagttgtggttaacaagtagttcatttatgctccggaccttgcgtcttgaatatagtagattaataatgaagctgccatgtttattttcaaaaatgggtaggttaaactacaggtttcttaaaagaatgtacaaatagtactccctccatcccagattgatcatcctctaagtaaagggcactaaagccaatgacatcaaaatactccctccataccacaatatatggcgcgcacacatattaagattcaacttttaaaacatttgaccaacacttagtataatatgaaattaattttatttattaaaaattatatcattagattgagatttaaatttactttaatatggttataattttgttgctacaaaccttatagtatatgagaaattataagctaaagattagttttggagaccgtgccagctttgaccgcgtgttatattatgggatagagggtgggatggagggagtactgtttactaattgtcatcatttagtctttttacataacaattgctatgctacgttggacaactatttcattatttgcttatgttatttcaggttatggaattatccaactttgaccgtgctgagatagagcatattttggagtgttgggacttgccaagtttatttttgcaaatttctgatgctgtagtatgaaatatgtagacctcaagtcatgttagttatgcagaggaattatgacattgcacatctatcacttgaacaagaaagtttggcttttgaattattggtttggtttcttcgaatgatgtatcgtggttgatgtagcttgtcaggtgcattgtcattttggaaaattgcttaatggaaatcattagcattgaaggggccaataggtcagtgacctctgtaaatgttggatgcgatatgcttgcttccagaagcaatccccgtgttcttttcacccatgggtggtaccgcaatttggcagcataattaggcaactagacaactactatatactgttagattagattgtattttaggtgccagcgttatataaagttcttcacctattgagtcgcaagcatttgaagatcaatctacaatctggatcatattcaatgaaatttgttaattgttggatcatattcaacgaattttagttgatcttgagaaaaaaaaattattgggaacataaccggcttgcaaaatttgaattatcacaaaatcttgctgcacggttatggggcacattttcacacggccaccaatttgcaaatgcactaacgttgttcagcttatgcatattcttcctccgtttcatattataaataggtcgctttgattgttttcctcattaattttttcaagtttgactaagtttgcagaaaaatttagcatagaatcttctgggtccaattctatgcgtgacgtgaacgtcagggtgtggtcgaagacatgggcacggacagccatacttagggctccactgaagatggcgaaatctgttcttgggagagttcctagacaagtcaagccactctgcactcctgccgagcacctaactttcgtaaattccctactatgacaagctccgtttgatctagtaacccgctgaaatgcagaagcgtagttaaagtgaatggagtccactgtcgctaacctcaactccgccttagtggctgatgctgggcctccgccccctcaagaccctctccagaacgatgaggttctcgaggacgctaacgctgccaacggccctatgccaacaacagtgagcatcgcatccccgagaacgcatcgccacgacgacatactcatcaaccgcctccctatcaaaatgctcacgatctccgcgaccaattgaacggccgaaggcgggagcaacaagaccaacacgatgccggacaccgacaacctcgcgaccagaattgtagagacaatcgtcgagatgacaatcgtaactgcgaccgagatcgagatcgtcatgattgctagagccgacaagacgagaacgaacgaggtcatcgaagtcatcgcgatgatcgagaatgacaagactcacgatctccagctctaaggcaaggccgaagccatgactaccgataccccgccttcatcgtcctcgtcatcatccaaggcggttcacgtggacctcatagtcgccgaccacccctattacctagaggtggatgcagagcctttaaagtcaactagcccttaaaattccgtcctgcagcggtagagaagtacgacatgagcatagatctagaggagtttttgcacgtctattctactatcctatacaccgccagtgcagatgacaatgcactggcaaattacttgctggcaacattgaaaggatctgctcggtcatggctggtgcaccttcctccctcaatatcttcctgcgcggatctttggaagcatttcatcgcgaattttcaaggcacctacaagagacatgtggtctaagatgccttgcatgccctcaaacaaaagcacggtgaacctcttcgagattttatccgacaattcaacgaatgtcagaatatgatcccagagatcaccgatgcatatgtgatatgagcattcaaatcagatgtctaagattgctacacaatccaagaactggcgacatgacggataatatctacaatgaagctgtttgaggtcattgataggtgtgctcacgcagacaaggccgttcgaagaaatgatgggaaggggaagttagtcaatgaaaatagttggccaaacaagatgctatggaatcaagttggcaatctagtcgcaagaaaggaggaaagcaaaaggcacagtcggaggttcttgtcgcagaataagagaaaagcgctccccaacgacctcctcctcaagatgatggccttgtactgcaatggtgtccggtgcacaagaccaacgctcacatgttcaaggagtgcaatgtattttagaaagccatgactaggaagatagcccaagacaagggaaaacgagtttgcatggtagagtagggcaccaatgaccttccgttcgatgccgaactagattttcctgacttcgatcaacatgtggcgtatatcttcggcggttcaaccttctattcttctaagcgggaatacaagaacacgaagtatgctctacatctcgggtatcgacgtctaagatgaattggtcaaatcagaagatagagttctctgacatcgactacccttctctgacgacaacccctggacgatacccgatagtagtcaagcctactattcagaacgttctagtcgcgcgatttctcattgacggtggcagctcaatcaatctcctcttcctcagcgcgcttgacgcaatggggattcctagaagcgagctcatcccctcagaacagcccttccatggcattaccccagagtcatcatcaaggttgttgggggaagattacattgcccgtgacctttggcagagttgacaacttgcagacatagcatatcattttgatgtagcagagttcgatattgcctacaacactatattcagaataacaacactcaccaaattcatggcggcttcgcattacgcctaccagttgattaagattccgggacctaaaaggataatcacggtgccagggaacgcgaagatggccgtgcaatgtgacaagatgagccttgatatagtcgagcaaactaccgcagtcccgccacaatcgagcctcctgggaaagtgagcaaacccaacttggcacccaaaccagacgacgccataaagataatcccgctgtctagtagcacacttgacaaacacggccaagattggcgccgagctcgactgcaaattggaactcaagctcatcaccttcctctatgacaatgcagatgtatttacctagcagccgtccgacatgtccggagtcttcagggaggtgattgagaacaagttgatggtttgacccgacgcaaaacctgtcaagcagaagttgcgtcgcttcacgccagatcgcaaagaggctatccaagaagagctcaataaacttttcaaagtaggcttcatcagagaaatcctccatccagagtggcttgccaacccaatcatggtacgcaaatccaacgataagtggaggatgtgggtacacttcacaaatctcaacaaggcatgcccaaggactattttccccttccacggattgaccaaccgatagattctatcgcagggtgtgagctgttgagtttccttgacacctactccgggtaccattaaatcagcatggccaaggaagacgaggaaagggcaaccttcatcaccacttcggtgtattctgctacgtcaagacgccttttggcctgattagtgctagatcaacttatcagcgccaaatccaaggggctttccaatcccaactcagcaataacgtggaggcctacattgacgacatcatcgtcaagaaaaaaaaaatcgagatcgtctgatcgatgacctaagggaaacattcaacattcttcggagacatcggctcaagctatatccagagtagtgtatgttcagagtactattgggcaaactgctcggattcctagtctttggacgaggtagcgaagcaaaccccaacaaaatcaaggccatcgaggaaatgaaatcaccgatgaggctcgaggaagtccagaagcttgccagatgtatgacaatacttagtcgatttgtggccaagatgggagaacgaggactgcctttctttaatttattgaagaaacattgacaggttcgagtggacatcagaggctgaagaggcattccttgtactcaagcgatacctcgccgatccaccagcacttgttgccccacaaccataggtggaactcttcctctacatcgccaaaacgccgttctccataggtactgtcattgttgtcgagcacgacaaggtccaattcctagtctactatgtcagttaagtccttcatgatgccaagactagatatccgaagatctagaagctgctctttgccatggtcatgacatcccgaaagctgcgtcactgcttccaaacccacaaggtcatggttgtcttgtcatacccccttggtaaagttcttcgcaacaaagaagtcataggatgcattgccaaatgggtcatcgagcttggccaattcaatgtccacttcgtcccacaaacgactatcaagtctcaggtacccgcagatttcgtcaccgactggaccgccccaaggacggcaaagtcgatcgtatggacaacgagcgatggacaatggcctttgatggagcattcaacaaccaaggagcaagagctgcattcgttctcacgtcaccaaccggagatcaatttcgacacgctgtccaattagatttctgagcaaccaacaacactgcagagtacgaaggacttagagcagccgcatcacttgtggtcaaacgactagttcagaaaggcgactcagaaatagtcaccaaacaagtgcataaggattacaaatgctctaatcctgaattgtccaagtaccttgtagaagtcagaaaactggagcataggtttgacgggcctatagtacaccatgtctaaagcaaagacaacgccgacgtcgacaaacttgctcgacgagcttctagtagagagcaaatggaacctggcatgttcctagaagtattaatcagtccatctgttaagagttcgctggacgacgacatcaatatcaccaccgacattggctcgggggctagttgatcgatcttggcggccgtctgtggagaaagagaaaacctttgccgaagacagttcatgttcatctgcggtcacaaaatacggatgcacgcgagcacatgaccaccagcgaactgattggtccgacactctcttgcttgaggcttttgttgatccaatgagcggtgccaaccaggtcatcgcatgtactccacagccagcctagataacctgttatggatctcttaggagctagacgaaccacatgcaactcttggcatagctgatcaagcgatgtgcaacaaccttcagtataagcttccatctggacttctctttccttgagaagcttcgagttctagcctttcttgatattgtcggttgctcgctccggctctttcttttcgaacttagttctccagtactcggcccagcgtttcatctcctcgagagaatgtttaagatctagaatagacagcgacaccattagcatcctttgttctgagtacaggagcaatacactataatttcgggttttcgcaccttgatatttctcacgaaggagcgtgagttgatcatcttgagaggccaacgtgccatcagaagtgacgacgaccagagcacggtcgccatcactcggggttgacgaggcctagggcgtactaggatgtgcaattaagcctgacgagcgtccgccttgctggacgttctcattctcgacttcaaagcatctacagaatacaaaagacaagatggaaaccttaaaaggataacagaagggaagtgttctcgggcaacagacgaaatacttgtccttaaggttgcaatgaaactaaaattagcatattactcttcaaaaaaggggatcacagactcctcgacatcctccaattctgatatcatgtcctcgcgacgcttgttggctcctcccttggtcatcatttgttcaatgttgacctccgggcgtgtgagtttgaggcacataagaacgtggcatgcgtcggtctggatcctagacctcattcccttgtctacttggtctgcatgggagctcgcggcggtctccagcttggttatcagcgacccaagggacaccaggaccgtggtttcgtcaggaaactcgggatgaggaacgctcatccccaggcccttttgcggccacatcgaggcgcccgtagttctagtgcagagcttgccagagtgaagccaggttgtccttggacttggtgattcctccgcgctggcaatctcctcctgcagcttggcgttgtccgcacgctcttccgttagatgggcttccagggccacaatgcggtgtcaaccgaataggcgacttttgcaagttgtccaagctcagccacggcatctcaggcacttgcttccaacaatcgataagcttgtagcagcttgttggaggcagaggtcgagcctgagatgacaagggcgccggccgacggaggaagaaatgtagggacaacagtagcagcagcagtagcatgaggcgacttggagctcacctcctcacaagccttggcacattgtcccgaggccgcaggtgaagggctgcattcaaaacatcttgggttacaaaagctacacgacgtcaagtggaaacaaaaaaaggtcaagttggtactcatccgactttttgtttcatcggtagcattcccttcttgatggaggcggactttgtgctggaagttatttgcaaacaagaaaggttaagatcgagaaggctaccatgattgtcagacaaacctgaaatagaagcctcacctcagagctgctcgtcctaactagtgtctccaccccagtagtcttctcgagagagggcaaacgttttcttttggatccactgccctgggcacgagggtggcggctgcttgctccaacacagccagctccttcaaagaagcgaacgcctagtggttgacaagctggccgatcacatccgttagaggccatgctagtatgggtcaagattactacttctatagccaaatatatgatagatatggagaatagtccgagatgcttacgttcacgatgatgtccttcttggcctatgggaggttgcttatcggcatcgggatgtcagcagtggccgatggtggatcgaccactacctgccctacccacttcaccacggctgcatcagaaacagctataacaaagataacagtgaaagattagatgttagagacagttcatagtactagggttatcagaaaactttgggttctaccaaagtgcgatatccacgtcatgtcctttgcccccatgtactcgtatgcagggtgagcacgggcttggagagactggattagacgacgaacaaagtcttctctacaacttcgtacccagtcagaccgcgttcttagagatcatgaattttgtcattgaatcccttcagagcaggggtcagagaatgtttggaggtccatgaccccagaatatgagggattttcttcgggaatagcaagacaaggagtggtatcagtgacatgaagataaaaccagctatccctctagtattttctagaggatggacagttaaaggggatgtatctacccttcatcttgtccctcagatggagactacaacatccagagattctaaaggcctccatccatccaagcttataaaatatctaaatagagctatgaaaagctgtaccccaaggtaagcctcgcataaatgagtgaagatactaaggaatcaagggagttaggattcagatggagaaggtgcatatcatagaaatcaagaagaagtgaaagaaactcggaaggactccggaagatccatggagagtcgctgaggagatgagggaagtttgtggcttagggttttttttttgcttgttggagcagtgggaaggtgcgcgaaggggaagcaaaatgtttgtttaggaaaacgtaacccaaatggatctcataagtggaatttataacccacgtccgacggttcgaatttggaggaagacggagaaatcaccgtcggagtttttgtggatttgtttatagcagtttaaagtttctgacttcaatccaaattcaaatttgagttgaagtctcggacaaagagaatagaaggaccatgtcatgtactctaaacttactcagctgttcgagaatggttaggtgagttcgacaatgattttcttcaggatctttgctctggaacattaacctactcatttgcattagagtcgggtgttactgtcagtgtcagggcgttactgtcagtgtcaaggataagacatacctcctatacatgggtttgtgtaatacggcaataccatatactcgatagtatatgagaatgtatcctttaattaaggaaatacgattgataaagaatgaaattatcttcctggaatataaggtgtccgagtcttagttggggaagataaggtcttcttaggcccatatcctgttttatctcttcgaattatatttggagaatagaataatctacgctataaatacaaggcccccttgtccagggaggggaattgagttacaagccatagccaaagccacatcaagaagcaatccggaggaagccagagccatattcgctgagtagatttcgtcaggtcgttctcgacagcttctggtcagtggatcagtctagttgtcctatttcccattgtaatctttgtggtattcccatccatatatccatataaacttgagtaggcttattactcatcctaagggctcgaactagtatcaatccttatcccatgtttgtatatccgatctcgcgtacatcctggttccaacgatccccatactttatgaataccatatagggtataacctgttgaacccttatcaagcaaatgctatgaaataatcacgacgaaaaaaaaatcacaaaatcaacttcaaaatttaaagaacaaactatgataaaaaaacataaaatcaacttcaaaaatgaaaattttaaatttatattatggctataaaataaactatgatgaaaaaaccacaaaaccaatcccaaaattaaatttaaaaagtatcaaattttggcttaaaagcgtaagtgtaagcgagataataggatgtaaatcatgtccaaaaagtttggactatttcaaggcctctttatagtgcaaaagcaaattaagaaaatttaaatacaaactcttggttcatatttaggccccatttagtagagctcctaattcaaactcacaactctaaacttcaactccagtgagagctggctcctttaggagctgaggtaggtaaaaaagtgtttggctagattactcagctccacgttaccacatccctcatcgccatttcgtccaacaccttgtaggcgttaccctggcgttgccgccgccgggcagcccgcgagccgctggcaccggtcagcccgcgagccaccgccgccggttggcccacgcatctccgccaccgcccctggccaccgactgtcgacgccgccgcctccccggctgcctcgcgcacgccgccacctatgccgccacctgtcgacgctgccgcctgcgagccgcggccgccgcccgcgagccgacgccaacacgccgtggcccgtgctcgccacccccgcatgctggccaacgtagacccgccgccgcccgccacaaccagttgtggccatcggagaaggatggggaagatgatggagaggagagagaccgggaggagataggtagcaaggggtagttcaatggcatttttgtgtaaatatagtaaaaaaattaaagggtaatgggtcttttggtgtggagttatggagcagcaaaaaactagctccacccccatgtacaaatttctggagccactttactaagttcgcttccaaaaaaaagggaaatccgtactttttggcacagctccgcttcaaataagtgaattgggaattggaacttggcccaaccgagccttaatgggcttgggtgatgtaaatggatagtactgtgcatgcccgtcctttccacatcatgatttggtaggtgtaatggacatccagtaatttttacctttgtatatttgggtatggataattcaactaaatggataattagggggtgtggctaatgggcgatcgatcgcttggagagatcgatccccatgccccccctgtacacacctctcctcccttcctcctccccttcttctcttcctactacactacaaatttaaaaaaaaataaaaaacaaagttggaaaaatttatgtatagaaatactatatataaaaaatatttgaattcaaatttaaatttgaagagggtaattaaacttttgacttataaactttgggtctataaactttaggtgtataaactttagatgtatagaaatactatatacaaaaaatatttgaattcaaattcaaatttgaatgggatatataatttttgatttataaactttgggtctgtaaactttagatgtgtaaacttgaggtgtacaaactttaggtgtataaatttactaaaataggaaagtaaagcggtgcctaaaaaggaaaccacgtggaggagaggggggagacccgatcgcccctggcgatcaatccccattagagcaactccagcagagaccctaaactcagcccctaatcagtttttgagggtttagagataaaaactagattcagcagggaccctactagagcccccaaagtgaggaggaccctagattctcctcccaagcccccagtcctgggggttccgagtacggcccccatcgactttttttcctggcgtgaaaaaaaatccgcttcgcgcgatctcgcctcgcccgcgcggcactacgaccagatctcctccgacggccgccatcgactcccccacccacctccgccaagatcgccccaaaaaaggtgaggattttttcctacctttgttgtcgtcgtcgtccacagggccttcgacctccgcttgcacgcctggcctccgcctgcatgccagccgttcaaacgctcggccatcgtccgcctggccacacgctgcttgcctgcacactgtgttagagtccggatattctttgtacatgtgataatgctccatatagctgtcggacagagtttgttgtgttagttagaagcgatagaacttatccatgtaatctaggttctcacaacaaactctgaaccgaagctatatacctcattgtaatcctggcacccattttgtggcaatcatcaacacgtaatctcctcaccgtaggagttcctcgcttccacatggtatcagagcctgttgctagattagattagttcgtctttgtgtttctgcaaatggcgagctcttcctcagcagcggcgatctccaatcctctgttcgggattcaaatctcggataaactcaccaagaaaaatcaccccctctggtctgcgcaaatccttaccaccctatggggtgcgcagctggaagggcatgtcaccggcacagttgaagctccggcggccgagtgcgagaaggaagatggcgacaagaaagtcaagaccaccatctccaacccggaatacatcaagtgattcagtcaggatcaacaagtcctggggttcctcttctcctccctatcacgggagatcctgcagcaggtggctggcgcgcagacgacagcccaagcatggaacatgatcaacgacatattctcctgcaaatccaaggcgggcgccatcaacgtcctcctcgccttgacgactactcagaagggacccatgtccataagtgagtacattgccaagatgcgatcccttggcgatgagatggcggcggcagggaagctccttgacgatgaagagctgatagcgtacatcatcaacggcctcgactccgacttcgacgcagcggttgaaggattgatggcaacgacaagaattgctcctctcttaatctctcatgtgtattcccaacttttgagctatgaaaacaggatcagtattcgccaaacctacctccctacttcggcaaacactgcaaatcgtggcggtcgtggtggtcgcggtggaaatcgcgggcggtgctcctcgcggcggtcgcagtggcggccgtggtggcgcaggcggggccaacactgggcgagggcgcggtaacgacacccacccggtgtgtcaagcctgccataaacgaggtcacattgcaagtgactgctggcaccgctatgatgagaactacgtccccgacgagaagctaggcgacgcggccacatatgcctatggtgttgacaccaattggtatgtggacaccggggcaacagatcacatcacagggcagctagataagctgactacaagggagaagtacaagggaacagatcagatccacactgctagtggcgaaggtatgaatattaaacatattggtcataccattgttcctacccctagtcgtcccttacatcttaaaaatatacttcatgttccacaagcatcaaagaatttagtctctgttcatagactcattgcagataattatgcctttcttgagattcatggaaaatattttttgattaaggacaaggccacgaggaggacaattcttgaaggaccatgtcggcgggggtctctaccctcttcctgtcggcacccccttgagacaagcctttgctgttgcgccatcgtttgaacggtggcatggtcatcttggtcatccctccaagccggttgttcttcgagtccttagtcaaaataagttgccatgtcttagtaattcagttaatgagtctgtgtgtgatacttgtcaacaagcaaaatgtcatcaattaccttttcctagatcatctagtgtgtcgaataatcccttggaacttattcattctaatgtttggggaccttcttctacttctgtaggggtaaagaaatattatgttagctttattgattattacagtaaatttgtttggatttatttcctcaaacataaatctgaggttttctagaaatttcatgagtttcaaaaacttgttgaaagacaattagatcgaaaaatccttgccatgcaaaccgattggggaggtgaatatgtcaagttgaataccttttttaatgggataggcatatcccaccatgtgtctgtcctcatacacaccaacaaaatggagctgttgagcacaagcatcgccacatagttgaggtcggtctaactcttctagcccatgcttctatgccactcaagttctgggatgaggcatttttagcagcttgctacctcataaatcgcctcccaagtagagttataaattttgatactcctcttgagcgtttgtttaaataggctcctgattataaatctctcagaacctttggttatgcgtgttggccaaatctccgtccctataactcataagctccaattttgatccaaacagtgtgtctttcttggttttagcaatcttcacaaaggattcaaatgcttagatgtgtctaccggcaaggtgtatgtttctcgtgatgttacatttgatgaacaagtttttccctttgcaacccttcatccaaatgccggtgcccgtcttagagcagaaatatctttgcttccttcaaatcttatgaacactagcacattggatcaagggggagaggaacaaaatgatcaaatgtttaatattcacataccaaatgctactaatgatgcctgtacagacgcagggataaatgacaggtgcagtgctgaggacagtggtcaaatcagcaacgaaaatggtgaatcagagagctgtgctggtacacacagccgggtgcacggagcaccggaaatttggcgggagaatcctcctcggcagcagtgcatgacgagacgacggcggtctcgggatctggaactcagggggagcaggcaggctcccctgcacggctgccgcgctcgccggcgagggaccaatcgggagccggcgcgtcatctcctgtcgccagctctccccgacagcacagcagtaccagcacttcctcggcgccaggtgtgcagcagtcacatccgtcaggatcatctacacaaatggagccagcacagcacggtgtgtctactgaggtaatgagaccaaaaactaggctacaaagtggcattagaaaggaaaaagtttacactgatgaacctgttagatacagctgtgtttcacatattctggagagccacaaactttggatgaggccttaggagataaaaattggaaggcaaattttgctacaggacattgctattgtgtggttttatccctaggacactgcccaaactcacttttgggggaaaacactccataaacgtagtaatttgctagtgggcaccacgctgattaaaataataatttccggttgaagaggagagagaaatcgcgtgaaagttgtataatgtcttggcgcccacatgcaatatcatccatct

SEQ ID NO: 67375 - DNA, 3672 bp, Oryza sativa
ctgtccatcatggacgtagttcttacagaaaatttaagtagttcttacagaaagtttaaatgcaacttgacgtagtagttcattacagacatagtttagatgcaacctgcaaattaaattgacaaacatttcattcaaacactcattgtctcattggcactttgtcgtcgtcatcatcatcaacatagtccatctcaatattaccatcaccatcttggccgacggcgccgacgaagaggtggctgttggctgacggcctgacgcgacgacgctgacgaacaggcggcggctgttggccgaggcgacgacaccgacgaagaggcggcggctgtggtgatgggacgacgccgacgaagggacgagacgacgaggcggcggcggcgaaggggcgaggcggcggcggcggctgtggcgaaggggcaagatggcggcggcggcagcggcgaaggggcgcggcggcggtgggcggtggcggcggccgccgtcatgcgtggccgcgtggggcggctgttgtgtgagtgtcgcctgttgcttagctagctagggtttgtgttgcctgttgcatgttgggttgggttgggctgatgggctctttgggctgattattctgaatggttgatgacaactccggatatccgggaaaaaatcccggatagtttccgaccgttttccgattccgtcggatatcacccttactgtattcgttttcgtatccgagaaaaaatatccgaattcgtttccgaatccgagagattccgaatagttccgaccgaatttttccgaatccgaaaattagtccggacggacggaaactatccgaaccagtttcatccctatgtatcactgtacctatattagtagcactgcattgtgttggactgcactagtattgcaatggatcgatctgaaccattgacatatatacttcatcaagtttatcctaaaataattgcttgtcctatgcatatatataatcttgcacatatatatactatgtgctgtgcatatgcttctgtagttgcatttatattctctaattttgcaatgttgtgatggcagtgatttttgtacatggacttttccgacgatgacgatgatctccttgctgaatggtgggagcaagaggtgttgtccgatgatgacaactactatattgcagctgctcttcttacggacatagagcataagagaaccaaaagaaagtgttgtggttcagtcccaggtcgtgagataattcatagggacaggtttgactgtatgcattggaggtggaagaattgcccaacaggctggaaaggacagtactcagggcatgtggatgggccaaccatgattcttgaagctgttgcatctaaagatttgtggatttggcattccttctttggattaccaggttcccttaatgatatcaatgtcctacagagatcaccgctctttcaaaggcttactccagggacagcgcccgagttggagtttatggtgaatggtaagaaatacaccatagggtactatcttgctgatggcatatatccttcttgggctacttttgtgaagaccatttctaatccacaaggtaacaaaaagaatccattacgcaaaagttcaaggagtgaggaaggatgttgaaagagcatttggtgttttataagcccgctttgcaatggtgagaggtcctgctagattttgggatacagagaccctatggtacataatgatagcttgcgtaatcatgcacaacatgatcatcgacaatgagcgagatgaagatgtagactttgactatgatcagggggacagtgaggtgttgaggaaggaggattaccagcgacgcgataaacatgtgttggagaagtttctaaagatacataaagaaattgaagaccaacaagcacatgagcaacttcgagatgatcttgtgaaatatttgtgggcacttcatggtgctcggtagtttgtcatttgcattttctatcaactatgggttattttcaatatttgcttgtaagatttatcattttcatgttagaaaaatttgaactcaaatttgaatcgtgatgtttgaaattgtaaattcgaatatggttaaattctatgtgctagaattatttatgtttgaattattatggtgttaaactatatataaacataaattatatactaaaataaaagaggaaaagaaatagaggctaagatatgagggctactgctagagttgatgacatatttaggtccaaaagaattggggcagcccccatttgacatttaggagctctaaactagaggttactgctactggagatcctctcaggagtttcgtaattagggtggatgtttgttatccatacatgtattgtccaagtgcaaattattgtaatattcccttcgagaactaggtagctcgtggagtatctgatacgtatgtcaaattgccaactcttgaatcgtgcgaacactatatattgtttataagcttgtcaaaattaaacattttcattggacagaaacatgcggaaacttctgctctagtacattaactaaaacgaggaggacgacaaattaagcgcagtatgcgttggtctccagaagcattgataattaattgcgcatgttagcaacgattagaggcatgtttcaattccatctggacgagcagctatccatctaccccatgcaaaatcaacccccaaatatgcactttatttgtataacaacagtacaatgccgcaacttgacacgtctgaattatgattagccaagtctacggctgaacgtagtagcgacgactttcagaaggaattaggcagaaattaaacaggtacggcgtaataagtgagtacgtagctagcacacgttgcctcgcaaatcgcaaatgtgttaagcaattacacttgttaagctacaacctccgtcctaaatataaagatttgtaggatatttaagttttatatcataatgtaagtatttctatactaattttcataattccaatcattgcaatcattctaaagctaattagattgaaaatccaagcaattaaaaaatttaaaaattaacaactaaaccgacaaaaatgaatcttttaatttaactacttcctccataaaaaaagataaatctaaaattaaatatgacattgacggagcgtggggctcctcaccgggagaccgtgcaggcccccctttgccggttcggccgggggcgctaagtgaggttcttcgctctcgatctgaggaaagtcagcgagagaggaagtgcacaagacacgggcgacgtagacaggttcgggccgctgagaagcgtaacaccctactcctgtgttctggtggatctgtgcgtgaaggaatacagagagccggagagcgagagagagttcaggctctagaacccattcgccagagtcccaacccctttctcttttctctcctccttttttttttactaggcctgggcctcctttttatctggtcaggggtcaccacaagggcctccagctacctaagaaaagaaacatgctttttacaatgagggctagtctacatccggaagtgacctctgacaagcagagcacacgcctcctgccccgctcgcccgcttttccggtggacgcccatttcaaccttcatttaatggccagcgacttccttgccatacttgcgctgaagcctggaatgg

SEQ ID NO: 67376 - DNA, 1661 bp, Oryza sativa
ggggtcggggcgccccccccccggggcccaaacggaaacggcccgtcccctcggggagacagagggaggggtggccacgtcaccctcgggcccgacccccccgagggggtcaggccacgtgggtgaccgcggctacccaagcctctagtcacgataccaacggccccatgtcaccgacaggagcccccggcgttatgccagagcgatcgcccccctcgagggaagcgctcgggcgtgacgccactccttaggcccggtgacaggtggggccggtccctataggcgggcagaaacccagcggtcgcaaatcgcgcgcatcggcaagggaaaaccgaccgacaataatgagcggcctctttaagactgctacattactcgagcagcgcgcgaatcgggacgagccggttcgtttcgcctggagacatgatgatggcgcttttcacggttggcgggcgtagttaatgcgcgcacgatctgccccatctcaaccgctacggccgcacatctgccgcgtgcgccgcaaacgggcgagtggggttagtggaggcgtgggcgcgagaaacgagggggcgaggtagcgggcgcgggaagcgaggagccgggcatagcattggcaagggtgtaaagacgccgagaaagggattcgtttctttcctctcgccactcttccccttgccttcgccacttgtgctctaactcttcgtttcctgtgccctacccttgccgcactcgctcgctctcaagctcctcctccaccggcgtcatggcacggggctccgcaccgctcgatggtagcgtgctgccgccttcccgcatcgtgagcgagaggcaggccgggctgccgcgccgattcatgccggaatctgccaccggccgggaggtggtcgcgctgggcgagggacgcccggcgccacactacccggggcggtccgtcttcttcctctctttcgcaatggcggggctggtccggccattctctatttttttcatggatattctggagttgtatgatctccagatggcgcacctcacccccaacgcgataatgacgttggccatcttcgcgcacctgtgcgagatgtttatcggggtgcgcccatctctccggctgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcaggcctccagctggcgggcggcggtagatctgggagacggttacaaccccgttcttgaccgcctggcgggtctgcgatcccaggggctcacgggggccatggtgttcggcgactaccttcgtcgccggatcgcgccgttccagctgcgcgcccggggcgcctgggatacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaagatcctggtcatcatgca

SEQ ID NO: 67377 - DNA, 33920 bp, Oryza sativa
ccatctcccaaggcgagttttcactcacccgtttctttttgtgttctggcttttcttctgccttagcgagatcccgtcgcgccccccgccattccaagtccggccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggtcagactccgctgggccggggagtccgtccaggaggcagaggcggcgcgcgcacgccaggcggcctgccaaacccccgacccgactccgcccgaggcgatgacgacttccgaggccacccacgacgaggccgcgggcacgccgctcgggcccgacccctcgggcgacgcttgggacgagccagcttcgggggacgcccccgagtccggcacgtcgatcggcgggccgagccgcgcggcacccacaccgagggggctctcccctctgccttccgctgccccactgagcgcggagcccctcctgcaggccttggccgccgcgaacagcacggtgctggacgggttaagtgcccagatggaggccctacaggcggagcgggcggagctcaacgcggcgtgggcgtgcgttgaggaggggcggcgctcggtggaggccatggtggaggcgggccacaaggcacaccgccggcacgcctcacagctcgaggcccgtcgtaaggacctggcggagatcgccagggaggtggaggaggagcgggagactgccctcatcgccaccgccgtgctcgacgaggcgcgggacgacctccgcctccaatacgggagccgggcggtggagctagaggagaagcttgacgccacctggggagtccttgacgccgccgctgcccgggaacggcgggcggcggagaacgaggcggcgtcccggcagcgcgaagaggcccttgaggctcgcgccacggcgctggaggagcgcgcccgcgccctggacgcgaaggagagagacctggcggaccgcgaggccaccgtcgccacccgggaggcaacactggcggcgcacgaggccgcctgcgccgaagaggagtccgcactccgcctccgcgaggacgcgctcaccgagcgggggcgagctctcgaggaggccgaggccgcggcgcagcggctggcggacagcctgttcctccgcgaggcagcgcgggaggagcaggcgcgccgcaatctggaaggcgcccgcgccgagagggccgcactggatcagcgggccgctgagctcgaggcgcgggcgaaggagctggacgcgagagcgcacagcggcggggcggccacgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccgtctagaccgcgccgggcggcaggcgggcctctggggcgggcaatacgcgaagtacgccgccaaccaggggggcctcgcccagcgcctctcaaagatggccggggccctcgagcggctccccgaggagctcgaggagacgatcaagtcatcctcgagggacctcgcccggggggcggtggagctcgtactggcaagctaccaggacagggaccctgacttctctccgtgggcagcgctggaagagttccctcccggaaccgaggacggcgcgcgcgcgcaggtccgggacgccgccgaccacatcgtccacagcttcgagggtacggcccctcggctcgcgttcgtgctcgactccgacgaggagggcggtgacgacggtgcggacgacagtgacgacgaggccgacgacccgggcgcgtcggagtgagcccccaggcccccgccaatcttaataacttttccttcttcttccgaggccttcgggcccccttcttgtatagactgatttaatctgcaatcaagtaaagaggaaatttctgcgtcagttctgtttgttgtgtgtatgagacgagaatggtctgtgccgcggtccttctgtgtcttggcttgaacaagggctcgtgcccaggtcccagcctcaaacggcgcgggtcgaggctagtgcctggggagatcctcgtgtcgagactggctaggccgggagcgcggtgaccgagggttatggatgacccgattgtgggcctttgccgattcccccccggagttcaccacgccccggggcacggctcggttctaggccccgtttggcgattttagccggcccgggccaccgagggcagggtcgagcacgagcgtgctaattcaagccaagattcttcaaaaggaaacgatggcacagacacagtcctcaggaaatcgaaaatgcttttattgaaatgcggaagagaaaaagggtaagtatatgcatgtggtagcccccggctaaccctgcacgcccgggggggggggtgcggggttggcccgagcccgagacatgacacccgacccccgctaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagaacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcatggttcggttcgccctgagcaccgctggcagctcctcgatccacgagtcgccgtgcttcttgaggatgttgaaggtcttggttttgaggcccttgaggatttccgcgttggtgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttattgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcaggcctgggccggctgatgggtttgcctggcgtgaaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcctttccaccagcacgtagcgcttggagatgcgccggacgcgttcattcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccatagggggtcgggtcgcgccgacggctgggcaagcctttcttcaaaggcgcccggtggggtctgggctcgcgaggaagcgagccttgagagttcgtcggcgaccgcgttatcccttctgggcacgtgccgaagctctatcccgtcgaaatggcgctccatacgccgcacctggcgcacgtaagcgtccatctgcgggtcagagcactggtactccttacagacctggttaacgaccaactgggagtcgcctaacacccggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaagagacagggagccgtcgaactgcatcacccagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcttggaaataatggcgcaacttcctcgaagtcatcagaatagcgtaaagcatcttctgggcctgagggtatcgggtcttggcgtcccggagggcctcgctaacgaagtagacgggccgctgcacctttcggcggggccgatcctcttcgccaggggccgcatctccagggcgctcttcgtccgagaggccacgcggggcgcactcggcttctgtgccgacgacctcggggttagagggcgacaggcgcggccttcccgcaatggccccggggccatcctgggggtcgggggcacctggcaccgtcggacaagcaggcggagggccagctccggccgtcgggggcctcgggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcccgctcagcctcctccgtctaggtaaacggcccggagcgtttgaggagcttaaataggggtagcgccttctctcccagcctcgatatgaaccgacttagggcggccatgcagccggtgacgcactgcacatccctaagcttgctgggggggcgcatccgctctatagctcgtatcttctcgaggttggcctcgatgcctcgggcagagaccaagaacccgacaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcttatctggctacccaaagaaattcgagtagtacgttgaaaagtaggatctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccacttcggatggatgacctcacggatgaatccggcctccagaagtcgcgccacctcctcgcggatgaaggcttgacgttccggggcctgccgccgcactttctgccggaccggccttgcgcccggccgcacggtgagacggtgctcaatcacctccctggggaccacgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggtaacctccttgaccgggacctcgtcgcacgtgaccatctgctgccttggggcggccgggatggaggtgctgagtctctcgtcgccacccgcgggcttggacgccgcggcaaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccgggaccttgatggcgtcaaaggctgcgagggaaaggatgttgagggctgcacccccgtctatgaggacacgccccaacttcacattgcaaacggtgggggaaaccaccatcgcgatctgtcctccccaggcaacgcacggcgggtggtcggtttggtcgaaggtgaggggcaactccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcatcgatgtcctcggcggtggccttctgcttggcctcacctcgccggttgccggcgggagccgccggggtcttgccctcacggcgctcctgcctcttctcctcctcccacttcctcgtccgctcagccaaacttttgaccgcgcggcagtccgcgaggtcgtggagggaggtgttgtgcacggtacaccacttgctggtcgggcgctccctgctgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgccgccctgaccgagcggcggacccgggggcggccggagctgccacaccagaaccggaggagttccaggaccaggcctcctccttgcgagccacacggtccgcgagctcaaaaagctgcgctgtggtctggggctccttggaggcgatcttctcgagcatgcggttgtgccgcacgcccctcctgaacgcgtagatcaccgcgtgtgcggggatgcacggtatggtgttgcggacttgacagaaccgctgaatgtacgagcgaagagactcgtcgtcccttcgcagctctcatcattccgacgggacggggcgaggcgtgtgacaggccgcctgttgccacctaacccgcgatctgaccggtctgtgaccggtcacacaccgtgaccggtcacggaccggataagcgtgcgctgcgccgcattaaatgcggcgtggcgcgctcgtccaacctgctataaatgcggttaggtgagcccgctgtgctcatctaacccacatacgtggcgccaaaaccacagggggtcggggcgctccagccctcggggccgaaacgggagcggcctgacccctcggggagacagagggaggggtggccacgtcaccctcgggcccgacccccccgagggggtcgggccacgtgggtgaccgcggctacccaagcctctagtcacgatacccccggccccatgtcaccgacagacatatctgagtataataaatctagataaaacgttgcatctaatcttaatttttcttttatggaggaagtatcttataacgggcgagtggtagaagcctgcatttggatagatgattgggttgatctctctgcacagtgtatgcgtccccagttgcagcctctgttttaaaaaaaaaagttgcagcctcttagaataattgctgcagcgaccggcagcagtaggtgggggcgtcacccttggtgattaggatcgggagttatccgggggaggtttccgaaacaaacataaaatatatatgtcgaggtcgattctttctcttttccctttcttaatatttagggactggtagcaacctactacttaggcatattctaatctcctatgctaatcacctaaaaagaataatgccctataataaagcgacagtagtgcacgcacacgcaactcaataataacagagaaatatttttactagctaccaaatcatttaggaaacaaaacttggcattactaacaagaaaaggacactgcgatctttttgtgaaaaataaaaaactgcaatcatgtttacaagagcgtggccaacagagtgcctatactgcccatgatcctaattcctagattattgaggttttaagtaaaaatgggtattgaatagtagccctaaacaaactcttaaaaaaaaatctcatctcatctcttaaaaagtttgaagtcgttgcatacgggagcacgggaggagacgaccgattcgtttaattttttatgtggcccacctttcaaagtttaattgtgttagaagggaggatatttttatcctttaaacggatttgctaaatctctggcgccataaaattccattgattacagtcggtttgcatacctatgcgctataccacacaactgcacagaggcctcccaactgtgttaccgtgagattgaagattattttctcacatacatcatgatgagtgatgactatatattaattacattatatgtaattttaggacttacatatgtaattttcgaacttacatatgtaattttgagacttatattgtaaatacactaaaattacatatgtatttttgggatttacatatgtaaatttaggacttacattataaatacactaaaattacatatgtaatttgtaaatttacaatgtaaatatataccgactattttttttttgaaaaatatggcgtcataaatgtagctactccccctttaaataccattagagattaaaaaaagaggattgaattttggtagtatgttgatgatgctttaattctatttcataagatactctgaggtgcaagtttaattttttcctattctcagccgtccaagtggtacgagctggacggtcatcatacaaatgataaattaagatgatacacagaaagtcaaaatgatcggtcttgattttgaggacaagaggattactaatacaaacaaatttaatatatattctctgttcttgatcgagatgtagcaacgatcatatatgtttagttcgatcgatagacgataataattttatgcttttctttttcataccctaacgtatatttaaattttattgatctaggttttactgccaaggaggaatcataaattggttaagtgagagattatgtacaaacaaaaatatcaattgcgagcattcacgaccaactttctccgttcatattatgagtcatttaaattttgttattagcaaatttctaaaattttgaccgggtttatagaaaaatatatcaacataacattaaattagtttaactaaattcaccatgaaatatatcttaatattgtattgactttttattgtagatattggtataatttttataaaagtaattaaaatgagacaaatttaacttaggacaaaactaaaatcggaacgggtaaaggatagaactcgaaagaaagtgacttcttggtaaatgatttttttaagctttgaaccaagatggcgtgtgacaagagattctgaaaatgaatgttaaaagcataaacaatgtcctagttcgttttcaaaccaaatgactcccgcttctcgtcgggtctaatgatggcgaaggagcaggtttttattcgggcatccacgatgtaatgaagtagtggttaataagtattgaatgcatccctactaccagctattatacattgtggaggtggtaaagaactactaccagggtataagcttactaccaggtatactttatggtgggtcccatctatttttttaattgtggcaattggcatgactcatgtttaaataactttttagatgggtcccaccgtactatccactctacacactattaccacctgacatgggcccaccttactacctagttttgcaataaacattgatgatgccttagttaattcatggcaaaatgtggcatacaaaccagattataagggcatcctcaatgtatgtgggacttacaaaattaggttatagttgtttctatctctcacaatgtgtgagtaagatatggcgcacatgtaaagcaatggttggatagaaaagagagagggcgagagaggtaatagtttaatgtcttttatggcatagttgctatctcctctattatccacctccacaatgataaagtaaagggtcttacaacccatttttcatccatattgtggatgccctaaaggccatgtttcgttagacaaaattccctcaaataccaatatccatctttaacgaaacataaattttctcaaataccaatatccatctttatacttttttatgcgtataataagaggcatacacattagacaattaatatggcaagagaaatttattatattacacgaacgagactaccgatcgggcgctcgatccaggcgtggaaaaatcgggcgctgacgtcagcatatacgcatacgtgcaaaaccactttaaactattttttctcttaaattatttatccaaatcatgatctggttcaccattaaattcgttgcaattaaatcttcaaaacaagaccacacatggatatattccgatgaaaatttttttagcttattattgaattattttaaaatgttgcacgatgttccaccaagtatatcggaattgtttcattaagtagattgaaaatgtttcaatcgtttaaatcggtcattgtttcaccttatataaaaataatgtttcagcaagtagcgaaagaatgtttcagttcactgcaacatttgatccatacataatgaaacattataaatacactaggtgaaacatttttggtggaacaaaaaataaaatgaattcccttaatagagggtttctaaaatatatgggtgatttgtttcaatggagtatgtgatggagacacatgacaggtgggggcagcggcacgtgggtgaggccccagggggcgcgcacatcgtggagggagggagtgctcgattttcctccctcccccccgagcgaccgacggggaggattctcaatattacacagtaccttattgtgtccaagccgtcaaaatgttatggcttgcttctgtctgttcattctctgtaattcactaaacaaaagaaatatattatattattggctaagagatgtcctgttaattgttgtaaaccttggcaaggtgggaataattaactatttgctactcttacaagtggttctaaaggatttgccagtggacccacatgtcatagacagcgagtggcaaatcgttaattgccatatcttaaaagtggcaaatagttaaatgttccggcaagttggcataagtcgacctattctattttgagctttgtttgaattaacatggtgaaagagaaagaagaaaagatcagcgacctaggtggctgagatctaactaggtccgtcgttactttcaattaggacaaacattttcaatatattatatttcttactattttttgagttgtaatcctcgactaaagttaagtttgcaaagcaccggtgatttgcatgcatataatttcaaaccactacacaagttagtcatatatttgtaatggtattccaagggctcgaaaaggtataatgtttcagtaatttaaagttgtacattgctaggactaaaattttaatgatatctaatatacaattttattttagttaagcattaattttgttaccaatggttttactttatttttatctaagtttaattacttgtgcacatattactgtcagttattataaatttattttatttttatcttagaacaattcattgttgaaccttttatctaaatgagttgtatcaagaaagtaaatatgtgatatgcatcacacaagttaactctcctcgcagataccatatactgcaaaccatatttttgagtgtctctgtttcgtgtcaggcggttgggaacccaactcccctgcacggaaaacagagcagtctattagcacgtgattaattaagtatttgttaattttttttcaaaaatagattattttgattttttaaacaactttcgtatagaaacttttttaaaaaaacgcaccatttagcaattcgaaaagcgtgcacgtagaagatgaggaataggagttgggaacctgcccaaacgaaatcgtatcctaaggtgtgaacctcttactaggtatatctcatactgctaaattttattcataacacaactaccaaagtccgagttgagtacgacaagacaagtagaagttttcgttaggatcaatacagagacatagtctatctatcccataaaaaactaacctaagactgaatgtgacacttctagtataacaaatctagatatactaggatttgtcacatccattcgttatttttgtgatggagggggctaagctcttttcacaaaagctaatccatcaggagcccttgccacaacccatcgagatcacaatctcaatgtattagtttgctaggcttccaccatatactcttgtacatgtcaacatctagtcaacacataaatatgaggaaggctatttcgtatgtttccatgagcccagacctatataaatctcatatcttttatgtgatgtgttcttcgtacgtacgtatcttcataccaggttgccctacacacccacaactattgtaattgtgtttcaaccattcgacaagttcgaatagagaatgagggttgtggtgagagcctttagatttttatccaaagaatgtgaagcataagccatttgaaatgtagatattccattcacaattggccttgtttaacataatgaaatttattttggactttgcttcaaggaaattacaactaatcaatacaaaggagaaatgacgagtgactacgaattatgaaaaccactacttactttcattattttatagttggggagaatcatcataacattgtttgttctcaacgacttacaagttatatgtagtcctattttccttaactcaaaagtaaaatctcagaatcaatgactgattactgtgttgatagaatttcatatacattaattaccactgacgactgacatcaaactaaaacgaaagataatatgagagaatcatccgtctaaactctaaatcatgtcatcgtaattggccggcggaggcataatgaagaagctaaacaaatctgactgaagtatgtactttgtgttgaccaatttggctctacttaaataaaacataattagcgatcaaaatgcactggtataatattagcagtcgtttttctacgacgggaggcagaccgatcgagtgtgttaggagttaggaataatccacagattaagacgacgcagatcctaaaacacacaacatttataatcaaaatcaaaaaacattcctcgcgttcgcgtaaagcacagcaaaccgtgttgccccgctgcgcgcgcgtgtgattggctggcttggtcagggtcaacgttggttgctactactacttgctaccaacatcaacaagaagaaaacctgcatgatttgcggctcctctccgtccatccaggctgccggcctgccgctgccgagtagtagtagtaagcgccgcgagtacgacctcgtccagtctctccctccctccctcccaccctgcgcgccttcctccttccatcttccaactacggtccaaccccaactactctaccacctccaacttttcagaccgcatagcatatcccccaccctttctacttctgtgccttcctccgctctcgccaccctcatgctctttataacccgcaccacctcatccgtcgcatcgatcctccctccctcaatcgctcaaactgcattctacaacctagctagcattcggaaatcgttccgtgctcaccacgtactcaccagcgcagcgcgccatgatgattcttgaggcggagcattccttcttctaaccgccgccgccgccgccggcggcgcgagcaccgtggtggagcctgtcgcgtcgtgctccgcacggacagcttcgccgccgacagctccttcgccggtaacctgggcgcctcgtctcgctcctggaggccaaggccccggccatcgggttcgacatcgccacggtcggggtcggcggcgatggggaggatcagcgcgtgcacggcctggcgctctgccgcggcgacgtcgcaagggcaacgtgcgccgagtgcatccgggcggcgggtgcgctggcgcggcgcgtgtgcccgtccaagaaggacgccgtcgtctggctcgacgcctgcatgctccgctactccggcgagccattcttcggcgaggtcgacgccgagcaccgcgccgtcgtcccgccggcccgcgtcctgcggggcgcggacaggtcggccgacctcgacagggaggtgtcccggctgatgaagcggctgacgaggacggcctacctgtcgccgctgctgttcgccgccggggaggccgtggcggtcggcggtgcgcagaggctgcacgggatggcacagtgcaccaaggacctctccggcggcgactgcaagatgtgcctggaatccgccattgatcaactgctggcgaggggttgcgccaaggagggaggcaaagtgttgggtggaagctgcagcttgagatacgacttctactccttgtctgattcctaggctaatttggattttgcaattttaaacttgtaattaaggtgaccacattgtgcatagagattcccatgtaatcacatactactactactactagtactcctacaagaaagagctctgctcataaatagagcagaatattgtctttcaattttgacaattttcaattttctttggacactaacatcgtgaaatgtgagcatcatcgatcgtcatgaatatgtgatttgaatcaaatttgaatcctttggcccggcagtaatttgcaaagagttcaaacagcgacgcgctacaacgaggcaacttggtaacttggcatggtacaaatttgattcgagattcatgactcataggattgagattttacgggagtttggcaacgcgcaggaccaagtacggatgaaccaagtgcgatgggcgacacattcaacaagatgaattcaatgtcctgcaataagcacggctgaccttttggataactaaatacttttgctgttttcaagtcaaaactcttgacaagatcctaaggacaacatgacttcccgcgtgttttcttgtcatgttggaacgaattctatctccagtcacagaatatgtgatgttttggacaacggcgtgatcactatgacactagctcaataaattgtactacatcgggtataaaccgcatcgtgtttcgttttgcactaggtttagcatatactttcactttacaccaggttatcttgaaataagtttcacttaagttcttaacaccaggatacatcatcaaacctataaaactatcatgaaatttcacagaatctgaaataaacattgtgaaacatggtatacattcaagaagtttcatatatttttcttcagttatagcttagtgaacatagatgttctaacccaacaaatcacatacacatgcattatattccctacgtgttctagagtacgataacatcgacttttaaatatacatttaaccatttatcttgttaaaaaaaatatgttattgccatttattttgttctgatttttttaatcattaaataatttaagcatgacttatgcttttaatatttgcaaaaaaatatgagacaaatggtagttcaaaaattaacgacattatccgtcaaaaaccagagggattatactaaatacaaagatatttagacagcattttggtgtacatgtttacgccatgaccgtgtgagtctagtgtttcgtgggttttatgcatcccattatacttttaaaatgtaataccattttatttttattctccataatttcctgaccgagagaaagagagaagaaaaaaaatgtgttgtttagatgtctgcacaatataccactatactacataaatgatcttttcatgccgacaaaaactaattttcacaggcgagtgagcactcgcctggagcgccaggtgtctgcaaaaatcggcattttgcatgcgggcaacacaattgcatgcataaaatcattttcgcggacagatgacctaagaaagccgcttgcaaagacccgatttttgcatgcgggcaaataaggatgcttgattgcaatgatttaaaaaataaaaaaagaaaaaaaaatccaaaacccaaacccttggtcgccgccgttgtgtgccgcgctacagcccttgcccccgctgcctgcggttgtggttgccgctcgcgatgtcgtgccgcccttccgcctcctccgtgcagcacgcgaggacggatccgccctcttccaagcactcacatcgccgtcgtggtcgtggtcgccactcctggtgttgcgccacccttccgcctcctctccacatgtgcaagggcggatccaccactctcgagcactccggcagcgaatccaccattcctaagcttgtcgacggtgggttgtccgctctcgatttagcccgcacgtacccgcaagttcgtggttgccgttcctggtgccacaccacccttccacctcctctccgccacgtgtgagggtggatccgccgctcctgagcccacacgcagccgctgtggtcctggtctccgcttccagtgcggcgctgcccttccgcctcctttccaccggacgcgaggacgtatccgccgctcccgaggttgctggcaatggatccaccgttcctaagcccgccggtggtggatccgccactctcgagcccgcacgtagctacggtgatcttggtcgctgctcccggtgcaaggccgccctttcgcctcctctccaccaagccccgagggtggatccatcgctctcgagcccgctggtggtggatctgcccttccgaagcctaccaatggccggtggatctgctactcccgagttcgccgacggcaaatccacccttcccgaggactgtcgtcgccagattcgccgcgcctgttgaccgccactagaagagccgatcgtcgcatccacctcagccgctgtgtaggagaggagaaggggggagcgaaggggaagatatgaggagagggagtgggagaggagtgatgggaggtggagcagatggggaggcagcggacgatggagaggaggagaagagaaaaaaaggaggcacattgagtgagaagggggatgaggagaaaaaaggtgcgggagaaaaaagagtagtgcgtggccagtgcgaggacacgtggagatagcccacttgctctccacgttgcctgcttgcgaaaatctatttttgtaggcccccttaagaggcccacatgcgataattggtgtattattgcattggacctcttaagaggtcgccttcaaaaatagattttcgtatgcaacccttgaactgcgtttgggaagcgatttttgcatgttgggtagttatgatccgcctgcaacttgaaagtgtctcgcctgtaaaatttgattttgtagtgtacaacacattccgtggtaggtagtttgttggtcaaaagaagattttgttaagtaaactcaagtacgcgctaatcaaccacagtattatacttatttctaagtgttcaattaagtcaagctatgatactaaatacaggtagccctgaatagttaagaaactagttgcactacaacttgtgtggcgttgataaaatatactactcgctagaaacaggagtctattgagctgtttcaggcttgcaacaaactcacagaatttcatacaatttaaatcacacatcaatgattctatgataatgatcgctagtatacatgaacccccataggtgccagttagaaaccggcaataggtgtcaggttcttaccctatgaccaacacctatagtattaagtgaaataacaaaaaagagcctaagaagccgtcattgccggatccggcagctgacggcgaggcgcatggcgaggccagggaagagctcggtgaggggaggagtgcgacggccttcacctccacctcctacccagccaacggcctccaccttgccctccgagccggccttctccaccgccaccgtcgtcgccagatctggaggaggagaagggaggaggtgaacagagaggagggccaccaggagagaggggggagcctccttttccacctccatcttcttcctagtcaccggccaccacctcgtgctctgcgccagcctttgctgctacctccgccaccaaatcgggaggaggaggaggagaagggagggccaccggaaaaaagtacgaattacccccctgaactatcgcggtcgaccgaattaccccccccaaacccgagaaccagagatcgttcaataccggacaaattagcccctcgactcaatctagagcgatcttatcctacgtagcgtatgcttgacaatccagtcagcattttctttttttaatggtagggcccacctgtcatatatactctctcacctcctctttccccttccactccgtcggtctctctctctctctccccctctctctcgggccgccggtctctctctcccccctctttttaggccatctggcataggtcgagcggcggcgggaggtcgacgtgcatggcggcgtgcaggggcgggtggtgggcggtggtggcaagtcaaaatggccgtgtctctctttgtcctcggcttctccctctgtgtgtcatctcctggctccgaattgtgggcggcgacgacgagcgtggcggtggcggcggcgttcatggtgacgttctcgttggggttcgggtcgtctagcgcaggtcgagcagcggtggacggtcggcgcccacggcattgcgcgggggcgggtgatgggcggcagcgtgggaggcgcaccgcgggccacggatgccagcgaggaggctgtggggctgtggcgtcacggactcacggagagggcgcgggaggcggcgggctgcggcgaggagggcgcaccctcgccggtgcatcctccaacctcattcgccccctcctggcggcagctggatgccgtccacctcatccgcctgtcctcttctttggaggccgccggtcaggatctgccgcctcctccttgctcggctctcctgacggcgccatagagagagagagaacgagggggagagagagacgcctaccatctccaatgtccttagcgccgcccgctactcgtctcgccctccccaccgggctcgccgctagcctgaggagagagagagagagggatgatgatgatgacgtagctggcctcctccaacaccctcctcagcgccgcacaccgtgccattcccgtgctctgccgccgccccccacacgccgaccgcccgtccgcacgtcgctgccgccgcccactgcccgtccacgcgcgcccgagagagagaagggggaaggggaagaggggagaggggtaatgacaggtgggccctattttttcttttatttctttttgctaattggatttccacgtcgacgccatgtgtatggcacgtaggagaaaaaccgctcaggattgagtcagtggggtaatttgtccggtatcaatagttcgaggtttaatatgtgtggttttgtggttcagggggtaattcgtactgtcgcaatagttcagagggataattcatacttttcctatggtaaatggcaggataatttgtctttagtactccctgctatctcataatataaagcatagttaaatttatcatggtcttcaagtaaaactaatttttagctttaattctcatatgctatatgaaagtaaattcaaacgttaatctaagggcatgtttggcacagctccaactccagttctccaactctcttggactgatgctcagccaaacagtttcagttacagctaaaatgggagctgcactaggtgaagatctctcacaaaataagctagagagttggagctggatttaggctactccacaactctactccagacccaactcctggagctaaatttaggagttggaactataccaaacttgccctaataatactatattacatcggtacagctagaaatacatgcaaatccattcaaaatttcagctctgcgttaaataggttgcacttttaattatttatgagaaaaggaacatgtcattggtacaaaaatatttactaggtaagtattgcctttgttttatattatatgtcactttattttttctagtaaaactcttttaaatttaacctaatctataggaaaatataataatatttttaacacaaaataaacatattattaaaaatatattcaatgttatatttaataaaactaatttagcgatgtagatgtatcatattagacagagggagtactacatacacaaattaattctttataaatttaatatatcaccaagctggtatatatcaccgggttaaatgtgatactgtttgttcacctatatcaaattttattcacatgagcatgatgtactttgatgtacctgcaaatgacatttgcagatgaaattttccactgatatatccctaaaccgagattcagaggatgcctttgttttttggcaagaggtgaacgacatatacaaattaattatggctgtgtttagttaaacacaaaatttagattttagttaaaattagagatgatgtgattgaaaagttatgtgtgtataacagattgatgtgatagaaaatgactgaagtttggatctttggatctaaacacagcctatgtattttgatggtctgacttggatagacaaatgggttgatcgagcaacctaatcagcttattttttagtgccagaacaattaataaactggatgaccataattgaccgatcgataccaattttaaaatgagaagttcattacgtgtgccatacgtatacggtaagtatactatgtgtgtgcgctgcagtatatgcgtgctacgtgcagttctgctgttcactcggtggcgtgacgtgggctgcggcgagggcaaaattgagaacacaacctgtaccattcaagtattcaacctaccaagacacaaccctatatagcagcttcacgggttaggaacatattgatgctcattagcgacatgatgaaacacatccgcactggagctatgcgtacacgcgtgcaagttttcaaaaagcgattggcatggaaaagaaaacattggaggaaagaaagaacaatgtttaatcctataaaaaagagtgatttgtccctaaaagacctcgtgcataattgagaactcatggaagtttaaatggaataacttgctgatacaaaattctcacaataaacgtactattggaaccatttgagaactaatcaatacttcaagtttgcaccctttttaacaggaattagagattatacagctatcattcttcacattaatttggtggggtgatcaaaaaataagattgtctcttggcatacagttaaggctactgaagaatatgcaatgatgtttataaatatgatgcatacaatatgtctgcccttactatgatccttggaatataccaggttcaacttcctggagatgttagatatggagcagtaatatttttgcatttttgcagctttttttacaaataactgcaaacttttgagcgtcctgtagcgaatttttcaaaacattataaagatcaagggaaaggtcacccttacacatcacgataaggggtctgctccatcaagtagactgcaggtgaaatcattgtttaccagaactattttctctgcctccttgataacagcgtctagttgaagaggtgcaaaactccgaccagggccatagaaatgaggaaaatagtttgaatcatcagctgcctcataaactaagccatctgaaagctacaacaaacaagaagagaaaatgctatgaatgtgaagtggcacaacgaacagatgaattctactgaaatacaaacaggcatgggcttgctacttgcctagttaccagggcaaaatacatgtatagtttttgttcatgaatagagataaaaaaaaacctggtgcgttctgaagtatccatctattatattattaaaacaactttgaaagaagacaccacgttcgctgtgggggctagaaatttccacattaatcggagaaaaagaaaagaagagtccaactagaaatacaattttaaaatagctgaaattcgaaattaaaaataagcaatattgaaacaagaggccctataagaacccaatacgagattaatcaaaattaaaaataaaaaaataaaatccaaaattagcaaaaaaaaaaaggaaaagaagagttcgagtagaaatacaatttaaaaataactaaaattcggaattaaaattaagcaatattaaaagaagagaccatataaaatcccaatacgagattataaaaattcagaataaaaaaaataaaaaaaatcaaaattagagtggtggcggttgatgtgacatctaaaaaactattaataaaacaccaaatgtaatcctaatgacgattaataggagggataacgcgtaggccgtgaagtaacaggtcaaggcggtcggcgggacttcttagagagtaaaaaagcataatgatataataatattcaatttttaaaatctcaatggcaataaaaagaagaggcggcgggcgggttgtacaagagtacaatggcagagccgtcgacggttggtgggacttctagaaagtaaaaaatgaattccaatgatagttatgttcaaattttacaatcccaatgacaacaaagagtaagcggcagacgagtcgtagagtagtatagtggcagtgtttgacaggacttctaaaagttataaaaaatgaaacccaacgagacaataaactttaaaaactacgaggtccaatttttaaaggttcaggacttctaaaaggtaaaagaataatcatgtttgattttaaaatcgcaatagcaataaagaagggagacagtgggtgagccgtagaggagtacagtggcaaagtcacttatggtttggtgggacttctagaaagtaaaaactgaacccaatcgataattacattcgacttttaaaatcccaatgacaataaacagaagaagcagtggatgagctgtagaggagtataatggcagcgtttgatgggacttctaaaaattataaaaacgaaacccaacgagacaataaactctaaaaactatacgatccaatttgtaaaggttctaaggagaatgaatagaaaaagtggtagatcgagttagcaaataaaaaaaagaaatgacaaaagaaagttgtagcaattggtatgacttttaaaaactataaaattaaaaacacagggataataaagtttggtctttcaaagtcttaagtcttaagacaacaagatagttatctaataagttttaagtaaaatcatattaaaaaaatatataattttatatgggtgctagccgcgcaactagtttaatttaaaatgatctattatgtgactacatccaatggagtttaaatacactgacacacgttaccttggaagtgtcaacttgtagtaggtatagatcattccttcctaggaaaaagttcttaagcgttttcctcacctaaaacaggttgagaatgagttctaaagaatacatatacagtgccaaaaaggaatggttggaggtcatatataaacaacgcccagatcaaattacaagacaaatatattattcagtgtatcacgaaaagtatataaattgaagtacttatatgcaatagtagtaacatacttttgcacaaaattgttttgtagaacttgagtgtaccaaacaataggtgtcacagtttagaaatgtatatgggattgttgagtaagcaaaaccatttccatatatcatatatgaaaacacagccaaagaacgcaatatgaatagcaggccctttcttaataggccacaatttctgaaatttaacatcctgatataatgagatgccatgttttcttttcgctagcatttacctacaacctgtttgcataaactacaaatgggcaccaatttgcatgtctgtcaaagcaatcaagggaaatagtatgtccttctaaagccaaacagaacgacttccgcacattatctattatattattaaaggaatagaaaaagaagcatccacgttcgctctcatggcctagaaattctcactttaatcggagaaaaagaaaaagtagagtccatatagaaatagaatgtagaaatagctgaaattcggaattaaaaaataaggaatattagaacatgagactaaagtccatatagaaatacaatttagaaatagttgaaattcggaattaaaaaataaggaatattagaagaggagactagagtccatgtagaaatacaattaggaaataactgaaattcggaattaaaaataaggaatattagaagtagagtatagagtccatacagaaataaaattaggaaataactgaaattcggaattaaaaataaggaatattagaagtagagtatagagtccatacagaaataaaattaggaaataactgaaatttggaattaaaaataaggaatattagaagtagagtatagagtccatatagaaatacaattaggaaataatagaaatatggaattaaaaataaggaatattagaagtagagtatagagtccatatataaatacaattaagaaaaaaatagaaattcagaattaaaaaaataaggaatattagaagtagagtatagagtccatataggaatttaaaactaactaaaatttggaataaacataataaaattaaaagtagagtttagagtccgtataaaaatacaatttacaaataactaaaattagaaattaagaaaacatgggaagaagagtttaaagtcaatataggaatacaatttagaagtaactaaaattcaaaattaaaaattaaagaatattgaaagatgagtttagagtccacatagaaatacaattagaaataataaaaattcagaaataaaaataaataatattggaagaagagcatagagtctatataaaaatacaatttacagaaaattcggaattaaaaaatattaaaagacgagtctagagtccatagaggaatttatataatttacaaataactaaaatttgatattaaaaataactaataactaacacgtatataaaatataatatgaatattatacattagtagttttgtaaagttattgcaaaatttaaattatgttgtaattttaatatatttgaataatataatgggaaaacatatatgctattatatgagagaaaatataatgatgctacccgcgcaatctgcacgggccaccatgctagttatagataatatagattattcttcactgctttgttacggtcactgctcagaaacatcctaagggcaacagcaatgtatcttacctaactaagtaataagtagcagggctaagtagtaggcctttgtaaagtgggtcgcatgagaaaaaaatattgctttttagttgctttttgtccaactcagcatgtagtagtagcacatcttgtgttggaaggagagagtgagagagattttaatgtttttttattcttatgagtgggtcataagcttagtaccgagcattagttactacccacttccacaatgcttattactaagtcataggaatagtatattgcctactacctgcttttttctaacattgtggatgccctaaatgaatcaaaagattccaaaggaaatggcatctaggatggccaattggacacacgcaagaagcaggagatctccacacgaagctctgtaggcaaacaaaagatgaaatcacacatgctgcgagaggcacctctaatagcattactgatttgcgtccaacctccaacctgggttgtaatatttggatggctttatccctaattttaaacagcaattttcagcaaagtagtctagcaccctagatccactgaaaaatcagagaaccaatgactaggcccaaatctccacttgaaatgtgcatatgataaatagagagatccatggggatcccgcgagtcggaagaaatcagacgtccctgctttctaattgggaattacctgactgaggtcgctgaggtggatacagccggtggagcggtcgaggtcaccgccaagggtgccgccggtgcgctgaagctgcgcccactcatccgccgtgctgatacggtatacgaacgcctgcggcgctggtttatccatttcggccgcccgctgacagtgctgagggttgaccatcagatacgtctcctctacgtttctgctccagaggacagaagatttcacttgttcctttttttttaggaagcactattggttctggccagcaataaagaattttatagaagaacggcagtccaagttacacgctacaaattacaaaaccaaatgtatgtaggccatgtttagattcactttaaaatttttcaccatgtcacatcgaatatttagatacatgtatagagtattaaatatagaaaaaaatagataaataattacacagattgcgtgtaaattatgagacgaattttttaaacctaattagtccatgatttgataatgtgatgctacagtaaatatttgctaataacagattaattaggcttaataaattcgtttctcagtttacaggcgaaatctgtaatttattttattattagtctacgtttaatacttcaaatgtgtgtccgtatatccgatatgacacgccaaaacttttcacccttggatctaacatagccataacctatctaaatttatttttgggtgtgttagtcccggcaaaatttaaaggttgggtggaaatgggacgaagggccgaaagttggaaatttgtgtgtgtagaaaaagtttggatgtgataaaaaaatggaaagtttgaaaaaaaagttggaaactaaacaagggcttccttgactcgttgtatattctgtaaatatgcaagagaattccattctatttacaccggcccatgaagaagccggcctaattagtaagatcaaataaaatgttgttacaaagttcaataggaaagttactgaaaagaaaatctaaaagtcacactgcttagaaccattaggaggagtgagtggcggaagctggattaaaaataagatttaacgaaaatgtttgtttcataaggccaactaagcacaacaaataccatatctatactataatcgcataaaaatatagtataattacagacaaaaccattttaaaataaagtaatattttttgcgccatacataattcatcatacaccaaaaattttataaaacatggtcgatagatatctttaatatatatatatatatgtatgtatgtatgtatgtatgtgcgtgaccacaccatgtccttatccctgttcctctatgtccatagaccatagcagcaggacgaaatcgattaggcgctagccgctaggcagctagccaccacaaatgacgatgtcctgcacgtgtctgcacgtgttgcttgcgcttggccctggcggctggcctgtcgggcgctaggctgctagctgctgcagtgttgcactgctgcggactgttggccgcacggcagcatggccgcacggggatggccggccggccggactagacggtggtggggctagcacggccggactgcgacagtgacagcatcgcattgtcagcttagcaccaagcaggaggagagaaggcgaggagcgagctattggctgcgaggagccagccgtcgctcaacgccggcaggccgtggctaggtgtcgcgtgcaccgtgcggtgcggagagttgtcgtaggctctcttgacctcccattatatagatgaagtgaataatttatatcatcaaataaatataatgaaacattcgacgtctcgagagaagaatattggaggcattgctgggtctttagcctgccagtcaacttcagcctgagatgtgcccgtcaaactactcgaaggcagcgaccagatgtgttacacatttaggagactggacaaaaaggctaaagatctatatcatctcaaacattcttaactcatactcatgtgaatttagttctcaggatgtgcactagattcacactttcatcttaagtatggacatacatagcaaacacatttcagatgaaagcgattaaaatttacaactactttagagatacataggccgatcggccaaatagatgtatgagggaacatcggaagcttgtctacccaatccccaagcacaccgactagacgtttaccccattaagtttaagtcctagaagaagcaatcgattacccgcatcactcaaaagactaagtttacaacctgcaagcaaaaggttaatccaatagcaagagtcagtacattattagaataatgtactggcaagcaccaagacaaaactaacaccctacttgcaaggcatataatcaaggaaggcataatatggatttttttagcataaagcaagttttatttgcataaaacacattcaaatcagatttgctttcaaataaatttcagcaagctagtacttagcatatgggcatcaaagtagacattaatcatgtataaatatacacctcattgccatccacggcagcaaggagatcattctcaaatctcatcataatttgaagataaaattcagcatttagaagaataaacacaagtctatactcaatacatatccacacaccgctcataaccgcgagcacggctaattgattagttttaactctgaagagtttgtacactttacccacatgatgcgaaataataatcatgcaagagcatggcacgcgatacataagtacccgatttattacccgcatcaacgtttttccaaaattcatgatttagccttacaccagcacgatatgtgttactccatcctaagccatacacgttatataacctagaaccgttaagtggcgggcccacgccttaaacttaacactgtggtggcggacacaacgggaacccaccacgtggcacaataccattgtattggacacgcttagtcacctaaactaccacatcggggtaaataggaagctcctttgaattattcgaactcatatacaccggcctaccagaatgtaaggctaaaccataaataatttactaatcttgggctatcccatactagcacatgtggttatactgtatacgaaatgaactgacattgagtgaagtccttaggtcggtttaggcgcactctccccctatcggtacacaactaatcaccatatgtgcaccacttaaggcccaaacctagaatctatgttttccatcattttatttatcaaaatcacaagtattaaaattctgtccagattatttcaaaatcaattttcatatttgtaatgagcccataatgacaaggaagatcattctaagcatggctaagcattatagtaacctagtgacatcaaaactcatatataaagtgttataattatattattcctaaggttaggaatggggatatggatatacgtggggttaaggtgataatgcaagtagtagaagtttgtctaacaagtttaacaaaattataatttattagtgtacaatcgacatgcaagatttgcaaacattttcaataacctctaaaacataggttcaaagtgatcaaagagagagggaggtgggacttgccttgtaacttggaaaaagttagcaccaaaatcacttcttcaccgtttaagcaatcatctatacaaagtacacgttatgtaattaaacaccgaattatgcgaaaaatccaaaatgctctaaaatgcatgatttgtgcacagtggataggtactggtctaagatgaatttaggtgaaagaattcctattttatctctttttatttgggagttatgaaatttagaagtttactcggtataatataggatttacttaggtactattctgaatttgttgtaaggtgattcttattaagtttatatttgctgaggtgaagatctgtatttttaagactaacacatttagtttcataacttttggagttaatatgaattctttatgtattttacaagttataacgtattgtaggcgtatagtgttctatatgcacatgcctttgatatttgaagtccaaaacttattctactttaattgtgatgaatgaagcaaataattttgttaactaatctatccctagttcacaagtttaggacttttattattttagttcatatttttataaacaagaggaattaatatatgattaaagtgtactaagttttggtggaagggatggatctatgccttcattggttcaacaagttttatttgggtttcattatagctagagtgtgtttctatatgcatttatatatatgtattgcttaatcaatactatgtgattagaacctatcctataaatttaaagtttagagttgaaacctgtacagaaggtgccatattttactctactatgttaaattatattacttgctggttctatagaaatttggttcactccatttggactaaagatgaattttctacaaattttacaaattaaaggttgctctatattggttattacttacataaatatttagaggcttttatcatacagtaagtatatacttttattttacaacttggaagtatatgttttggttattctacagaacttgggtttactcaaaaaggatctaagatgaattttatatgaatttctaaagttcagcttatataaaactagttattttaaaggtaatagttttagaggcatttgatgcaaagcaagtatacctttttattttattctacaggagagcataagtttgtgattctgtggaatttgagtttatcccaaaataggttgaagtcaattttccatatatttttataagtttgtgcatgctttatgtgtgatttaacttagatgaattttagaggtgaaatttgtactgtgagtgaaagtttttatttcataactttaaatttcataatctagtgagttcacagaaatttgaatcatctcaaaataatctatatttgattttatatggattttacaagttctaggtatttctcttgtatattctccgattttatctccaggggtccactgtcagtctcttactgttttgcagaaaggtccctagtttttccataaatgaactcgcagtactaggccccacatgtaagtctctagtgctttacgctttaaaccctaagcttttagtttactacaagacagggtccttgtcttcaacctccagccgccgatgtacagggaggagtggtcgtgagcttggcgagcttgccggcggcgataggtggctcggatgacgttggggtaaaaatagaaaatttagatgagttctttgcaaagccaatggtggtcttgttacaagccatagtggacagaatagatggtggcgatggtggaaacagcggcatgtctcgggttgcttgtgcatgtcgagttctagagcaatgtgatgtgagatagtgcatgcatgtggtcttaaggtactcaagggtgctcaccgaagcttgaaaatggcttacagaggcccgacgggatcttgacgatggacggacatgacggcagcggcaagaacctccgaggtaacggcgtcggttcaatctacttgaagagtggccatgctgttgacgtttttttatcaacatatgatcacctaacgatttgcggtgtaaataatagagtcctcaaaatcgatagatcggctaatgaaaccgatttcgagattaattcacttccgcggaatcacacgactaatttacaagcaaattagaaaaatgataaatatcataattacgtgacgacaaacgattagtttctgggcaaactagcaaagataactgtggtgaaaccatgtgtcttttagggacttaagcacatctgttaaagcagtgtgcgtgtggtgtatgcccaataatttggaagtttctttattcacaacagcaagctcttctttatagctgttatgctatgtgaattttcaaagatattgtcaactttaggttgcacgcatcatattctgcaaagcagtcggtatatcatctggatcatattattcggggattcacaccgcatatgctatatattggtatcaagtcacttggttgactataattatcaaaaaccactcagttggttggattatttattccttaactatatgcttggtttgttcaattaaccacatagtcgggagctacacctatttggtgcatctagtcgatgcacctgactttatttttcagccctccacagtcttcagatttggtaaaagtactcgggagaccatgacgaagatgattgaagcactcggctttggagtaatctgatttgagagaagattatcttttcgactgcgaaggtttcaggggctactatggagattatgggtaccccatacccacacggcgtggttatccgactggttataggggataacttatatctatgaaatatgtaacggatcataacttggatattacgtttccctgtatattatggaacggcctaaagtcctggtttgataagattgtaaagtagatttaggaaaccgataccgtattggttaaggtttctatcttgtaatcctgcccccatcctatataaggtgggcaggaggccctctaggcggcatgagacaactagatcgtcagatctataatacacccggcggacttaaatccccaaacaggagtagggtattacctctcattgagagggcctgaacctgtctaaatccttgtctccgcatccatccacttttaggtctcgtgcgctatccccttttcatattgccgaaaatttctttcgacaataacctcctcgctttcgtggagaagcacgaccgtttttcagcacaaaatggcaaaggttaaccaaatcctaggattgctagaatccagctatgaaaacaaaatagaaaataacggaaaagtaaagaatgagaaaaatagtagattgatagattgttgggggttctcccgttctactgttaccgatatactccctccgtttcgaaatgtttggcgccgttgactttttagcacatgtttgaccgttcgtcttattcaaaaaatttaagtaattattaattcttttcctatcatttgattcattgttaaatatatttttatgtaggcatataattttacatatttcacaaaagtttttaaataagatgaacagtcaaacatatgctaaaaagtcaacggtgtcaaacatttcgaaacggagggagtatataccggcaaaatgataatggtcccacacaaaataaacaaggaaataaactaataaaaatccattcttatctttaccgctgaacgcgctaactcaccggttcccatgatcccatctcctgccaaccgacgccaaaactccatatcgcacgcgggacgcagcggcacccaaatttgtctcggtcagcaacacgaactcctcaaggatctgcaaatttgcatgca

SEQ ID NO: 67378 - DNA, 3655 bp, Oryza sativa
gattggaggttagatagcaagatgatcagagattatataagagatatgatagctgggcgacttaggtaggcaagattagagtatcataatgatggaagcactaatcccgagaacgcaagccgccataacaagtcatacctctagttgaagatcgagaccgatgcaactcaacccgaaagcaagaattcgtcgaaacaaaacgaaagtaaaagggtggcgatgcgccgagattgtatttgaacacgtgttatctaattacatggggttcggggtctatttatacccgagattacaaaatatgtccttgtcggacacgactcttatctctaacaaactctaagatccaagctttaataacatattttaacttactactacagatccaggcttcagtgacgggtcatctgtgacgggccaacgcaactcgtcaaagatgagtcatctctgacgggccgaaaaaatatcctcttcaatatatggctactagggaggacccgtcacagatgtgaggtcatctgtgacgacttgcacttgtaacccgtcacagatggctctttaactaaaaagagaccactcatctctgatgggtcattaactaacacacgtcacaggtaacgttatgtctgacgggtggtagttatgacccgtcagtgatgagtgaaaattcaaatttttaaattttgcaaaaaacctcggattgagacatgtcctatataaaagtaaagttgtagctctcgatgatatccacaactttataactaataacatttctattagagatcgtttacatccccgaagatgcattacaagtgatgagatctacttttaaaaacaaaattttgagttttttttcaaatgacatggatggatacatgccccatatcaaagtcatagaactcaaccagatctacaacattaataattgaaaatattttcatttgacaaagtttacatgttcaaaatacatgttataaagtgagatctattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaaacatagacaaaataataacattgggtgagtaatcaatatgtgctgagtaggtgagttggtaaggaagctctctatggtggttgaggtcttaagtttgaatctcacgtttagcatgcaagttatattgcgtgaaaaattgtgaatttgtaggtagtgatgtgtaactatgtataggatggctagtaaaattcaaaatatttttttgaggttttttttgttgcgtttaaaatttaaaaattgtatttcttgctttgtcatcagtgacgggtcgtaagtttcaacccgtcagagattagtcgtcagtgatggtcaggtagttatgacacgtcactgatgacttatctgtgacgggtgacaagttgttagacccgtcagagatgacttatataccggtcagagatgagttatctgtgacgggtgtttcacccgtcacaggtgattttgtcatcagtgaccactaatcactgaccaaggccaaacccatcaaaggtgagggtttgggcccgtcagagatgacctggtccggcgtagtatcaaactatttcatgtatattatatcatcaacaactacaaaatcagtatcacatgaaagtattttaaaacacaaatctaatgatataacctatataatacttggcgtagatattattagtgtacttattagtcaatagatacattttcaaaaaataagagcggagagagtatataagtaacttataagtgtactggagatacaacgaagaagcatctgtaaagttgtataccatttacaacgttttgcaaatgacactggtacaaaaatgtttcttgcggactgtccaaaaggggtttttgcgtgcggtatggctagctgcatgcacaaaacactaccacagaaagggctttcggtgccggttggcaaaccccgttaggaaccggcacctttgaggtatacgatttacaaaaaaaaaatccggctcgccgagccgatgcttcaaagcaccaaaaataaatccaaaaaaaagagaaaataatccacaatcagacaatcaacaattaagttcatgggtcaaatgttcatgtaattttcacatcagacactcaacaacaagttcatgcatcaaatgttcatcaaattttcacatcattgaatcaaacatcataaatgttcagacaatcaacagcaagtcagcacaggttctcaccggaggtggaagcaacaggacaccatcgggcaccgtaggcgaggggaggcggacagagatgccgccggatccgaagccccccaacatcgccgccaccgccgccaccgctgctgcctcccctcccgccggatctggcggaggggagggcgccaccgctgccaccgtcgccccaaggatccgccgccaccgggccaccaccaggccaccaccgcctctcctcccaccgtcaggcctccagagttggcagagggagggcgctcccaccgtctgccaccgcctcctaccctcccgccatctgccgctgttgcacctccatgccatccgccgccaccacgcctcccctcccgcccctgccggatttggcggaggggagggcgccgccatacctcccgcctctgccgggccggtaccgccgtcgtcgccgggctgcggctccacatagagagggagggaaagcgagagaggagcagtggagaaaagatcgagagaaatggagaaagctggccttatctcctctgagtgtgggccccgccgggagaagaaatatctcctccggctcggctcggctcgataataaatgtgtcggttttttaaaaaaccggcacctataaagttgtcagtttttactgaaaaactaacatggtgttgttttcttttacagaaccgacacctattatcacttaaatgtgccggtttttattattttcggaccatggaggtagcaaaggcctataggtgccggttttagcacttccggcacctataatgcagacacctatttgatgagtagtagtgaaatggtctgtgaaaattgctatttttgcatacgggtggcacacccgtatacgaaaatcggattttcgcgcacgtgaaaatggaaaatcgcaaaaaaaaattccaaaacacaaagacctaaccctagccggttgccgccaccatcgtcgctggcggatctgcctctcccgtctccactgtcggcggttccgtaccaaccatcatcgccagccgcgaatccgcgcgcgtggaggccgaatccacactgtcgctgacgtccgcgcatgttgcggagcccgtgcctaccgccatcatgctgcctgctgccggatccgcgttggaatgggaggctagggagagccgccgttggcctcccactcgagcctattgccggatccacgtgggggaggcccaaggggctaccattgtagctgtcgctcacgcccttcatcgccgcaatcgccggatctgccgccctcacggtcaccgcagtcgccgccctccttcgcagcaggcactcctgaaggtgccgccactgaatctgtgcgggggt

SEQ ID NO: 67379 - DNA, 22146 bp, Oryza sativa
aggggtatttttgcatgctggtgagttaagagccccgcatgcaaaaatacacccttattttcgcgtacggacgctttaagtggtctgtttggcaaaaattgaattttgtgtgcgggtctctgagccgtatgtgaaaatgggagttgatttttacagacacaaacatttatggaaacctattagagtatttgtccagaaaaatcatttttgcactagtgtgattattttaagggcgtatagatagtttacagcggcattaacactactacaggacatggctgttgtaacacagctatgtgctactacatacccaaaaaggtgttactgaggtccgcagtaacacaaaatataagtgatgcaactgcctatgttacgggcatatagtctagtagcacatatttagtgttccaacctataaaaaagggtgttacaacaaagcctagtagcacataactaagtgttccaacaaagtagaaaaaggtgttacaaccatatcgtagtcgcacatattagatgttacaaggcatatactagtaactgttgacggttgttatcgatcagtttcgaccatcaatattgccaaaatagaggagaactagtgatgcttgcaatgcataattacgttagaataataatattccactagtattaggtatactaacattttgcagagaatgacaataaagtgaaggagaatcgacatcaacacagacgataaatcaatcgcacgatgtcgacaatcagacttatgtatgaatgggccaagaactcagaattgacacgatgaattgggacaaaattcacaagtctgcaaagtggagcaatagaggaggccaccagccgaaattgggctagattgggccagccccaggttcggcccaacctggtggttcggccgaaccaatccttgcgccgttggatccaggttttggcgtggacgtccaggattgcatcccaatgacagttggatggcacttcggacaattccccttccacaaccgtcataactacctctatataaggagctcactctcttcacttcaacacacacctcaagcaatagctctctcatttctctcaagcttagtttagtagtatctagctagtggaataggaatagagtagaaatcaggagtccgaaagtcttcggaagagttcgggtatgactctagcagcttttctcttctcttttgtaagccttgtacttttattagaatactcttctaaatacatttatggtattgaaatactttccgagtatatgagtacctactttatattatgttcttgttatactgaatatacggctagcttatctaggagatgctttggtgcgggtataatgtttgcttatgcaattactctatgtcatgacgatgatattagagtagtatctggtagtttagacgtggtgtctagattacgggatatcattatttggggttatatattgcggatgagaggtgggccgctgatggtgacagctcagtacaggtattcctccgcgcctatatataatcctaagttaatttcctggggagggtattcctccgtatttagcccggttgtgtggttatgatgggctgtcgtaaggaactcagcagtcaggggtggcttctcgaagtaccagaagggcatcggaaagagggtattagctagtatatcagttaactaagatgtatgtatactatgtatattagaagtataggaatagattatcttcctcttttctttccacttagcttagataatatattatgaaaatgagtagttaatgcttgtgtgtcactctacccttggattatcttaactcctacttagaatatgattattacaagcaacatataaattattagtcaagtcctctctacatgatcttcccacgggataaaataaatacaatacccttggaatactctcgggtgaaatgctataatggtatatccgtgcgcttgcggataaactctgtaactataatataccaaaagtatttatgcgccattgctgggaattatatttctagtaatgtcgttaagaaataccaacagtaacaccattttttaacctcaggttgcactttggaacaccttgctataggtcccggtaacacatatcttggccactagtaacacatcaaatgcacagtacagcaaaacaataatgatttgattaccaataatgctctaattagctttttttttacattgttgccttttaattttcaggaatgtgccaaaatatttcaaaatatcctttataggcatcacatatctcaaataacacaaatcaacatggcaatttgaattgcatacgaagcaaatgttattttcatcaatccacatatcaacaataagtacaatttctaaacgattttacaaagtgtgtctatttctatattcttcataaaattatttgctgcttgatccattgttgcacctgaacgtgcatctttgctcttaagttccaactgagtatcaacttgtatgtgtaatgtgtacaataaactgtacctgcagttgatcatgatgaaaatatccctgttaagcccataaaatttacattgaattgtacatatgaaagatcaaacacggattacgccacaaaatgagttaagcgagaacggaagtatctaagacataacagttgccaatcaagctaatcattattaagtaataagaagtaaacctgtttgtaactgtgacagataatttggatagatgccatattaacatcaatatctgaaatatgtttgacaaacttaaaacttcatgttattctacttttattgaatcttacatggataagcaattaagtttgacatgtccggcaattcacaaattttgagactgcggaagtaaatgaatagaacagtgccttgtgagatctcctaaataatcacacagaattggagttcaatgcttttatttctaaaaatttggcagcacaaatattgtgatggatgagaaatgctattgttgctttgaaaaaattaaagcatgcagtccaatggataaaaggacggtgcatacagttctgcgcataaggaaaatgaatctaacacagataatacaatgaaaacttgcattggataagaatactattatgtgatttcagcaacaagaccagtatttatcttggaataagaatcaccaattgtttatccacaatgaactaataaagcatactattttttctatatgagaaatttcaacacaatatatatactgatctagtccaataatgtatgaaaaaaatcaaataaaaactttccaatgattagtatataaagatacaactcaaagttgatgcatatttttctatatatcacatttgcataaatttgcatgaagataaaattttctactttttttcggtttacctgaacctctgaacttgaatgctgaagaaatccttctaagttacaaacaaagaatactagattccttcaactacaatcccttttctgttccttgaactacaatcccttttctgttagaaacaatatacaaccatagatcatggaaataattagaagtgaagcaaatactaccataccagagaaaagttctgaaaagctatcaccattgccaattctgattgcactatgtatctaccataactataccaacttcagaaaatctcagtttttccaacagtatggatatttcaatcagaggatgcatgcagcaggctattttaagcatatattatagcccgttataagcatatattagcatgtatagcccattattgcttaccatatcatagtttcctcctgtgacattgagattagtgacaggcgtagccatgagctaatcactactaagcaataataagaagaatatcaaccatggtctgtagtaaatgccatattagcatcgactgctagagaaaaatttgacaaagttcagaatatatgttttattctagtgttattgaaccatagatcagcaatcagctaatgtgccttgtaaaatttcgtaagtagtcaaagacagagctggagttcaatgctcccattgctccaaattttggtgagtgccattgtaaatgttgggatgaataaacaatgatctaatcgctacatataaactttgaaatttcgcttcttgtctacccacttaactagcatatcattatataaactgagctggtattaatctagcaacaaaaaaacaagaaacaaaaacaatgaagaacagacaacttcaccttctgttatagctaggaatatttgtgttccccctttggttgcaaccaaaggccaaatctcgtcatacacaaaacaaaaattgctgagattagtttacgggttggagattagagagagagagagagttgaggtctgaggagtaggggaagagaaggactggtaaaggaacatagctgttgaaccgaggggagcaccgccctggtatctggcctgagggagaagccccacgtactagcacatctggccatcgcaagcggaactagtcaccaactcacctttgagctcgtcgggatgcgtgacgccgccgagcgctgctgtggggaggcgccaatgtgctgccaagatcttcgccatgggggtggagacggtggctgagagctcgatgacctggctacaggccgggagacggcggcgtgggggccggcgggtagcgacgactgggggggaggcggaggagaaaatggccattttgccatgttcaaaacacggtttcgctagaatgccattccgaaaacgtgattcgataaaataccaatatgaagcgtgcgtctaccaccactttgctattttcaccattttattcattttcgaaaagattttctctcctctactaggtgttgagacaaaattgccccttatcaacttagagaacacggtgagagaggagacagagagaaggggcggcgacgccgctattgccggccggcgcgccgcctctccgcatcatgcgcggcaacatcgtgcgcgtccgccgcggcggccttcgcatgctttactcggcgccggcgccaacgctgagaacgggatcgatcatcgacgaggccctctacatgatgaagctccgcaagaacgtcgtcgactcgatgaaggccgacctctgcacccctgtcgatgccgccacccgcgatggtggagcagaggcgaggggctagcgccggcatggtttcggcggcggcgtcgtccatgaggtcgtcgtcatcatggtcgaagtcgaccgcctccacatcggtgtcccggcggagctcctggcgcaccgccagcgtccgcaccaaccttcacctgatcttcgccttcctcaccgacgacctcagcatccgcgaccagctccgcccagcgctcctctacctctaccgcctcggcttccacgacggcctcagcttccttcgacggtgtcctcgtcgcctcactgaccccgccagtgagcctctgttctccacggcgacggcagcaagcaatgctcccacgctctgcctcaggcgccgcgggcctcgcggcgggcggccgcctccgccgcggtgctcccctgccgcaggcgcgctgccgccgccgtcggccgacagcatccgacggctggtgctaacgccggagggtcgggcgaagttggatgcgccgcttcccgaccaccgccgctctgacggcgtcctcgagagagaggaagaggggaagaaggggaaaaagagaggtgagagagtatgaccggtggggcccacgttaggggtattttggtctagggaaagcattccagtgaaaaatgatttcgaaaatacacaaaatggctaaaatggcaaagtggcggtgagcacacgttttatattggtattttagcgaaacgtgtttttgagatggcattctagcgaaaccgcttcttgaacgtggctaaatgtctattttcttgaggcggagggaccagtgtgtataggggaggggagaggatggggtggcggcgttgagcggtctggggagtggggggggagtggggactgggagtgggagggtaagagtccaagagatgagcactttaattagttggctgatgactgatgagattatcctacttgagcagagcccgccaataccaatttcaccagttccaaaatttctctcaccccgccctgtctccaaaatttcgagcttagttgtagatagatttttacaactaaaattctgtttttggaattcctaatttgattttaaggtgaaaatatatttttatttccaatatatatcttaaatggcattgttgcaaatagtagtcactgaagggagtacaagggagaaaaacgagtggcttatcgccttctcggcatggctagggcagctccaccgccgccgacgcggccttcctccgaccgcattcgcttgcctctttccctttcacttgcaaggccgcattcgcttgctgttttcccgttcacctacaaggtcgcctcagcatagacacgacatctgcaaggtcgtgatggctacagtcttcatgggcgacgagaggaacatgagatgggagtcggggagacgctgctaaactcggctgcgagttggcgccattactccctcaccaccgccgacatcctcattgcccatccgtccagtggcccatggcctccattgctcctccaaaagagttccttcgcggcccttgccatcgcctttggacttcggtgcccgacggactacgagctccatcagccatagcaacggatggttggatttgcttcctactacaccactaccataaccaatggggttacaactaaaggtctattttagtttgtgtcgagtatgtgtacgtagtcgattacagtttagggtttggagttatactaggtgttagaaatagagtaagagtcggactctatcctactatctctcttaaacagatgggcaaatctgctgtaactgcacataatgactagattgctcaccaccttcgccagtgccattgatcagggtagataaggagaacatcggtgacgatacacgcctttgatgcaacgagcgtgtgctgcacgggagcacctagtaatgaaaatattagaatgaagcacacggccgacctccaaacatacgtagtttgtcatttagatactaaactaaatgtatttttaggtctacgaacttgtcttcggtgtcatacaggtgcaagcgggctccaaccgctctttgcattgacatggcataccattgttggtttttttattttttagatctttttatttttttcattttattaatagacatttctaaaaaatatttccaaatctgaaccttttgaccacgcgcacacacagctgacctgccacgccagggtaggaggggaggtttttggggggaggggggtttcctcaaggcttagagggatggccgtaggtggcggaggacgcagtgggcggtggacttcggcgggcggtgaggcagcggcgccatcgaagccgcagggatgaaggagggcggtgggccagcgtcggcggcggggcaaagcaagcgtgcgattaggaggcggcggccggtggtggcggatccgatggcagggagccgccggagacggggaagatggcgtggcagggacatctccccatcaccaccttgagaagaaagagaggtgggaaggaggagcggggaggcggaggagcctcgctaggggacctcactggcgctgttgactccttccgaccagccgacgaggcaggcggcagcgcggtggggcagtggtggcggtggattggaatgctcgaggaagcgaggggaacgggagaagaagaggtagggttgagtgcttgcatgaatcttaaagcatatctgatggtccaaaattcgaatgatagaaggtgagattttctgtgacaagatgtgtagcaaatcaaattcattcaatcctcttttatctaagtcctaccactggcgccaaagtcttactccatatggcggtaaatcgaattcttctagtgaatttcccgcgcccaattttttctttggcgccaaatctctgcatatggcgccaaatccatcccagggcgcgcctaatctctcctgaaataactcctcccagcaccaatggtctcttcagccccttctcctcccctgactccctgagagtccatgcaaccatgcccagtttcctccacgcgcttgctctagctggcccttccactgcctgtgtccaccactcccaggcgccaacacccgcttcctatgacagcgtcgagacggagaaggggcagcgcctggcagccaacaggagggcggaggcgggggcgcggcgcggagcgccgccggctgcggagcgcggtcgcgtggagcggtgttgcttcgcagcggccgggcgcgaaagcactggctgcagcagcatggtagctggctatttggcgagcatagcataagcagcagccagcgagaggtaaataggtgagcttgccacaattgaaatctgaacaattagatttggaagttcaatgcatgatctatagaagatcttttttttttttttttttgcagccaagcagcagccagcgtcctgactccagagcaatgtttctcgatttattttggactgggaatggtttgagaatgggttcaacccattttcttgtgtttgttttgaaccgatttggattatctttggtacttgccgagtaggtttgggttttgggagtgattaatttgtttggagtggtttggtagtatgctatacagacaaattgttctgaagtgtgtcgttaaattagtctagaaaactattaggtgatgatttaatttgcctccgttttgtgcatactgtatatgtaaactttgatcatcatacctataggctgatatttatcatgtaagcatttctttcatcttatctaccgcagtcgtgtagacaatttgctgaaaatatttcaaacaatgtgcagcaagacagcaagatggtggatagatattgactagtaaaaactagcccatgaagtatgcaatactatgtcggacaatttgtttatatatacatcagaatcagaacttccttgcattatttattttacttacctgaacccatgaactgaattcctgaaaatgtttttagttacaaatgaagaacactgaggtttgactgaaaaatacaatctcagactcatcagttgtggaattagatcagtgtgttttccaattgatgtttactttggcaatttggtacatttcgatgaaatatgatgtttccattttttttagtgaatagtttggatatatttattcttcttcatactagtcatggatgtctcagtttttattggaaatttggaaactatcctttgcaattcaataggtgcaccatatacgcttcaatacaatttaaagttggtaattcctaacatgtgtatcatacattgttctttggtgcaaaccataagccaactgcaagatatatgttgaaatatttaaaataagataatgaatcactaaatctaaagcttactgattcatactgtgagatttactctgcacaagcttgaattacatgataaatagcttatttgtgatggttcagttgttacttgtgtactctgtttttttcgcacatgattataacacggatgaagaaacaagtattaagtatttaaatgttgactcagaaaaaaagtaggatctcaaatattgccatctatatataaacaattagtacaaaaatcaaagcaaaatatagtttatttccatttatcatgcccataaattgatatttttattttataaggttgaaatatgatactagacgcaaaggacatgtagaagtaattaaaaaaaaggctatgccaccaattagtggttatcatgcaactgtgcgatcctggatccattgtcttggcaacacatcctttgtaacacgtattttgtgctcctacctcacttttctagagctatattttacatcttttgaaaatgtgttacaagcagatgttgtagcacatagtatgtgttcctgtgatattgccgtgtaacacatcctagtatgtgttacagggtttgttacaatatacctgtcctgcagtagtggccaattcgcgtatgctggcttcaccgaggggagagagggagggcatcccaggaggcatttgcttactggtggggctgcctgaagtgcctaggcccagtggaagtgaaagagagggaaatttgagaaagaggtggtgtcccgctttgaaagctgtttggggatttgaccctagggtctcgccgagttgtgttggtgggaaaaaaattgcaaaatttacaatgagtagaggagttcatcataactttattaattactagaaaaaatacatgtgttgtaatgggtgaagatgttttcagtgatacaacaactattaggtgatgggcaatcgcacgggtaaagatcttttcagtgacacaatagctattaggagctgagcaataaataaaaatattagaatcgctatacattgtaatttaaaaaataatgaatatccttcattggttttagacggaagcatatttcttccttacttttcagcttagcctagtctgatacctccctccgcccgtcctgcctctcttcggcccaacccacaagtagagacgcaactcgcatagccaactgtttgtcctcaaccttcaaaaacagtccccgatcttctcatcaaatttggccgaatctcttgttctcctaaaattggttgagggcttttgatccattcgttctcctctttccctttttcataaaatcaggtaaaaaggccggggaagcttgccggtaggccatcaacaatggagcgacaaattgaagctgaattgaaagggaaaatcatggggaaaatactaaggaataagtggggaatcaatttttgcaatcaattttaggaggaaacatgtgggaaggtagatcgacgttgtgatgatgctagggtttggcctgggcagcggctagaggtgctgcgcgtgtgcaactgattggatactactaagatagattggatactactgagattggacaaaagaaccggcaaccaaagaaagggatggataaaaaaactcgcacaaaaaaattccacgtgcaaaaaaatacaaatctgacaaaaaaatcgacgacgaaaaaaaagaagacggacaaaaataaaagcaaaccggaagtgataaagacaaatattagaaaacaaactcggatgacgtaccaaaattttgacaaaaacatcttcaattttttttttaatagtagagaaaaggcctccatcccaaattatagggcgcctccttttttagaaaaatcaaacttgataacttttgactaatgatcatactaaccatatatatactaagtattatacatgttatataattagattcatattttgatgtactttctttttatgctaatttcatatttataggaaacctaatataaaataaattaatggtcacagtgtgttattgaagaccgtgtaaaaaaatataaacctaaattataatttaggatggatggagtataatttaagtactatagagagttcttcaattttgacaccattcttctcatatactagataataacccgcgctttgctgtgagatatatattagatagtaaagaaataataaaatgatttggattgtaatattatgaaaatgatttgagaatgatgatttagcacgtgtatgtttagttttagaattgaaataaattatagatataattattatatgcttgcatgttgagctctgtgtgcttaatgggtcgatgtggcatgcttgcatgtaggttttaggagagccaataaatactatgcttgaacgttgagttttatgtgtttagggcaggtgttatagaagatgtgactaccaccttcaaatttatctatatcattcactcataaactaatagataactcatgcaataaaacacctctagtacacaaataccaacgtctctaatactctcacactcttcttaaaatttgtgtggaggttacctcttgatttaggggtagctcattatctctctcctcacttctctactccaccctcatcacttaatttaatttaatgtgccattcttagggacagcatatgaagcattatactcagctttttgcaaatgattatttgaagggtgcagagcatattttacagcagtattgaattgtgctactatatataactcacagatctcgatcatgaggccatgggtcggcagtgcaattgagtacatcaggggaatttttactacgccatctcgataattatttctaaatctaaacttttttactacgccaccccgtatgacagtacgaattaatattgtcacatcacctacagtcgacatgtcagtttttgttttgctactatgctttgccactacgctcttacttaattctaaactttttcttcaaacttttaacttttccatcacatcaaaactttccaacacacacaaccaaatttttcatcacatcgttccaatttcaaccaaacttctaattttggtgtaaactaaatacaccctacaatgtggctagagtagaaataagttttgaaagttttgaaataagttttgaaagggtttattttaaaaaataaaaataaaaaaggttaaaaaaattaaaaagtcttcaaggaagtgccgcaatgttaaggaagccctattttgaaggcagtacttccttctcattattttctgcttcccttgccctattttctccctaacatgtggcccatgaacagtaacatgtggcccatgaacagtgtgtgccatctactagaaaataatgagaaggagaagaaaagatgcccaggttgccaggtgctatatttttttacactgtacgaacgtagatatttatatacatgcccacacactcacccatgcatataaacgcataaacacgtacctacctctttaattacccccgagagattacgttggaatatatagagagatgatgttaccacttatgtcttattattgattgatacgttgcctacaaataaaaaaataattgctcataaatgtaagcatatgtgtcaaggttagaacttgacaccagatgaataggtgctatcataacaaacatatataaccaactgaacttcgttcagctcgcatgcaggtgcacattattgttttggacttttgtaggaatggatttgaggaaaaattaaattgaatattttactatagattttaatttaattatgaaatttggttcatggggatattggggattgttatccaaggtataggaattagagcttaggcaacaaatttggactgaactaaaatttgaaattcaatggaatttgtaatcaggaatactggaagggaaaaaagaggaattgattgggaaattatttcggaccgaaatttcggtcgtatcaagcctcccccccaatagaaagtgctcgttcaatatatatattgaaccctggttagtatgcaaggtttacttttttatttggttgggtgagtgggatgatccaattttatgtttggtttgagccataaaggtgaatttttttatgcagttttttttagttgaaggaagtaaggtgcatgagctattgtgatcactctggtgagaataccccttcacttcatatatctcactgataaagactgccttaactcaagcaggttgggcaaactatcaaagcgaagaattctttcggatcttacgtaataaaagatacatgaaatatccaaagattagtatatcgttcataaaatgaaaaatcaaagattagccggggctgcctacggctcgggcgcccgacatcatgccgatgtcagcgcccgatttacgtacaaaactactttaaactgatgtttctcttaaattacttatccaaatcatgatctgattacaccattaaattcgttacaattaaatcttcaaaacaagaccacacatggatatattccgatgaaaaaatagcttattattgatttttttaaatgttgcacgatgttccaccaggtatatcggaattgtttcactaagtagatcgaaaatgtttcactcgttgaaattaggtgctgtttcaacttatataaaaacaatattttagcaaatagcgaaagaatgttttagttcactacaacattagatctatacatagtgaagcattatgagtacactaggtgaaacatttttcggtggaacaaaaaataaaccaaatttccttaatagggggtttccaaaatatgtgggtttttgttgcaatggaatgtttcgttcactgcaacattagatctatatatagtgaaacattgtcagtacactagatgaaacatttttgctggaacaaaaaataaaccaaattctcttaatagagagtttccaaaatatatgggtaatttgttgcaatagagttgtgtgtgaggacacgtggtgggtcaggggaggggagcgcgcgtgcatggggtaggggagcgcccgatttctcctcccccgcccgatcacctgacgggcatcattatcgagattactccggctgctcccccaaatttgatggcgaaaatcggagtgcaaataacctcatgaacattagtaattattatggatgcatataatgattaatgtgtttacacccaaatttggcacctaggagtaaaataagaaaaattgccaaagtttggaagtctgccggttttcctctgtggggccggtctgaccgccgtgtgtgggccggtctgaccggtggtgtgtggccggtctgaccggcagagtccgagtccaggtctgtttcaccgggtctcgaagtttccttgctcaggaaggcatgtttctggtttcctttggattctatcccgagttggacgtggaggagggcctgtaaagggtaagaccaacccctatataagggggtaaggccggttcattgtaaaaaccaatctacaatcaatcaatcgaatcgtttttcatattgcttttagttttctcttagtttgtccatctttgtcgatttgcgccgtaaatcgtccaccgcccctacaagagtgcgacatctctttgtaggtttgtcctgaaaaccttccgttttgcccacgagacgggtagttatctagaatcggctccgttagccagtttagttatcaaaacctatcttggtttagcttttgctagattgagatggttggtgactctagtatcaacgcaaggcgtttacgtgctgcgatcgtgcttgtcaacttgtcacaaaaagttgccaagatgatttttggcgactccactagggaaatctgctcaacgtcatctcaacttcgatatcgccatgacaaagcctccatcaaccaaggcggaggtggaaccggtcaatgtgataccagtcgcattggaggagcttgatgagggagcacgcaaagctttagatgaacatctcaaggcatatactcaagatctactaatgaaggcgtgcgctaggacccgccaaggtgtgattttcaagccgggatcattgcctaaacatactttcgacatggtaagtgctgaagaggtatcacaatctatccaacaacaaattgcgcatacgatagattcatctatggttactttaaataataagttagatgcatctatcgaaactcgttgtgaagaatttatgaggactaaatttggccctctcatggccgattttatgttcaaagataaagcctctaccagtgctagccaagcccccatagatcaaataagtagtaaaaccgatggggtgaagacgcaacaaactgacgaggggtggtcagcgcatacagccggtctgaccgggctagatggtcggttagaccgcgactttgccgccggtcagaccggtcagaccgggtattaccccggcggtcagatcggaccccaaaccggtctgaccgcgcctttggatgccggtcagttcggggcttggaccggtcagaccggcgcaatcatcccaatacagggggtagatccaatgacaaataacatgtttttataccatataccagcacccaatcctcctatatccactattggtccccaagttcaaccacatatccctaatgcttacaatgatcctactaggggatatactcccgatactaggcatggccaatataattatattgcgccgcaaccacaacctattaagccaccaaacccaccaccaaatcaaaataggcctgataatatggaggaattgattagtggtattattaaggataaatttggaattaaagctaggaatcatactaaggtttaccaaaagccatatcctgattactatgacaacataccatatcctcgtggttatagagttcccgaatttaccaagtttagtggtgaggatagtaagaccacatgagagcatgtaggtcaattcttagcgcaatgtggagaggctagtagttctgatacttttaaattgcgtttgttttctttatctttgtccggtacttcttttatatggtttacttcttttccggcaaattctattcatacttggactcaagtagaacaaagatttcatgattatttttatactggtgaaactgaacttaggctaagtgatttaacatcggttaggcaaaaacacaatgaatcagtcattgattatgttaagagatttagcgatgttagaaaccgatgttatagcttgaatataactgatagagatttggctgatcttgcttttaatggtttaattgctcctattaaagaaagattagattgccaacaatttttttatgttagtcaactcatgcaaaaggctctggctcaggaaagccgggttaaggatagcaaaaaatttgttagagcctaatgttaatttgattgattatcctgaagctagtgatagtgatgatgagggtgatcatgatatgtatgttgcggagtgatcatgaactaacaaaaataagccttttgtttgctctaatttaatgccgactcctcgtaaagatcggcaaagtaaggttaagtatagttttgacgtggccaaatgtgatatgatttttttttatcttttgcaagaaaaacaaattagattacctaaaggccatgtcataccctctcaagtagaattgaagcgtcaagcttattgtaaatggcatgattctcactctcattctactaatgattgcaatgtgtttcgacgacaggtttaatcggccatagatgaagggcgattgaaatttaccgatggttccaagatgaagcttgatcatgatcctttcccggtgaatacaattaatttcaacaataagaaggtgttgattggtcaaggagtggtcattggagagcctaggccaaagatgatggtgccaaagaatccggaggttggtgtttggaaggagaataggagcgaagtttcaagttctaaagctcctaagaggactaaggtgaccttcgatatgcttttgaataagtatgagaagcaaggtggtgagaaagctcgcaacaaaaggaaaagaccaagatcacctcctagggagcgatttggtcattcaccaagacagtcggaatcacctacatatcatcgttctcaaaacatgtcatgggggccttatccaatgctgccgtcgggttatccttttccttactacatgccatggggggcaacaccatcaatgttcaatcatatgcctccaatgcaatacaaccggggccagctcgttagcgtttatctttaccaaacaatggccagttttatgctaagaaccgggccaatgaggagaaaagggaaggaaagcgtgtcaaagtggagattaggacttcggaggtgattactatcaaagtggggtctcatgatgagccaataccttctggagatgaagttggagagtcttcaagcaataaatccaacgccgggaccagctcatcgcaggcggccggtctgactaggccctctggccggtctgaccgcagccctaaggctggtctgaccgggccatcaggccggtttgaccgtcagcccaatgtcggtatgaccggcgcttctggctggtctgactaatggtctacgtccggtctaaccgggctccagcgccggttcgacaggagatttgcaaagggtagttcaggggcttcatcgtcttcgagtaaaatcaacagagggcattatttacctcctggaacagagccgaaaccgaggtggatgcctaaggatttgacgggtaccaaaagagaaggttgcaacatctttgggcccaagaattaagagagagagaggccgaagagcaaagagatagaaggttcaatgagttgcgaccactgcctacaaagatgtggaggcataaatccatagagattgaagaaccggttgttgtgcaaaaggagaaggaagaacaatcggttgctaaggatgaatcatctccaaaggaggacatggatgtcaacatggtgtgtatgttgcctatggagttttacgctatagatgaagccgaggttgctcaattctcactaggtcctaaagatgcggtttttgagaagcctgatgagtcaaaccgtcatatgaagcctctctatttcaaaggtcatattgatgggaagccggtctctaggatgctagtggatggaggtgctgccatgaatttcatgccatactcgttgttcaagaagttggggcatggagatgatgagttgaagaagaccaacataattctcaatggcttcaatggtgaaccaacggaggcgaaggatatcttttcagtggagcttaccgtgggaaacaagacgctaccaaccgctttcttcatcgtcgatgtgcaaggtaactacaatgttattttgggtcgttgttggatccatgccatttgttgtgtgccttttaccttgcatcaatgtttaattcaatgggacggcgatgatgttgagattgttcaagcggatacatcgcccgaggttgcaatggccaatgcaacatttgagtggtgttatgggaatattcaatgcttatcgggatggatctttctagctatgattttattagtatcgccaatggcaaatttgtacctatctctgtatagccggctagtttagcacggctaggccatatcactttatgtaatgaataaagaagctaatttagagtggttgcaaaagagggtgcaagaatatcggtctacaaagaacgatattagtgaaactattgaagattttgatgaagtagagaagcttggttaagggttcacatcggccgatccgttgcaagaagttgacataggtgatgaaactaagccaaggccaacttttgtaaacaaaaacatgagagtcgattataaagctaaaataatcgagctacttaaggagtatgttgattgcttcgcatggagtatctgttgacgaaaaaatcgaacacatcggcctggaagatctgcttaactcatgtgcaggtccaaagattcatgagatgcaggcgtgccagtcagtttgatcctgcaactgacaagatatgcaaatagtaaatcaaaacagccgatcggctgacaagccgatgaagtagttccagccgatagccaataatagccgatgccgatatcagccgatagcgatagggattaagcaatcggctatatgtgcaatgtagataatgatataaaggcaatctgctgttgatgatgtaataaaataacaatataaccgagtagaaaccaattggctagaaacaagatataataatcactgatccgaaggttaaaacacacatcggctggaggtccgatgtcatgaaatccacaagattagattaaacagtgacacctttgttgtcatcggctaaatccaatttatatgtatatgcaatccttatgagccgatgcaacgtccagataactcaccggctgaaaccccgatgaaacccttattggcagtcaaaaagcaggctagagattatggttctatacatgacttagtagatcaaactcaactgatgcagcactaagtatgaaaagaaacataatatctagacgatcaaaccgttgactgagttttcagggtggtagatatctaagttaatctaatctagcaacgcgatttagccgataccggcagaaaccctaaaacgagaagcagctgatagagctaaattgatatgctaagactagattaatagagacatatgataaataggtaggcaaatatatcatccaaaccagagcaatccaagaggtcgaatgtactgatgcagccttgaacgacgccgacgtaaacgatgcaattgcctggaccgacggaacattgaacttaccccttcgccggagatcgaagacgatgcagccccgcgtcgggtgccaagttccgccggaacgtagaaacaaaagtagaagtaaaaagggtggcgatgcaccgaattgtattgatcgagagataattacatagaccccgggtgtacatatttatacccatgggttgatacaagtccttgtcggacaagaaagaaactatcctaaagataaaaggaaaagataaagtccttatcggacactaaacatactttcctaaagataaaaggaaactaacaaactatacctaattaatagataaactgccatgccgcatccttcttgaactcgaactcttctagataagcttcctttgattgatttgattccaccgagaacacgacagcatggcaacttgatgactcccatcggctgattcctccaatcggctgattccagtactctggagctgatattgactctaagccgatgatgacttcgggcttgaccaaattttcactattaacagtatcatgagatgccgggtcttaaccgtgatcttgtcgagcatcggcttccaattaaaccgggttttaggcctcataaacaaccgcctcgtcgtttcaatcctttgctatatgaccgagtcaaagaagagattgatcggttgttgaaagcggggtttattaggccatgtcattatgcggagtggatttctagcatagttccggtggagaagaaggggagtggtaagattagagtttgcatagactttagagatttgaataaagctactcccaaagatgaatatcctatgcctatagccgacatgatgattaatgatgcctcgggtcataatgtgattagctttttggatggtaatgccagctacaatcaaatctttatgacggaggaggatatgtacaagacggcttttaggtgcccgggatttgttggtatatttgagtgggttgtcataacttttggattgaagaacgccgaggcaacatatcaaagggcaacgaatttgatcttccatgatttactaggtattatcttagaaatctatattgatgatattgttgtcaaatcggatggtattgtgggacatagccgatttgaggttagcttttgagaggatgcgccggtatggtttgaagatgaacccacttaaatgtgcttttggtgtgtcggcggggaagttcttaggattcatggtgcatgaaagaggagttgagattgatcctaagcagatagaaaagattcgtgatttcaaagcgccgacatggaagtaggaagttcaaaaattactaggtaaggtgaattatttgaggagatttatatctaacctagcgggtaaaatcgatgcttttgtccctatacttcgtttgaaaaaagaagccaattttacttggggtgcaaaacaacaagaggcgtttgaaagattgaaaaggtatttatctactccacccgtggtacgagcgactaaagttggaatgccgtttcggttatatattgcttccgaagacaaagtcagtggtgccgttttggcacaagaggaagatggcaaggaatatatcattacatatttgagccgccgtcttttgtatgccgaaacgaggtatgtctttatagggagactttgtttatgcctatactgtgcttgtaccaaattgcggcattatttgttatctagtacatgcatagttgtttgtcaagctgatgttattaaacacatgttgcaaaggccaattctaagtgggagaattggcaagtgggcatacactttgattgaatatgatttggcttatgaaccattgaaatatatgagaggccaaattgtagttgattttatagtagaccatcctgtagatattgcttatgaggaagaggtttgcttagttgaagttataccttggaatatttatttttatggttcttgcaaagtaaggtcaaggcataggggtagttttgttttcacctaa

SEQ ID NO: 67380 - DNA, 1570 bp, Oryza sativa
atcataagataatttcaccatctattccaaaataatttggcctgcacaaatgaactaactataagccaaattatgatcaaacacatgcatgcatgtccaagaggttgattaggtcccatagatggtgcatgtgcaaagaatcgatgaggggctcccagcgaaggagaatttggtcatggcgacagtggccgaagttgaagccgatggaggccgatctccgtccatggtgctccattcttctcggttcttgaggggtttttaagaggatctcatggaggagttgatggcgcgatggctctgcttgatttggtccagaacgacgggaacagcgacgaggtcacaacggcgtcgcgcagagcacgccccaaggccggcgatgacacagtggcgttcccgttgattcgctgtacgaaagaggatgaaatcaaaaggagaatcttgggcatggtgaggagagtatggaacgtggaagagatagggttggcgaagactcgtcggcgacgacgagcatcgtctttgtcacggctggtggtgagatcgaaggcgaggagagcagcaagagctctctccctcggttctctcggcacaggactggaggatgaggcgaggcgatgcgactgtgggagagatggagagtgagctcggtgttagagttcggatatattgcatgtacatgtgataatgctcccgtatggctgaggatagagtttgttgtgttagttagacaagataggatcaatctctgtaatttagctgtacacaacaaactctcaccgaagctatttatctcttgtatcctgtcgcccggtttgtggcattattatcaacacgtaacctcctctctgtaggagttcctcgcttccacatggtatcagagcaccccgctagattagattagctcgtttctgcatctctgcaatggcgagttcttcctcagcggtggtgatctccaacccattgttcgggatccaaatcttggagaaattcaccaagcaaaatcactccctctggtctgcacaaatccttaccaccctacggggtgcgcagctagaagggtacatcaccggcacagctgaagctccggcggccgagtgtgagaaagaagatggcgacaagaaagtcaagaccaccatctccaatccagaatacatcaagtggttcacccaggaccaacaggtgctggggttcctcttctcctccctgtcacgggaggtcctgcagcaggtggctggcgcaaagacggcggcccaagcatggagcatgatcaacgacatgttcacctgcaagtccaaagctggtgccatcaacgttctccttgcactaacgacaactcagaagggacccatttccatctccgagtacatcgccaagatgcgatctcttggcgacgagatggcgggtgcagggaagcctcttgacgatgaagagctgatagcgtacatcatcaacggcctcaactcggactttgacgcaacagttgaaggattgatggcaacagcaagaatcgcacccctttcaatttctcatgtgtattctcaactcttgagatatgaaaacaggggctgcagga

SEQ ID NO: 67381 - DNA, 734 bp, Oryza sativa
ctgcagcccataagatatgagttgtgcaagattgtacaggaagctgaaaaattatatgaaaggaagggcattgtcggatgggtgaattatatctgatcgtccaaaatgggttaatagtgatcgttggcgtttgtacccgtctaacctttttggtctgaagtctaaaccgcagagcaccgctccaacaaggcgcccacataaggaaaggaaaacctgcaacaactccatggtctcctcccgtttcgatcaaacaaaagaccagaaaataaaagagaaaaaggtaatagtaagcctccgttcccaaactcccccaaaggcctccaagctcgagctcgaccccgaaccggaaacattcctcgtcggcgaggagcggcgagatcccccgggccccggccatggaggggctcctgtccaagctccggagcctggacgcctaccccaaggtgaacgaggacttctacagccgcacgctctccggcggcatcatcacgctcgcctcctccgtcgtcatgctcctcctcttcgtctccgagctccgtacgcctcctcgctctcccctccctccctccctctcacttccgatctagttccgctgctctcaaccctagcctccggatgggtgcctttggagatccgatggccatggatttgagtatttgaccatgggggatatgctggacgagggtttgcctgattgatttaattcggtgcgctagtgaggtgtgggccgttgt

SEQ ID NO: 67382 - DNA, 719 bp, Oryza sativa
aacaagtagaattttggaagggattgattaaagaaattgaaggacttctacggtacaatacactagcaatatatatttttggcatatacaaagatacactaggaatttccatgtacaagttcgcgtgagcatggtggagagtggggagttgggcatcattgctgctgcctcctccaggtagaggaactagctagggttttgggtgggtcggaaattgagaagacgaaagaaaggcaattcgaattaatttacaggcaggcaggcacaatagcgtggtgcgcgtgaacttgcagtgcgtgtggcgtctctctatggcggtatggcctatgatggacgacaactacgggactggggaatgaaatcaagtgaggaacacgtctagcattgtgcatttatgtacaacagttgtctgcaagcaaacatttagaaagacaattatccccttttcaattttatactacaattaatttaagttggtaggccagttaatctacaccatctgatcattcatactaataaaatgtactgtttgtattgatccatatgttatgaaacgaatgtagtatcgtatatagatcttctcagaaatttatgtcttctctctgttccaaactctccaaaattactgtaagaaccccacgttgaaaacagggcctttaatctcactaatcatgctctcttaagcagcgcaactccaacatctgatcaaaaactaacac

SEQ ID NO: 67383 - DNA, 2675 bp, Oryza sativa
tggaagcttttggtgattcggaattggtggtgcaacagttgccggagtttacaattgcttggacggatcactaaataggtatcttgattcatgtttcgatattattgccaattttgataattttgctattagacatattgctaggcatgataattctatagcaaatgatttggcacaacatgcatctagctataatgtgaagaagggagtatttttgatattggaagagccggtgcttgattttaaacctttgtgtgaaattggcaaaatcacaaaccaggggtggtctgactggcgttgcacggctggtctgaccggtgaccaggggcggtctgaccggccttgcatagccggtctgaccagttctggatagagcgctggggggcacgccgcaattgattcaaagccaaattaattgtaaattcggacatttgcgcccagaagacaaaagaggattggagaattcctttgattaaatatttgaaagatcctacacttaaagttgatcggaagatttgtcacgaccggaaatcacccaacgggcgttcctgacgtgcgtgtattattccttgtcccaggaggcaaggtacaccaaaagttgatacaatacagagtttaacaagcggaagcgtatataaaattattacatgggcgacgaaggcccagcacactcagagacaacgaaaaacagcggaagactagggcgacgaccacaggcgcttgacggcaggcacgagctagacaccgaagccttcatcttcagggaactcctcatctgggcttgggaaaattaagcaagactgagtacaaccaccgtactcaacaagacacacccacaaatgcagaataaatgcaagggagtacgagggaattataacataaagggttagggttgcagtaaacagcatttaaagacatttagttgctcaaggccattttgtaaacacgatcctagaactaaacagtattattaatcaaggccgtgaacccacacgaacctgccttaacccaaggcctatgatgattcagaccgaactggcaacccgaccctgggccccagctcgtcccaagccaacccaggccaaccattccacattttagttgttgagcaaattttaagaattataacactgacttgggtacattgctcggcttgcccatatccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcagacggaactgagcccctcacagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccagagtgtccaggtgatatgaaataattcccaagtctaaagttgtaaaaccacctaaggttacctaattaaattgcgaagcatctacctagaattaaactagtggtgtcttgagtagagagtccactagttgaggttttgtttgcctagggtgaacaaggtaataataataacaataacgataataatatggtcataacaaaggtgaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccgtttgaagtttatatgctctttaaatggatatttgcgaatttcttcatttaattttcaattaaaaatcccatttattgcgtcagccgaggggcgggcgcgcggaccgggtccacgggaggtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgaggcggcctcgccggcacggccgacgggagcggcgcgcacccgcgccccgcatggtcaccgccggcgaccaccggcgcggcggagcggcgcccgagaaagaggtgggaagggggaaacgaaggggatggtc

SEQ ID NO: 67384 - DNA, 67408 bp, Oryza sativa
gcggcatcttttgtggtaattatcttctattccatgtatatcttgtgttcttgagtattaggatgccgtactattaagagggctaccacatgcatataattggtagaacactagtgctcaaaatcctttatttggactgttcctattttattcctgtcggactatccgatcctgataagactatccgatgctcagactatccgaaatttcttagaacttttccctctgtctttggtctgagtgttggctaaaaaatatcggacaatccgatataaggtcggattgtccgatacatcggactgtctgaactttctcagaacttcactctctgtcttgaattgctttttattcctcttgagtgatttttcaaatcagactatccgatgtgatcggagtatcggatgacccagagactctgaaattcaatggaacttgagtctctgtgagaggatgaaattcatgattcaaaaataacggaatatccaatataacatcagactatccgatcgatcggattgtccgaaattctccagaatttcgttctctgtctctggcgtgcttgggggtcaaaaacatcggactatccgatgtcacctcggactttccgaggtgggatgaaaatattttctcccaacggccacattttgggggatctataaataccccccacctaacccttttctagggttacccaactcattcattcacattcactttgggttgagcttggtgctaaggtgctttggatatttgagctctttctccctctctcaaatccctcctcattctttgtgtggtggatcttggtgattgtggatttggtgtttgagggcctactgtgtgtttcactcgatcttgagcactagggtttgaccaagagttgtgtggtgtttgtcactcttggaggttgaggactcctagacggctaggtgttactcccgagccaccgatctacgtgtggttggccgggagatgtttgtgaaggccggatctcgcctccgcaaggaaagagataccccttagtggaaggaggagtgcttagtgcaacctcttgaggaaagggttagcaaagaccccgctcttagtgagctcctcaacggagagtagaatcccctcaaggatttgaactccgggaacaactcggtgaacttcattgttggtgatatctcttcatcccttctttagctttgcttaattgtgccgctatagatctagtcgctgtttgcgctatactcctgtttgtgcactagatctacttgttgtgtttctttagtggatcagacagtctgatccaacatcagactatctgatattttcagatggtctgactgtggatcagactttccgaccctaactcagtgtgagcttccgcataaagttttaaattagcctattcaccccctctaggcctaattgaccctttcaattggtatcagagcctaatctactaattaggcttaaccgcttggagagatcatgtcgggccaaacgggggatggcaaagatggtgataagggatctacgtttccttatgactatccatccacatctacctcttatgtgagtacctatagcggcaaagcttcgtacttcaacggcacggactatgccgcttggaaacataagatgaagatgcatttgaagtttattaacccatctatttggagaatagtcgaaaagggctatgttttgcaaaaacctgaggatcccaccaaggaggatgacgagaacgagcacaagaacgctcaagccgctaatgcaatacttagcgccttgagtggaagtgagttcaaccgcgtggacggtattgagagtgccaaggtgatttgggacacgcttcggaatttgcatgaaggcacggatagtgttcgcgagtccaaggtggagatcctcaaagggcaatttgagaggtttgtgatgttggatggagagagcccaagcgacatgtatgaccgtttgagcaagatcgtcaatgagatcaagggacttggctccaaggacatgaccgatgaggttgtggtcaagaagatggttcgagcaatcactccaaggaactctaccttagtaactatcattcgtgagcgtctggacaacaagactctcacacctcatgatttgctcgggcgcatcctagcccatgacatgcttgtgcaagagtccaaggaggtcatccaatacatcaaccaaagctcaacgacaagcatcaagaaggaagatttggcattgaaggcaaaggaagaagaagaatagagccgcaagagcaagagcaaggaggagatcgatgatgaagaaatggctctcttcgtcaagaagttcggcaagttgatgaggtgaagctgcttcttcaagggaagttcttccaagcaccactccaacaagtcaagtggaagacattctgcaagggtgtgctacgtgtgcaaagagcccgggcaattcattgcggattgcccttacctcaaggatggttcccacatcaaggaagataagaagggcgaaaagaaggatgagaagaaggagaagcacaagcatagcaagcgggaacgttatggccaagctcaccttgggatgattttcggctccgactccgagtcaagctcaagtgatgaaggagttgccacgtttgccgtcaagccttcatcaccaccaagactcttcaactactcaagtgatgaggatgctcccatttgcctcatggcaaaagagcctaaggtaccttcctccctcaagtcaatcaatgttgatcttgtttgtgatgaggaggatgatgttgaggatgaggttatggatgaggaattgttcaagtccataaccaaggagtctctaccacacttgagtgagttgcttgggagaattgatgatcagtatgcaacccttgagaggaggcaagaggcattactcattcgtgagaaagagcggtctcatgaactcaagggtgagcttgctaaggagagagaaaaatgaggctttggtacggctttacaagcaaaccaaagagtctcacgctaatcttgaggtggcaaatgctcaacttcaagagagagtggatggcttggacaaagctgttaacgaccaaatttagtaatatcagcatcggaaaagaggattagatcgaagtggagccgaaggcggagatcgattcgagaatagagcaagaatcggctggagcctagatcggctacgattagaatcggttaagtccgagtaagactgggttaagtgatgcagccgattctgacaatacgacttgtattcgatatcgggtttgagttgacgtacttcaagatgattgccatacatggataaagtcctgggaaggcaattgtatctattaattaggatattttatgtaaatttcttagagataaatatgggcaaaagtctgccacaaagacttatggtatcttagagtttgttagagataatagtcgtgtcctgtatggacatatcttgtaattctcgggtataaatagaccccgagccctatgtaattttaacacacacgttcaatacaatttcggcgcatcgccacccttttgctttagttttatttcgatgatttctggctttcgggttgagctgcatcggtttcgatcttcaacaagaggtaaaacttgttatgtcggcttgtgttctcgggattagtgcttccatctttatgatactctaatcttgtttatgtaatttgctgagttatcatatatcttacataatctctaacgatatcgccatctagcctacaatcggctaacatctgttaatagagggcagccgattaggttaaatatcgatgttggtttagattatataagatacccaccactatatgaaacttccagcgacttgattgtctagatattgttcttcttttcatacgtaatgctgtatcagttgagtttgatctattaagtcgtgcttagaatatcaatatctagcctgccttctggttgccaattagggtagtatcggagtttcagccgatcttatctgatttaattatatttgctttatatgtttcattgacatgttaaatctgccctttatgtcaggatattattgcatctaagtatattaagcttctgtttggtatattctgtttgtttcaacatcttaacatagagttgtatcggagtattagccgatacatgctagatctatccgatcggctatgctataaacatatatagttctgttattaatatatatttcaatctaagtgatttatactgtcttggcatggcgaccgatctatcccaatcactcgatttatgtatatatcgatataaaattatatattgttgatatctacagtcgatcgagtaggtttagttctttattatctatttataaccgccgatagatttacatatgacatcggctcaaagataaatgatatgtcatcggcacttagccgatcgtctatcatttataggtttaaccgcggtttctttgtctctatttcttgttgattgcaggatcaaatcaactggcacgctaacatacccgaaggcgagctttggacctgcactggagttaagcagatctcgcaggcctcgtgttttacgtcaacacgcttttggcatgcccagtgggaccaagaagaagtcagcaagcaattcttcctcatggccgagaaaccaccgctatcgccatcctcggctagtccaagcactgttaaggaaaagatccagaagttgggattgaccgacgtcaatgaaggaaacgtcgtgcccatcgatccagaaaaattcacacctgatcagaagaaagatttcgacgcgatgatgcagcaggcacgggatcaattcttgaactcattcatgcagactagcaagggaacagtggttcagaagtataaagtaaaggtagttgccgatgatcctgggaccagttcttctaaaggtgaagacgggaaacaagctccggacggctcggctcaaccgagtgacaatggtgctacagacggttctctaggaggtcaacgtgacaattctcaaggagtccatggggttcaaggtgatggggtgcatggagttcaaggtgatgttgcttaggggttgcgtggaggaaattttaatcaggatggcaatgcatcataggagtttttcaataacttccaagatcgggttgactatgccgtgcacaatgctttgatcaatcaatctgggatgttagtcaatacattgtcaaatatgatgaagtcaatggtcgatggtacaatagctgaataccaagctgcaggcccagtttatttgcaaggaggagtatttccaaattatcggcctttgatcaccaacagtcatccatccgttcaagcagctccttctattgcaccatcggctcagccgatggcaccagcatcggctcccgcacctactgtaccaccttcggctccaggccaattggtcaatccccgattgctgataagagaacagccacaacacgctggacaaaatgtggatcggctaacacaagaccaggttgcatctatgtttttgcctccccaaaacactgttgatccaacccgcaacagccgattcagcaaacaccccaaatccaacaaattgtgcaaccagtgcagcaaacacccctagctcaatgagttgtacgaccggttcagcaaactccattaaggcaacaggttgtccagccgattcaacagcaaggttcaatgaattcatcggcagggtttgcaacacctggtgggcagcctgtgcaacatgctacaaattaggttgtcccagagcatttagtacatcacgtacaaccagatggcacggtaattccgctagttattcctgaacatttggtgcgtaatattcagccggatcttcaaaattaccagggggcaatttgaattatcaatatcagccaccatcacctcatgttcaataccagcaagcaggatcggctcagccccaatttgttcttcaatacaaccaattcgagccgatgccacaacaacctcaagggacacctcaatagtggccatgggccgatttgattgcagatgtcatgaaggagcagttcaggcttaggccgaaagatgctggaaatctatatcggcagccatatcctaagtggtttgagagagttcctttgcccaaccggttcaaagttccagatttttcaaagttctcatggcaagatagtacatcaacttatgagcacattagccgatttttagctcaatgtggtgaagcatcggctgtggatgctttgaaagttaggttattccggttgtctttagctgggtcaacctttacttggttttcttctttaccatatggatcaattaacagttgggctgatttagaaaagcagtttcatagctatttctatagtgggattcatgagatgaaactgtccgatctgacgtcaatcaagcaaaagcatgatgagccagtacatgagtatatccagagatttagggagatgagaaataagtgttacagcttgagtttaactgacgcccagttagccgatttggcttttcagggtatgattgctccaattagggagaagttatcatctgaagactttgaaagcctgtcacatcttacacagaaggtagccttgcatgaacaaaggtatgcagaggctaggaaaaattctaggaaggttaatcatgtttgcccttataaatatggatcggatgatgaagatgatgattctgagatagctgcagccgagtgggtaaggagtaagaaggttataccatgccaatgggtaaagaactcaggtaaagaggaaaggtatgactttgatatatccaaggctgataagattttcgacttgctactccgagagaaacagattcaacttcctgccggtcacacaattccatcggctgaagaattagggaagaaaagatattgcaagtggcataattctggatctcatacgactaatgattgcaaggtcttcaggcagcagatccaagcggctattgagggaggcaaaatcaagtttgacgactctaagaggctgatgaaggttgatggcaatccttttcctgttaatatggtgcatacagctggccgaacagccgataggggccgtgcaaggggttttcaggtgaattcggctaagattatcaacaaatatcagaggaagtatgacaagcagcaggagaagcatcatgaagaagatgacgatggttttgatcctcattgaggttgtgagttctttagattttgttgaaatgaaggtctaaggctgccgtctattgaagactgtcctgggtgcagtgatattgccaagaattcaagccgatcatatggtaggggcaatcggctaaggcagacaagagttcctgttcatcaaagattgggtccagtgaatcaagatcatggccaagaggacaatgaaatcaggaaaaatcagtggtgtccttctggtattttcacgaagaatcaaaagagaagggttcaaagattgaggaacagggagtgcttttaggaggttgaacaggaaattaaccatcggctgcagaaaacaaagtcgaggcaggagtggcgtgttaagaatcaggttcctgtagccgatgaagctacagctgaggaggcaaaaaggttagctaaggggaaaagtgtcgtaactgcttcggtcaacatggttttcacgttgcctgctgagattgggaccaagcaagccgatgtcgatgaagttgaagaagaatcagccaaattgattttgttgccagagcaggcaatttttgagaagccagaggggacggagaatcggcatcttaagccattgtatataaatggttatgtcaatgggaagccaatgtccaagatgatggtcgacggtggggctgaagttaacttgatgccttatgctacattcagaaagttgggcagaaacgttgaagatctcatcaagacaaacatggtgctcatagactttggcggcaatctatcagaaaccaaaggagtttcgaatgtggaactgacagttggtaacaaaactatccctacaacattctttgtcatcgatgggaatggttcttatagcttgttgcttggaagggattggattcatgctaattgttgcattccttcaaccatgcatcaatgcttgattcagtggcaagacgacaagattgagattgtgccagccgacaggtcagtcaatgttgctagtgctgatttagctctttgggagatggatggtctcgattgtttatctggaaaagtttgggatagagattttctaaaagtgtccgattctaatatacagccaattgaagatggagaacccaagctgttatttcgagggcgttgtggagggttcaaatgtctacatcaaggacacggtagatgatctcgatgacaaacaaggacagggttttatatcggccgatgatttggaagaaattgatataggtccaggtgatcgaccaaggccgacatttatttgtaagaatttatctacagaatttagagccaagttgatagagctgttgaaagaattcagagattgcttcgcttgggagtattatgagatgcctggactcagccgatcgattgtagaacatcggctacctatcaaaccaggggttagaccacaccagcaacctctgagaagatgcaaagccgatatgcttgaacctgtcaaagttgaaattaaacgattatatgatgcttgttttattcgtccttgccgatatgctgaatgggtttctagtatagttcctgttattaagaagaatggtaaggtcagggtgtgcattgatttctgagacttgaataaagctaccccgaaggatgaatacccaatgccagtagccgatcagctggttgatgctgcgtcagggaacaaaattttgagttatatggatggaaacgtaggatataatcaaatctttatggccgaagaagatatacataagacagcttttagatgtcctggtgcaatcggcttatttgaatgggttgtgatgactttcggcttgaagagtgctggagctacatatcaaagagccatgaattacatatatcatgatctaatcggctggttggttgaagtctacattgatgatgtggttgttaagtctaaagaaatagaggaccatatagccgatttgaggaaggttttcgagagaaccagaaaatatggcctgaagatgaatccgacaaaatgtgcttttggtgtatcggttggccagtttttgggatttcttgttcatgagagggggattgaggtgactcaaaggagtgttaatgcaatcaagaagattcagcctccggagaacaagacagaactacaagagatgaacggcaagataaattttgttagaagatttatttcttatctgtctggaaggttagagccttttacaccattgttgagattaaaagctgatcagcagtttacttggggggcagagcaacagaaggctttggatgatattaaagaatatcttagctctcctcctgttttgattcctccacagaaagggatatctttcagattatatctatcggccggtgagaagtcaatcggctcagtcttgattcaggagttggatggaaaagagcgcgttgtattttatctcagtcgtcggctcttggatgttgaaactagatattcccctatggagaagttgtgcttgtgtttgtatttttcatgtacaaggttgagccattatctactatctaacgagtgtactgtcatatgcaaagccgatgttatcaaatacatgttatcggctccgattttaaaaggaagggttggaaagtggatattttccttaactgagtttgatctaaggtatgagtcgccgaaggctattaagggacaagctatagccgattttattgtggaacattgtgatgattcaatcggctcggttgaagttgtgccatggacttcattctttgatggatcggtgtgtactcatgattgtggtataggcttggttataatttcccctcggggggcatgtttcaagtttgcttatactataaaaccttatgcgactaataatcaagctgagtatgaggcagtgctcaaagggttgcaattactcaaggaagttgaagccgatgctattgaaatcatgggggattctttgctggtaatcagtcaattggcaggggaatatgaatgcaagagtgatacattaatggtttataatgagaagtgccaagaactgatgcaggaatttcggctggttactttaaagcatgtgtctcgagaacaaaatattgaagctaatgatttggcccagggggcatcggggtataagccgatgatcaaagatgttaaggctgaaattgcagcaataacagccggtgattggaggtatgatgtgcatcaatatttacataatccatctcaatcagcttctaggaaattgagatataaggcgttgaagtatactctattggatgatgagctttactatcggacgattgatggagtgttacttaagtgtttgagtgccgatcaggctaaagttgcaatcggcgaagttcatgaaggaatttgtggtactcatcaatcggctcataagatgaagtggttacttcggcgtgcaaggtatttttggccgacaatgctggaagattgtttcaaatattataaagggtgtcaagattgtcagaagtttggagcaattcagcgagcgccggcgtcggctatgaatcctattattaagccatggccattcagaggttggggaattgatatgatcggtatgataagtcgaccatcgagtaaaggacataagtttatattggtggcgactgattatttcaccaaattggtagaggcgattcctttgaaaaaagttgattctggggatgcaattcaatttgttcaagaacatataatctatcggtttggtattcctcaaactattacaaccgatcaaggttcaattttcgtgtccgatgagtttgttcagtttgtcgatagcatgggtatcaaattgttgaattcttcaccatattatgcacaagctaatgggcaagccgaggcatctaacaagagcttaatcaaattgattaagagaaaaaattctgattatcctcggcaatggcatactcggttggacgaagcattgtggtcttatcggatggcgtgtcatggatcgatccaagtccctccctataagcttgtttatggacatgaggctattttgccatgggaggttagaatcggctctagaagaacggaattactaaatggcaagtatttgaagaaatattacctaagtgtttgggttaatgcatgatcggctgatgttgccgatacatgatagccgatgaattttcatcgcctagagatggccgatattgttatatcgcccttagttttttttttccaattgtaatcggttatggtttaccgatgtgcaatggccggtattactatatcgccctaagttgcttgtataattttattaatgctgttgacattataaaattagggggggcacatatattcaaaaatcgcatgatgaaagtgaaaatttttgagcaaatttagaagttgtattaatcggcacaaaggtagtgttaaaacagcggggtattaaggcatcttagccgattacaaaaatttctaggtcctattacacaagagttattgagataagtactgctggatagcctaatttgttcaacttcttcaatggcttgggcatcttgagcatcagttccagagatgaccttcagggacttggttaggtcagcaacattcttgatagtcgatttgagccttgccttttgttctttgatagattttgggagatcggctagctttttgtgctccatatccagttcagcattgcattcttcaagctgtgccaagagatcgatcttgtgagcttcgagccgatcaatattggacttaatcggaccctcagatagctgatcgagtttgactttttcttcatgcacaagctgccgattgacctggattgtggcttcaatctccttgcgctcacggcgttcggctagtcttagcttggctttttccagcttgaactgatgttgttcaagataagcggctggagttaggacatcggccaattcttcgggaatcagagcttgaacttcatgcagccgtgtcctaattgatccgcagtcaactaccaagctatctaaagaagaggcttctagctagccgttgagagatatcttcaagtgttatctttacatcgtcagatagaggagctaaagctttgcttgaagtatcttcttctgccttatcaagataatctctgatgtcaaaagagaaaagatcggctaaaacctgcagagacaatttcggaaagagtaagagctgggtaaaatgtagctgatctaattattgagacaaagaaaaacttattgggatagcaggagcagctggttgttcttcctcctcgatgtgatgactctccacagccgatggagtctggtcacttgacggttgctgtacaggaggagaaggaggaggaggaggctgtagaatagacaagtgttatatagagccggttgagattgattaagtaaaagaattaaagacatcttactggtggagccgacttgacaattgttgctgctggttttttcttcacagcagttttcttcttctgcaaccacaaagtctatgagtaattagccgaagagtcgattgtctgtagaacaaaaacaagagattagtcaagtaatgaatcggctaacaattattcaagctaacaatggtgaggtttacctgaggtatgacatcagggaatagatctgtcatatacatcgaagctgattgatgaaacaagtgcaacttccattcaccccaccatctgtcgaaatttttgcttctaaatcctgccaactcaatattatcaatactgcccagaaggggtcctggtaggttaagtagccgatccatcattagagtggatgtgatttctcctcggcactgaatcttgtcggcaaagaataagctgattgggagttggcacaatccaagttgtctggccgagctcattgggtgataaaattcgtaggagacttagatgtttctcccttggtgaatgttgacatgaaggatgcatggactgattgaagctgtaagaacttctctagatttttggaatttttcatgattaatgtcttgaaatctaaagtctgatggaagttcaagatctgctgagtcttcataagaaaaccacacccgtgcatctttcttaaaaccttcgtagaagctgcagaaccagtccttgagtagctcagccgatagcttcgctcgagcatcggtttgtgtggatgtatattctccgtatgatgtgcatatgtgatgagtgcgttcttctccatcgtctcctacaatcggctctggcaatgggaactcagcttctgtcacaggcggctgattgaaaactttcctaaccatcaggttcaaccaggtttgtagcagccaccatggtctacctgcaccaactactgagccaacggctattttggccgatgcgttgttcaatgtttggtataagtaaccgaggaggatcttgcctaatggaaattctttctttgattctaaggcttcggctacaaattgctagttggttgtagggccacaactggatccacagaagaggaacttttctagccacatgagcaagaaagctacatgctctcgaggggtaacagatccttggcccatatatgccgccatatagccagaccagccacctatgcttttggttctgaaatcaaactgatttttggtgttcatgctcatgggattagccgatgaagttacatctaaaccggtgatcatggtaatgtcgatcaaagttggagtcattggcccttggttgaacaagaaggcgttaatggtgttggaccaaaaataagaggcggctgccattaagggctcgtccttagctaagttggctatggttaggtcaagtgcttggccgattccaatctcatcccagtgaactttcttattagccgatacgcgctggtaccatgtgatccaacttttctcaggggtggttttctcaagagatggccaagacttgaaagtgtttttccagtggctcaggttagggttggctagcctaaaggggatcctattggtttcaccaatgataaaatcagtggagtcaagattgccgattggacccagaaaatagtggttttcatgcgacaagctgggaatcgcaattaggttggaaagatgctgcaaatccaaagcaaccggaaagaagaagagcaatgtgaggtaaggaaaatcgatctgctgttgagaaaggggatctagccgatggggacttacctcggcatactcagctgatggcgcagcagacgggctggcggaggacgacatcgttgcgggcggagatctcgccaagggtgaagtcgcctggaaatcgctttgtgcattggaagaatcgccgtagagagagaaggcagagtttcacttgagcggtgaaaacgggagtaatggtgtaagatttctctgcggcatcggtaaattgaaaccatgccattataattttgcaaagtttgagatatgccatcggtatctcaatgacatgtaggacccacatgagtcaatgacatgtgggtcaggatggcatatctcaaattttgcaaaattataatggcatggttccaattttccctagtatttaaagcgcttgaataacagtcggaaaacggtaaagtgcgaaacttgctcggagtcgatgttaagaaaatccgaaacattaccaaatattccggacttggggggcatgtgttaacgaccaaatttggtaatatcagcatcggaaaagaggattagatcgaagtggagccgatggcggagatcgattcgagaacagagcaagaatcggctggagcccagatcggctacgattagtatcggttaagtccaagtcagactgggttaagtgatgcagccgattccgacaatacgacttgtattcgatatcgggtttgagttgacgtacttcaagatgattgccatacatggataaagtcctgggaaggcaattgtatctattaattatgatattttatataaattttttacagataaatatgggcaaaagtctgccgcaaggacttatggtatcttagagtttgttagagataatagtcgtgtccggtatggacatatcttgtaattctcgggtataaatagaccccgagccctatgtaatttttaacacacacgttcaatacaatttcggcgcatcgccaccctttttgctttagttttatttcgatgagttcttgctttcgggttgagctgcatcggtttcgatcttcaacaagaggtaaaacttgttatgtcggcttgtgttctcgggattagtccttccatctttatgatactctaattttgtttatgtaatttgctgagttatcatatatcttacataatctctaacgatatcgccatctagcctacaatcggctaacatctgttaatagagggcagccgattaggttaaatatcgatgttggtttagattatataagatatccaccactctatgaaacttccagcgacttgattgtctagatattgttcttcttttcatacttaatgttgtatcagttgagtttgatttattaagtcatgcttagaatatcaatctctagcctgccttctggttgccgattagggtagtatcggagtttcagctgatcttatctgatttaattatatttgctttatatgtttcattgacatgttaaatctgccctttatgtcaggatattattgcatctaagtatattaagcttatgtttggtatattctgtttgtttcaacatcttaacatagtgttgtattggagtattagccgatacatactagatctatccgatcggctatgctataaacatatatagttctgttattaatatatatttcaatctaagtgatttatactgtctcgacatggcgaccgatctatcccaatcactcaatttaagtatagatataaaattatatattgttgatatctacagccgatcgagtaggtttagtactttattatctatttataaccgccgatcgatttacatatgacatcggctcaaagataaatgatatgtcatcggcacttagccgatcgtctatcatttataggtttaaccgcggtttctttgtctctatttcttgttgattgcaggatcaaatcaactggcacgctaacacacccgaaggcgagctttggacctgcactagagttaagcagatctcccaggcctcatgttttacatcaacaaaagcttatctctctcttgaagagaagttcgaaaccttaaagaatagtgtctctctccctagcgaggcaccttgttccaaaattgttccaagcaatgaaccatgtgctaggtgtaaggatattgatattgatgcttgtgctactaactctacttccttaagtgctttgcaaaagcaaaatgagaagcttatgggactccttcacaatggcttgcttaagtgccatatgggtagtaaggtactaaagaaatacctaggctatcaaagggacaacttcaaccatgaaggccttgggtatgttcctccaccaaaaggaaaggtggacaagagtgtgttgatcaagaagccccaaggtcttagcatctttgttaaggccaaaagtatccttcctaatggtcatgcttcacattgtccttttgatgtatcatatgttcttaggaagaatgctagtggtcgtgtggttgctaaatatgttgggcctaggggcaaaaatgtttccatcaagagagttctttgggttcctaaggcacttgtcactaacataagatgacccaagaaagtgtgggtacctaaaactagaaattgatctcttgtaggaatatctctccggtggaagaagttgggtgattgatagtggatgcacaaatcacatgaccagagaagaatcaatgttttcttcccttgatccaaatggcactttgcaagagaacatactcttcgggtacgatggaaagggaaaagtaatgggattgggtaagattgcaatctccaatgatctttccatttctaacgtcctcttggtaaaatctctaaactataatctcttgtccatttctcaattatgttccatgggctacaattgtctttttaccgatgttgatgtgaccgtatttagaagggatgactcctcggtagtctttaagggtgttcttaaggggatgctttatcttgtggatttttcctcaactaaagccaaacatgagacatgcttagtggctaagtccgacatggggtggctttggcatcggaggctagcccatgttggtatgaggaatcttcacaagcttctaaagcacgatcacatccttggtctaacaaatgtactttttgagaaagatagggtgtgtagcgtgtgtcaagccaggaaacaaattggagctcatcgcccggtcaagaacgtaatgactactacaagaccgttggaacttcttcacatggacctcttcgggccaattgcttatctaagcattggaggtaacaaatatggtcttgttattgttgatgacttttcacgcttcacgtgggtgttcttgcatgacaagagtgagacacaagccatcttcaagaagtttgcaagaagagcccaaaacgagttcgacctcaagattaagaacatttgaagcgacaatggcaaggagttcaagaacacgtgcatcgagagtttccttgatgaagaaggcatcaagcatgagttctcggctccatactcacctcaacaaaatggagtagccgagaggaagaatcggactctcatcgacatggcgaggacaatgttggacgaatacaagacatcgcaccgcttttgggccgaagccatcaacaccgcatgtcacgtcatcaaccgcctctgtcttcaccgtcttcttaagaagagtccctatgagcttcttaccggtaacaaaccaaatgtctcttactttcgtgttttcggtagtaagtgctacattcttaataagaaggctagatcctcaaagtttgctcctaaagtggatgaagggttcttgcttgggtatgggttaaatgagtgtgcataccacgttttcaacaaaacctccggtattgttgagatcacgcgtgatgtgacatttgacgaaactaacggctctcaagtagatcaagttgactcgcatgtgttaggtgaagaggaggtccctagcgaagcaatcaagaggttggctcttggagacgtacgtcctagggagccacaacaaggggcctcttcctcaacacaagtggagccacctacatcgacccaagccgacgatccctctacttcaagcttggatcaaggtgaagaaggcgagcaagtgccaccctctccgataaatctagctcacccaagaatctaccaaagtatccaacgagatcaccccaccgacaatatcttaggagacatcaataagggagtatccactcgctctcgtattgcaaatttttgtgagcattactcgcttgtgtcttctcttgagcctctaagggtggaagaagctctaaatgatccagattgggtgatggtgatgcaagaggagttgaacaatttcacccggaatgaagtgtggactttggtggagcgaccttggcaaaatgtgattggcacgaagtggatcttccgcaacaagcaagacgaggccggggtcatgataaggaacaaggcgaggttagtggcgcaagggttcacccaaattgaaggattagatttcggtgaaacttttgagccagtagctagacttgagtcaattcgcatattgcttgcttttgctactagcctcaattttaagttatatcaaatggatgtcaaaagcgccttcctcaacaggcctatcaacgagttggtatacgtggagcaaccaccaagcttcgaggatacaaaatatcccaaccacatgtacaagctccacaaggcactctgcgggttaagcaagcccctagagcttggtatgagtgttttcgcaattttcttatgaaaaacggctttgagatcgggaaagccgattcaactctttttactaaaagacatgataatgatatttttatgtgccaaatatatgtcgatgacattatatttggttctactaacaagtcttttagtgaagagtttagtaggatgatgaccaagcgttttgagatgtcgatgatgagtgaattgaagttcttccttggccttcaaatcaagcaactcaaggtaggaagtttcatttgccaaacaaagtatttgaaggacatgctcaagaagtttggaatggagaatgcgaagccaatccacactcccatgccatcaaatggccattaaaagacgtcgaccaaaaggtataccgttccattattggatcactcctttacctttgtgcatctaggcccgatattatgattagtgtgcatgtgtgcaagatttcaagccgctctgaaggagtgtcaccttgtggccatgaagagaattcttagatatttagtgcacactcctaatctaggtctttggtatcctaagggagcgaggtttgatctcattggctatgccgatgcggattatgtcgggtgcaaagtggataggaaaagcacatcaggtacttgccaatttttgggtaggtcccttgtttcttggtcttccaagaagcaaaactccgtcaccctatccaccgccgaagcggaatacgtttcggctaggagttgttgtgctcaacttctttggatgaagcaaaccttgagagactatggcctaaatgtgtccaaaatcccactcatatgtgacaatgagagcgccattaagatagccaataaccacgtccaacattcccgaaccaaacatatagatattcgccaccatttcttgagagaccattccacaagaggcgacatagacatccaacatgtgagaaccgacaaacaattggcggatatcttcaccaagcctctagatgaagctaggttttgtgagttgagaaatgaactaaatatcttggattctcggaatgtggcttgatcttttgcatacatttattttcatttactagaataagtttgcatgccacatcatgacaaagtgcacattcaattcatgaatggacactagtcataatctatgtggatagcttgaatctatgtgtacgggggtctcattctctaatgaatcttggtccttgcacaatttgctatagattcgtacattccctctctcgagggtgctaagttatttctcttgtgctgcttttgcccaagtaatagtctagccatcaagttcattctctttgtgccatcctttattgtctctgccaaaggatgtcggactgtctgacatgatgtcagacaatccgaccacatcggatagtctgatttcaaatcagactatccgacgtggggccgagggcaaggggacttaacctccccaggggtaattttttttaccccttcacccatttggagcagtcgttttctctctccactcaaaactctagttcttggccaccaaaaatcttcgtttcgaagtctccgactgctattccttcgctttggggtggtttccctccctcaactccttccaaatcactggttccctagtgattttcttggtggttcttgaggtatttccttgtttttcttcgatctccgtcatggtgcattatttctatattcccttcggtgaaccatcttgttttagtgcctagacctagttcctagaagatcatttgattccatcggatatttttgtgtgaatcgagatttgttggtctagggcaaatggctgtcggaatgtctgatatgccatcagatagtccaacggcaaatcagactatccgacctccttttggcctagatcaaagttcttttgattcatgcctaaatattctccttccaagttattcttaatcattatcctctgttctaaatcagtgtatcctcatgatcaagggtcagttcaagaatcaagtttactctcgccgtgttccaatgagttctcgaggtcgttctcccacttccaaagctcgccatgctatacgtcgaatgtccgaatcccgcaaagatgctattgacacgcaagctcaagcctctgaagatatagcagctcaagtggcaaatgtggagcgaggtgctcctcttcccccctcgccgcagccgagtcagtggagaaggctcaagtgctccaactagcaaagtgaggcgaggcaaccccacggcttcttctgatctggggcaagatagtggttctcatgctccatcctttgaggaagagattcagttagaagaggacattgccgctcagcaagccgctcatgaagaagggcctttctttgtcactgctccctctagagatcctaattatcatcggagagtcacaaggtggaaccgcaagtggactgaagtggagaaagagcgtaagaaagatccctacaaatatcaacagttgtccactgatcctcggttttggaacctttttcagcaggactactatgagacagtgattgcacctaagaagggggcgattctcatgcagtgggttgattggaagtatatggaggagttgcatgatccaattattaatgaagtcattgaagcttgtgctcggcaaaacttgaaggaactaatgggcttgcaatacccatggtgcaaagagatcatcgcacaattctatgctaccgtttactttgagccaaacaaagaaaagattatccattggatgacagatggcatcatatactcagtgacatatgccaagtttgctgccattttggggtttccggctcgctctcgcaccaatcgtgtcaagattcatgatgagaagcccatggacacaaattctcttcacttcttgtaccaagatgtggactatgagttaggcaccatcaaaggtctccttcctttctatgcctatctcaacaagctcttgcgcaaaactcttaatcctaaggaaggtgatgctagcaatgtccttgcctatacaagaaatttgctccacaagatgaaggcacacccacagctctttgatgcttttgacttcatctttgaaaaaatctggcttatctccatgatacctaagcgaggacatggctatgggccttacattatgaagatgattgagattgtgtccaagaagaagtttcacaaggaagtggctcacaccggttaccaagttcgtcccatcaaggctgtttccgtgccggctggtcgaaccactcgtgcttcttctcgtgctggtccctccgctactgtcacctcgtcggactccaactcttctttgcggttcttcaagtccatctttaacatgtgcaaaaccatctcagttcatcaagccaaggaacgcagagcaaggaagaaggacactcggcggatcaagaacctccttcacaacgcccatttgctgttgacggagcgtggggctcctcaccgggagaccgcgcaggcccccctttgccggttcggccgggggcgctaagtgaggttcttcgccctcgatctgaggaacgtcagcgagagaggaattgcacaagacacgggcgacgtagacaggttcgggccgctgagaagcgtaacaccctactcctgtgttctggtggatctgtgcgtgaaggaatacagagagccggagagcgagagagagttcaggctctagaacccattcgccagagtcccaacccctttctcttttctctcctccttttttttccctctaggcctgggcctcctttttatctggtccggggtcaccacacgggcctcctgctgcctaagaaaagaaacatgctttttacaatgagggctagtctacatccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggaagagagccaggaagctctcatcattccgacgggacggggcgaggtgtgtgacaggccgcctgttgccacctaacccgcgatctgaccggtctgtgaccggtcacacaccgtgaccggtcacggaccggataagcgtgcactgcgccgcattaaatgcggcgtggcgcgctcgtccaacctgctataaatgcggttaggtgagcccggtgggcccacctaacccacacacgtggcgccaaaaccacagggggtcggggcgccccagccctcggggccgaaacgggagtggcccgacccctcggggagacagagggaggggtggccacgtcaccctcgggcccgacccccccgagggggtcaggccacgtgggtgaccgcggctacccaagcctctagtcacgatacccccggccccatgtcaccgacagctgtgttctcccgatgggtttgaggttgaggacagtggggaggatgtatttgaggacccctttgcagctgaggcaagctcctctcgtgcagatcgtggcaaggctcctatggaagaagaagaagaagaagaggaggaagatgacaatgatgaggagtcaagtgaggaggacaaggattttgatgaggatgagtgatccactctcttttcccttttagtgccttgatgccaaagggggagaaccaacctacctatcaaaacttttaaaaaaaatctatctcgttttcgtggtggctagttgaacattgggcttttgtgtcatgtttaaagtctttattatgcatgtttatgtcttgttgaacctcgcagacttggatgatgttatgtgcatgttatatgaaattatctcttatccatgcttaaatgagtgatgtatcttgtcatatgcatatgcatgaggttatattgtgatttctaatcttttgcatagattaagggggagctctcatattcttttctagcttatctttagggggagctccacctaaatcctaatcttttattatttctaattgtgttgtcatcaatcaccaaaaagggggagattgaaagtgcatctaggacccctcatttattttggtgtttatgacaacacaattagaggttcactaatgctctttgttgagatggatgcaaggataaaaaggagtggaacttgaatttacaagctttgcggcatattttctggtaattgtcttctattccatgtatatcttgtgttttgtattaggatgccgtactattaagagggataccacatgcatataattggtagaacactagttctcaaaatcctttatttggactgttcctattttattcctgtcagactatccgatcctgatcagactatccgatgctcagactatccgaaatttcttagaactttgccctctatctttggtctgagtgttggctaaaaaatatcggactatccgatataaggtcggattgtccgatacatcggactgtctgaactttctcagaacttcactctctgtcttgaattgctttttattcctcttgagtgatttttcaaatcagacaatccaatgtgatcggagtatcggatgacccagagactccgaaattcaatggaacttgagtccctgtgagaggatgaaattcatgattcaaaaataacggaatatccgatatgacatcgaactatccgatctatcggattgtccgaaattctccagaatttcgttctctgtctctggcatgcttgggggtcaaaaacatcggactatccgatgtcacctcggactttccgaggtgggatgaaaatattctctcccaatggccacattttgggggatctataaataccccccacctaacccttttctagggttacccaactcattcattcacattcactttgggttgagcttggtgctaaggtgctttggatatttgagctctttctccctctctcaaatccctcctcgttctttgtgtggtggatcttggtggttgtggatttggtgtttgagggcctactgtctgtttcactcgatcttgagcactagggtttgaccaagagttgtgtggtgtttgttactcttggaggttgaggactcctagacggctaggtgttactcccgagccaccgatctacgtgtggttggccgggagaagtttgtgaaggccggatctcgcctccgcaaggaaagagataccccttagtggaaggaggagtgcttagtgcaacctcttgaggaaagggttagcaaagaccccgctcttagtgagctcctcaacggagagtagaatcccctcaaggatttgaactccgggaacaactcggtgaacttcattgttggtgatatctcttcatcccttctttagctttgcttaattgtgccgctatagatctagtcagtgtttgcgctatactcctgtttgtgcactagatctacttgtgtttctttagtggatcagacagtctgatccaacatcagactatctgatattttcggatagtctgactgtggatcaaactttctgaccctaactcagttttagcttccgcataaagttttaaattagcctattcatcacccctctaggcctatttgaccatttcacaccccccccccctctaggctacatctttgcgtgttcaggtgcttggatgtacgcgtgggcctagacaagcaagggaaggtcttcgacacggcctttcctatgttatactagatgatttgggaagagagaaatgcatggtgttcgaggcagttgaataaagagtgaagtagttgatgccctcacaaaagaatggtggacttggaggattggtttgcttgatgcgatgctcacgccacaatagacattgttcccttatcgtaatcacgcatgggtgctgagccgggacgccctagtccgtgcttacttggtaggtgactcaggggcggacgtacccattgagcggcatggggcgatcggcccagctatggcatgcgtcgccccaacccctcatattctccttgggccgcttaccaccacattttattcataattggcccataagtgagaagcccgactgtccaatttaggattttcaggaaattagggagtctatctataggcacacatgtgtgcgactcctcggtaacggcgccatcaacgcttcgtctccaccgtgaccgcgactctgcatgccgcgctcgtctcgctacttgcactcttgtaacatactcaaattctagaccttaaaaatttcatgtcaaaatagttggaagctaacttttccatttttgtggaccaaaattttccattttaaacctagttgaagttgatctaattcttgcatgaataaaaatttgagggcgaattaaaacattttttatttataacctatgacaaaaatgcaacacaagtgaaagcatgcaaacttgcataaaacatgttttgacttgagtccttcatgtgcatttggattttcgatttgtatttcataataggtctcatgaataataactcaaatctagataaacaactaaaccatcagagcctagtgctaactattggaaaataatacataggaaccatagtacaccttaaaatatatcaacaaggccgatgtcaagccccacaaaactaatttggtcatccatctaaagacaagtcatgaacatgaaagtgaataaataaattaactcatatagggtaaattctatcttaatcgtctctataagcattctcttaatttatactaaagtaaacttatacataaataggtaagaagcttatgacatgtgtaaggtaaactgtaattctaacatatcaacatcatctcaggttaagaagagtccaaatataacttttataaacatttacatacatttaggaaagggaaacacatataagagataagtcttgctaattatctaaaataatttgtgcaagataaaatcatgggaaaattcatgtacgctcacttaacatatacaacacacagtaattttgatacaatttaataactaaatttgatacctcaaataaatcaatcaaaccagtcgaataatagactattcctaatcggcaaaaaccatactttatttaaaagtgcatttaactgcatggaagtgtatagagaaaataatttattcaaatactagttcaattatcatgagtaaatataatttttccagaatttatttcctttgtttagctcttctaaaaattctaactagtttccaacgagcccatcgtctgctaatttctgtgagtaatctatccatatatttttagtgcaaccaaagaaaatggaatctaataaatggaatctgaggtatctttatctacctccactaaaatccacatgaattgatctgcgacacaaattaatgaatgaattaacaaagaagggaagagaaatatatcctggaaaatcgtccaaaaatcaagtctacctatgtttctacccttccctttctccctaaccttggtctcatcgttttgggcccactcatcagtggctgtggctcgcttcctctctgtgcaactcctccaaccgaccagcagacaagagagaacgtgagagggagatatcggcgccgacaactctcaggcgcgctcgacgcgtgtacatcgctgtggcaacgccgagtgtggaagcgaggaactcctacagagaggaggttacgtgttgataataatgccacaaaccaggcaacaggatacaagagataaatagcttcagtgagagtttgttgtgtacagctaaatttcagaaattgatcctatcttgtctaactaacacaacaaactctatcctcagccatacgggagcattatcacatgtacatgcaatatatccgaactctaacactccccctcaatcttatcctgtaaggtttagatttttcctaaacatctctaactgtttaacagttagagtcttggtgaatccatctgcaacttgatcatttgtggatatgtattctacctgtaacaacttccgtgcaactcgttctcgaacaaaatgatagtccacttcaatatgctttgtacgagcacgaaacataggattagctgtcatatatgttgcaccaatgttgtcacaccataccttagctgttttaggcgcttgaactcccaactcatgaagtaaggtctatatccacataatcttagcagttgcattagccaatgccttatattctgcttctgtacttgaactagacacagtagcttgcttacgtgcactccatgacacaagattgggtcctataaacacagcaaagcctccagttgatagcctgtcatccaaacatcctgcccaatctgcatcagaaaacgcactaacaagcaaggagttagatttactaatctttaaaccaagcttaactgtatgctttagatatctcagaatcctcttggcaacagcccaatgttctgttgttggagcatgcaaatactgacatactttgttcactgaaaaagatagatccggtctagtcagagtcagatattgcaaagcaccaacaaggtttctataccttgtactatccactggtccaagaggtgtcccttcatgagcacttaacttttatgagatagataaaggagtattaacagctttgcaatcactcatgttaacccgttttaacacatccttagcatatttttcttgtgccaaaactataccatcattttctttcttaacctcaattcctaggaagtaatgtaactcacctagatccttcagtgcaactcttgattaagattcttcaacaaggtgtcagtggcactgttagatgagctagctattataatatcatctatatacaccaacataaacattgtaacatctctcttgctataaaagaacaaagatgtatctgatttagatgacttgaaccctagctcacacaattttgtacttagcctagagtgccatgctctgggagcctgtttcaaaccatacaaggccttatcaagtttgcacacataattaccttgttcataaccaggtagttgcctcatgtaaaattcctcttctaaaattccatgaaagaaagcattctgcacatctagctgacgcagtgtccatcctctagagacagctatagacagtatggtcctgatagtagcagccttgactataggactaaaggtatcttcatagtctataccatatctttgtttgaacccttctgctacaagtctagccttatatctgtctagactgccatcagctttcctcttaattttatatacccacttacaatctatcacatttaaacctctcttgggaggtactagatgccaagttttatttttcataacagcatgatattcactatccattgcctctttccaatgtttatcccctagagcctcatccaaagtttgtggttccccagaagatgtaaagcaactatatctaacagtaccatcagtataaattttatcctttctaatgccactttgtaacctggttttcggtctcattacctcagtagacacaccctgttgtgcggcctccatttgcacagatgatccaggtggatgggactgctgcacgtcctgctctgggcacgtgatgatgctgctgggctagcggggagagttgacggcaggcgacgtgccagcttctgactggcctcccatcggcgaacgcgtcggacgcgcaggagagcgctgctgctagtccccctggattccagatcccgagcctgctgtcccatcatgcgctactgccgagggggattctcccgccgaaaccgccggcgctccgtgcacccggctgtgcgtagcagccacactcgcctgatctttcatttccattgcagttttctgcgctgttcctatcataagattctacagctatacaagcatcatcagtagcatttggtacatgaatattaaacatttgatcatactgttcctctcccccttgatccaatgtgttattcataagattagaaggaagcaaggagatttcagctctaagacgggcaccggcatttggatgaagtgttgcaaagggaaaaacttgttcatcgaacgtgacatcatgagaaacatacaccctgccggaagacacatctaggcacttgaaccccttgtggagattgctaaaaccaggaaacacacattgcttggatcgaaattagagtttatgagagttatagggacggagatttggccaacaagcacaaccaaaggttctgagggatttatagtcaggagcttgcttaaacaatcgctcaagaggagtatcgaaatttataactttactaggaagacgatttatgagatagcaagctgctagaaatgcttcatcccataatttaagtggcatagaagcatgggctaggagagctaaaccaacctctactatgtgacgatgtttacgctcaacagctccattttgttgatgtgtatgaggacaagacacatgatgtgatatgcctatctcattaaagaaggtgtttaacttgacatattcacctccccaatcggtttgcatagcaagaatcctcctatcaaattgtctttcaaaaagtttttgaaacttatgaaattcctggaaaacctcatatttgtgcttaaggaaatagatccaaacaaattcgtcgcaatcatcaataaaactgacataatatatctttgcccctacagaagtagaagcaggtccccatacatcggagtgaataagttccaaaggattatttgaaacactagatgatctaggaaaaggcaactgatgacattttgcctgttgacaggcatcacacacagactcattgactgaattgctaagacatggtaatttattttgactaaggattctaagaacgattggtttggaggagtgaccaagacgaccatgccaccgttcaaacgatggcgcagcagcgaaggcttgtctcaagggtgtgccgacaggaagagggtagagacccagctagcatggtccttcaagaattgtccttctcatggccttgtccttaatcaaaaaatattttccatgaatatcaagaaaagcataattatctgcaacaagtctatgaacaaagactagatttttcgatgcttgtggaacatgaagtatgtttttgagatgtaaaggacaactaggggtaggaacaatggtatgaacaatgtgtttaacattcataccttcgccactgaccgtgtggatcagatctgttcctttgtacttctcccttgtggtcagcttgtccagctgccctgtgatgtgatctgttgccctagtgtcaacataccagtttgtgtcgacaccataggcatatgtggccgcaccacccagcttctcgtcggggccgtagttctcatcgtagcgatgccagcagtcacttgcaacatgacctcttttgtgacagacttggcacaccgggcgagtgtcattgccacgccctcgcccaggattggcaccgcctgtgttcccacggccaccaccacggccgccgtgaggtgcgctgctgcgcccgccacgatttccaccacggccaccacgaccaccgcgatttgcagcgttcgccgacgtggtgaggtaggcttgacgaatccgaatcctgttttcataactcaagagttgagaatacacatgagaaattgaaaggggtgcgattcttgctgttgccatcaatccttcaactgttgcgtcgaagtcggagttgaggccgttgatgatgtacgctatcagctcttcatcgtcaagaggcttccctgcacccgccatctcgtcgccaagagatcgcatcttggcgatgtactcggagatggaaatgggtcccttctgagttgtcgttagtgcaaggagaacgttgatggcaccagctttggacttgcaggtgaacatgtcgttgatcatgctccatgcttgggccgccgtctttgcgccagccacctgctgcaggacctcccgtgacagggaggagaagaggaaccccagcacctgttggtcctgggtgaaccacttgatgtattctggattggagatggtggtcttgactttcttgtcgccatcttctttctcacactcggccgccggagcttcagctgtgccggtgatgtacccttctagctgcgcaccccgtagggtggtaaggatttgtgcagaccagagggagtgattttgcttggtgaatttctccaagatttggatcccgaacaatgggttggagatcaccaccgctgaggaagaactcgccattgcagagatgcagaaacgagctaatctaatctagcggggtgctctgataccatgtggaagcgaggaactcctacagagaggaggttacgtgttgataataatgccacaaaccgggcgacaggatacaagagataaatagcttcggtgagagtttgttgtgtacagctaaattacagagattgatcctatcttgtctaactaacacaacaaactctatcctcagccatacgggagcattatcacatgtacatgcaatatatccgaactctaacaccgagctcactctccatctctcccacagtcgcatcgcctcgcctcatcctccagtcctgtgccgagagaaccgagggagagagctcttgctgctctcctcgccttcgatctcaccaccagccgtgacaaagacgatgctcgtcgtcgccgacgagtcttcgccaaccctatctcttccacgttccatactctcctcaccatgcccaagattctccttttgatttcatcctctttcgtacagcgaatcaacgggaacgccactgtgtcatcgccggccttggggcgtgctctgcgcgacgccgttgtgacctcgtcgctgttcccgtcgttctggaccaaatcaagcagagccatcgcgccatcaactcctccatgagatcctcttaaaaacccctcaagaaccgagaagaatggagcaccatggacggagatcggcctccatcgtcttcaacttcggccactgtcgccatgaccaaattctccttcgctggtgagcccctcatcgattctttgcacatgcaccatctatgggacctaatcaacctcttggacatgcatgcatgtgtttgtatcataatttggcttatagttagttcatttgtgcaggccaaattattttggaatagatggtgaaattatcttatgatttgcttgaaatcaattcagtttacatgtgtagaatttgtgatgcaatagatggttccatgtaaattggagggtggctttatcatttgatcatgtgagggagttaaagttgcttgatgccagtctgaaagcagaagcagagcaggagtcagatgcatgcaaatttgcagatccttgaggagttcgtgttgctgaccgaacaaatttgggtgccgctgcgtcccgcgtgcgatatggagttttggcgtcggttggcaggagatgggatcatgggaaccggtgagttagcgcgttcagcggtaaagataagaatggatttttattagtttatttccttgtttattttgtgtgggaccattatcattttgccggtatatactccctccgtttcgaaatgtttgacaccgttgactttttagcatatgtttgactgttcatcttatttaaaaacttttgtgaaatatgtaaaattatatgcctacataaaaatatatttaacaatgaatcaaatgataggaaaagaattaataattacttaaattttttgaataagacgaacggtcaaacatgtgctaaaaagtcaacggcgccagacatttcgaaacggagggagtatatcggtaacagtagaacgggagaacccccaacaatctatcaatctactatttttctcattctttacttttccgttattttctattttgttttcatagctggattctagcaatcctaggatttggttaacctttgccattttgtgctgaaaaacggtcgtgcttctccacgaaagcgaggaggttattgtcgaaagaaattttcggcaatatgaaaaggggatagcgcacgagacctaaaagtggatggatgcggagacaaggatttagacaggttcaggccctctcaatgagaggtaataccctactcctgtttggggatttaagtccgccgggtgtattatagatctgacgatctagttgtctcatgccgcctagagggcctcctgcccaccttatataggatgggggcaggattacaagatagaaaccttaaccaatacggtatcggtttcctaaatctactttacaatcttatcaaaccaggactttaggccgttccataatatacagggaaacgtaatatccaagttatgatccgttacatatttcatagatataagttatcccctataaccagtcggataaccacgccgtgtgggtatggggtacccataatctccatagtagcccctgaaaccttcgcagtcgaaaagataatcttctctcaaatcagattactccaaagccgagtgcttcaatcatcttcgtcatggtctcccgagtacttttaccaaatctgaagactgtggagggctgaaaaataaagtcaggtgcatcgactagatgcaccaaataggtgtagctcccgactatgtggttaattgaacaaaccaagcatatagttaaggaataaataatccaaccaactgagtggtttttgataattatagtcaaccaagtgacttgataccaatatatagcatatgcggtgtgaatccccgaataatatgatccagatgatataccgactgctttgcagaatatgatgcgtgcaacctaaagttgacaatatctttgaaaattcacatagcataacagctataaagaagagcttgctgttgtgaataaagaaacttccaaattattgggcatacaccacacgcacactgctttaacagatgtgcttaagtccctaaaagacacatggtttcaccacagttatctttgctagtttgcccagaaactaatcgtttgtcgtcacgtaattatgatatttatcatttttctaatttgcttgtaaattagtcgtgtgattccgcggaagtgaattaatctcgaaatcggtttcattagccgatctatcgattttgaggactctattatttacaccgcaaatcgttaggtgatcatatgttgataaaaaaacgtcaacagcatggccactcttcaagtagattgaaccgacgccgttacctcggaggttcttgccgctgccgtcatgtccgtccatcgtcaagatcccgtcgggcctctgtaagccattttcaagcttcggtgagcacccttgagtaccttaagaccacatgcatgcactatctcacatcacattgctctagaactcgacatgcacaagcaacccgagacatgccgctgtttccaccatcgccaccatctattctgtccactatggcttgtaacaagaccaccattggctttgcaaagaactcatctaaattttctatttttaccccaacgtcatccgagccacctatcgccgccggcaagctcgccaagctcacgaccactcctccctgtacatcggcggctggaggttgaagacaaggaccctgtcttgtagtaaactaaaagcttagggtttaaagcgtaaagcactagagacttacatgtggggcctagtactgcgagttcatttatggaaaaactagggacctttctgcaaaacagtaagagactgacagtggacccctggagataaaatcggagaatatacaagagaaatacctagaacttgtaaaatccatataaaatcaaatatagattattttgagatgattcaaatttctgtgaactcactagattatgaaatttaaagttatgaaataaaaactttcactcacagtacaaatttcacctctaaaattcatctaagttaaatcacacataaagcatgcacaaacttataaaaatatatggaaaattgacttcaacctattttgggataaactcaaattccacagaatcacaaacttatgctctcctgtagaataaaataaaaaggtatacttgctttgcatcaaatgcctctaaaactattacctttaaaataactagttttatataagctgaactttagaaattcatataaaattcatcttagatcctttttgagtaaacccaagttctgtagaataaccaaaacatatacttccaagttgtaaaataaaagtatatacttactgtatgataaaagcctctaaatatttatgtaagtaataaccaatatagagcaacctttaatttgtaaaatttgtagaaaattcatctttagtccaaatggagtgaaccaaatttctatagaaccagcaagtaatataatttaacatagtagagtaaaatatggcaccttctgtacaggtttcaactctaaactttaaatttataggataggttctaatcacatagtattgattaagcaatacatatatataaatgcatatagaaacacactctagctataatgaaacccaaataaaacttgttgaaccaatgaaggcatagatccatcccttccaccaaaacttagtacactttaatcatatattaattcctcttgtttataaaaatatgaactaaaataataaaagtcctaaacttgtgaactagggatagattagttaacaaaattatttgcttcattcatcacaattaaagtagaataagttttggacttcaaatatcaaaggcatgtgcatatagaacactatacgcctacaatacgttataacttgtaaaatacataaagaattcatattaactccaaaagttatgaaactaaatgtgttagtcttaaaaatacagatcttcacctcagcaaatataaacttaataagaatcaccttacaacaaattcagaatagtacctaagtaaatcctatattataccgagtaaacttctaaatttcataactcccaaataaaaagagataaaataggaattctttcacctaaattcatcttagaccagtacctatccactgtgcacaaatcatgcattttagagcattttggatttttcgcataattcggtgtttaattacataacgtgtactttgtatagatgattgcttaaacggtgaagaagtgattttggtgctaactttttccaagttacaaggcaagtcccacctccctctctctttgatcactttgaacctatgttttagaggttattgaaaatgtttgcaaatcttgcatgtcgattgtacactaataaattataattttgttaaacttgttagacaaacttctactacttgcattatcaccttaaccccacgtatatccatatccccattcctaaccttaggaataatataattataacactttatatatgagttttgatgtcactaggttactataatgcttagccatgcttagaatgatcttccttgtcattatgggctcattacaaatatgaaaattgattttgaaataatctggacagaattttaatacttgtgattttgataaataaaatgatggaaaacatagattctaggtttgggccttaagtggtgcacatatggtgattagttgtgtaccgatagggggagagtgcgcctaaaccgacctaaggacttcactcaatgtcagttcatttcgtatacagtataaccacatgtgctagtatgggatagcccaagattagtaaattatttatggtttagccttacattctggtaggccggtgtatatgagttcgaataattcaaaggagcttcctatttaccccgatgtggtagtttaggtgactaagcgtgtccaatacaatggtattgtgccacgtggtgggttcccgttgtgtccgccaccacagtgttaagtttaaggcgtgggcccgccacttaacggttctaggttatataacgtgtatggcttaggatggagtaacacatatcgtgctggtgtaaggctaaatcatgaattttggaaaaacgttgatgcgggtaataaatcgggtacttatgtatcgcgtgccatgctcttgcatgattattatttcgcatcatgtgggtaaagtgtacaaactcttcagagttaaaactaatcaattagccgtgctcgcggttatgagcggtgtgtggatatgtattgagtatagacttgtgtttattcttctaaatgctgaattttatcttcaaattatgatgagatttgagaatgatctccttgctgccgtggatggcaatgaggtgtatatttatacatgattaatgtctactttgatgcccatatgctaagtactagcttgctgaaatttatttgaaagcaaatctgatttgaatgtgttttatgcaaataaaacttgctttatgctaaaaaaatccatattatgccttccttgattatatgccttgcaagtagggtgttagttttgtcttggtgcttgccagtacattattctaataatgtactgactcttgctattggattaaccttttgcttgcaggttgtaaacttagtcttttgagtgatgcgggtaatcgattgcttcttctaggacttaaacttaatggggtaaacgtctagtcggtgtgcttggggattgggtagacaagcttccgatgttccctcatacatctatttggccgatcggcctatgtatctctaaagtagttgtaaattttaatcgctttcatctgaaatgtgtttgctatgtatgtccatacttaagatgaaagtgtgaatctagtgcacatcctgagaactaaattcacatgagtatgagttaagaatgtttgagatgatatagatctttagcctttttttgtcaagtctcctaaatgtgtaacacatctggtcgctgccttcgagtagtttgacgggcacatctcaggctgaagttgactggcaggctaaagacccagcaatgcctccaatattcttctctcgagacgtcgaatgtttcattatatttatttgatgatataaattattcacttcatctatataatgggaggtcaagagagcctacgacaactctccgcaccgcacggtgcacgcgacacctagccacggcctgccggcgttgagcgacggctggctcctcgcagccaatagctcgctcctcgccttctctcctcctgcttggtgctaagctgacaatgcgatgctgtcactgtcgcagtccggccgtgctagccccaccaccgtctagtccggccggccggccatccccgtgcggccatgctgccgtgcggccaacagtccgcagcagtgcaacactgcagcagctagcagcctagcgcccgacaggccagccgccagggccaagcgcaagcaacacgtgcagacacgtgcaggacatcgtcatttgtggtggctagctgcctagcggctagcgcctaatcgatttcgtcctgctgctatggtctatggacatagaggaacagggataaggacatggtgtggtcacgcacatacatacatacatacatacatatatatatatatattaaagatatctatcgaccatgttttataaaatttttggtgtatgatgaattatgtatggcgcaaaaaatattactttattttaaaatggttttgtctgtaattatactatatttttatgcgattatagtatagatatggtatttgttgtgcttagttggccttatgaaacaaacattttcgttaaatcttatttttaatccagcttccgccactcactcctcctaatggttctaagcagtgtgacttttagattttcttttcagtaactttcctattgaactttgtaacaacattttatttgatcttactaaatctaggccggcttcttcatgggccggtgtaaatagaatggaattctcttgcatatttacagaatatacaacgagtcaaggaagcccttgtttagtttccaactttttcttcaaactttcaattttttcatcacatcaaaacttttctacacacacaaatttccaacttttccgtcacatcgttccaatttcaaccaaacttttaattttggcgtgaactaaacacacccgaagatagatttagataggttatggctatgtttagatccaagggtgaaaagttttggcgtgtcatatcggatatacggacacacatttgaagtattaaacgtagactaataataaaataaattacagatttcgcctgtaaactgagaaacgaatttattaagcctaattaatctgttattagcaaatatttactgtagcatcacattatcaaatcatggactaattaggtttaaaaaattcgtctcataatttacacgcaatctgtgtaattatttatctatttttttctatatttaatactctatacatgtatctaaatattcgatgtgacatggtgaaaaattttaaagtgaatctaaacatggcctacatacatttggttttgtaatttgtagcgtgtaacttggactgccgttcttctataaaattctttattgctggccagaaccaatagtgcttcctaaaaaaaaaggaacaagtgaaatcttctgtcctctggagcagaaacgtagaggagacgtatctgatggtcaaccctcagcactgtcagcgggcggccgaaatggataaaccagcgccgcaggcgttcgtataccgtatcagcacggcggatgagtgggcgcagcttcagcgcaccggcggcacccttggcggtgacctcgaccgctccaccggctgtatccacctcagcgacctcagtcaggtaattcccaattagaaagcagggacgtctgatttcttccgactcgcgggatccccatggatctctctatttatcatatgcacatttcaagtggagatttgggcctagtcattggttctctgatttttcagtggatctagggtgctagactactttgctgaaaattgctgtttaaaattagggataaagccatccaaatattacaacccaggcttggaggttggacgcaaatcagtaatgctattagaggtgcctctcgcagcatgtgtgatttcatcttttgtttgcctacagagcttcgtgtggagatctcctgcttcttgcgtgtgtccaattggccatcctagatgccatttcctttggaatcttttgattcatttagggcatccacaatgttagaaaaaagcaggtagtaggcaatatactattcctatgacttagtaataagcattgtggaagtgggtagtaactaatgctcggtactaagcttatgacccactcataagaataaaaaaacattaaaatctctctcactctctccttccaacacaagatgtgctactactacatgctgagttggacaaaaagcaactaaaaagcaatatttttttctcatgcgacccactttacaaaggcctactacttagccctgctacttattacttagttaggtaagatacattgctgttgcccttaggatgtttctgagcagtgaccgtaacaaagcagtgaagaataatctatattatctataactagcatggtggcccgtgcagattgcgcgggtagcatcattatattttctctcatataatagcatatatgttttcccattatattattcaaatatattaaaattacaacataatttaaattttgcaataactttacaaaactactaatgtataatattcatattatattttatatacgtgttagttattagttatttttaatatcaaattttagttatttgtaaattatataaattcctctatggactctagactcgtcttttaatattttttaattccgaattttctgtaaattgtatttttatatagactctatgctcttcttccaatattatttatttttatttctgaatttttattatttctaattgtatttctatgtggactctaaactcatctttcaatattctttaatttttaattttgaattttagttacttctaaattgtattcctatattgactttaaactcttcttcccatgttttcttaatttctaattttagttatttgtaaattgtatttttatacggactctaaactctacttttaattttattatgtttattccaaattttagttagttttaaattcctatatggactctatactctacttctaatattccttatttttttaattctgaatttctatttttttcttaattgtatttatatatggactctatactctacttctaatattccttatttttaattccatatttctattatttcctaattgtatttctatatggactctatactctacttctaatattccttatttttaattccaaatttcagttatttcctaattttatttctgtatggactctatactctacttctaatattccttatttttaattccgaatttcagttatttcctaattttatttctgtatggactctatactctacttctaatattccttatttttaattccgaatttcagttatttcctaattgtatttctacatggactctagtctcctcttctaatattccttattttttaattccgaatttcaactatttctaaattgtatttctatatggactttagtctcatgttctaatattccttattttttaattccgaatttcagctatttctacattctatttctatatggactctactttttctttttctccgattaaagtgagaatttctaggccatgagagcgaacgtggatgcttctttttctattcctttaataatataatagataatgtgcggaagtcgttctgtttggctttagaaggacatactatttcccttgattgctttgacagacatgcaaattggtgcccatttgtagtttatgcaaacaggttgtaggtaaatgctagcgaaaagaaaacatggcatctcattatatcaggatgttaaatttcagaaattgtggcctattaagaaagggcctgctattcatattgcgttctttggctgtgttttcatatatgatatatggaaatggttttgcttactcaacaatcccatatacatttctaaactgtgacacctattgtttggtacactcaagttctacaaaacaattttgtgcaaaagtatgttactactattgcatataagtacttcaatttatatacttttcgtgatacactgaataatatatttgtcttgtaatttgatctgggcgttgtttatatatgacctccaaccattcctttttggcactgtatatgtattctttagaactcattctcaacctgttttaggtgaggaaaacgcttaagaactttttcctaggaaggaatgatctatacctactacaagttgacacttccaaggtaacgtgtgtcagtgtatttaaactccattggatgtagtcacataatagatcattttaaattaaactagttgcgcggctagcacccatataaaattatatatttttttaatatgattttacttaaaacttattagataactatcttgttgtcttaagacttaagactttgaaagaccaaactttattatccctgtgtttttaattttatagtttttaaaagtcataccaattgctacaactttcttttgtcatttcttttttttatttgctaactcgatctaccactttttctattcattctccttagaacctttacaaattggatcgtatagtttttagagtttattgtctcgttgggtttcgtttttataatttttagaagtcccatcaaacgctgccattatactcctctacagctcatccactgcttcttctgtttattgtcattgggattttaaaagtcgaatgtaattatcgattgggttcagtttttactttctagaagtcccaccaaaccataagtgactttgccactgtactcctctacggctcacccactgtctcccttctttattgctattgcgattttaaaatcaaacatgattattcttttaccttttagaagtcctgaacctttaaaaattggacctcgtagtttttaaagtttattgtctcgttgggtttcattttttataacttttagaagtcctgtcaaacactgccactatactactctacgactcgtctgccgcttactctttgttgtcattgggattgtaaaatttgaacataactatcattggaattcattttttactttctagaagtcccaccaaccgtcgacggctctgccattgtactcttgtacaacccgcccgccgcctcttctttttattgccattgagattttaaaaattgaatattattatatcattatgcttttttactctctaagaagtcccgccgaccgccttgacctgttacttcacggcctacgcgttatccctcctattaatcgtcattaggattacatttggtgttttattaatagttttttagatgtcacatcaaccgccaccactctaattttgattttttttattttttttattctgaatttttataatctcgtattgggattttatatggtctcttcttttaatattgcttaattttaattccgaattttagttatttttaaattgtatttctactcgaactcttcttttcctttttttttttgctaattttggattttatttttttatttttaattttgattaatctcgtattgggttcttatagggcctcttgtttcaatattgcttatttttaatttcgaatttcagctattttaaaattgtatttctagttggactcttcttttctttttctccgattaatgtggaaatttctagcccccacagcgaacgtggtgtcttctttcaaagttgttttaataatataatagatggatacttcagaacgcaccaggtttttttttatctctattcatgaacaaaaactatacatgtattttgccctggtaactaggcaagtagcaagcccatgcctgtttgtatttcagtagaattcatctgttcgttttgccacttcacattcatagcattttctcttcttgtttgttgtagctttcagatggcttagtttatgaggcagctgatgattcaaactattttcctcatttctatggccctggtcggagttttgcacctcttcaactagacgctgttatcaaggaggcagagaaaatagttctggtaaacaatgatttcacctgcagtctacttgatggagcagaccccttatcgtgatgtgtaagggtgacctttcccttgatctttataatgttttgaaaaattcgctacaggacgctcaaaagtttgcagttatttgtaaaaaaagctgcaaaaatgcaaaaatattactgctccatatctaacatctccaggaagttgaacctggtatattccaaggatcatagtaagggcagacatattgtatgcatcatatttataaacatcattgcatattcttcagtagccttaactgtatgccaagagacaatcttattttttgatcaccccaccaaattaatgtgaagaatgatagctgtataatctctaattcctgttaaaaagggtgcaaacttgaagtattgattagttctcaaatggttccaatagtacgtttattgtgagaattttgtatcagcaagttattccatttaaacttccatgagttctcaattatgcacgaggtcttttagggacaaatcactcttttttataggattaaacattgttctttctttcctccaatgttttcttttccatgccaatcgctttttgaaaacttgcacgcgtgtacgcatagctccagtgcggatgtgtttcatcatgtcgctaatgagcatcaatatgttcctaacccgtgaagctgctatatagggttgtgtcttggtaggttgaatacttgaatggtacaggttgtgttctcaattttgccctcgccgcagcccacgtcacgccaccgagtgaacagcagaactgcacgtagcacgcatatactgcagcgcacacacatagtatacttaccgtatacgtatggcacacgtaatgaacttctcattttaaaattggtatcgatcggtcaattatggtcatccagtttattaattgttctggcactaaaaaataagctgattaggttgctcgatcaacccatttgtctatccaagtcagaccatcaaaatacataggctgtgtttagatccaaagatccaaacttcagtcattttctatcacatcaatctgttatacacacataacttttcaatcacatcatctctaattttaactaaaatctaaattttgtgtttaactaaacacagccataattaatttgtatatgtcgttcacctcttgccaaaaaacaaaggcatcctctgaatctcggtttagggatatatcagtggaaaatttcatctgcaaatgtcatttgcaggtacatcaaagtacatcatgctcatgtgaataaaatttgatataggtgaacaaacagtatcacatttaacccggtgatatataccagcttggtgatatattaaatttataaagaattaatttgtgtatgtagtactccctctgtctaatatgatacatctacatcgctaaattagttttattaaatataacattgaatatatttttaataatatgtttattttgtgttaaaaatattattatattttcctatagattaggttaaatttaaaagagttttactagaaaaaataaagtgacatataatataaaacaaaggcaatacttacctagtaaatatttttgtaccaatgacatgttccttttctcataaataattaaaagtgcaacctatttaacgcagagctgaaattttgaatggatttgcatgtatttctagctgtaccgatgtaatatagtattattagggcaagtttggtatagttccaactcctaaatttagctccaggagttgggtctggagtagagttgtggagtagcctaaatccagctccaactctctagcttattttgtgagagatcttcacctagtgcagctcccattttagctgtaactgaaactgtttggctgagcatcagtccaagagagttggagaactggagttggagctgtgccaaacatgcccttagattaacgtttgaatttactttcatatagcatatgagaattaaagctaaaaattagttttacttgaagaccatgataaatttaactatgctttatattatgagatagcagggagtactaaagacaaattatcctgccatttaccataggaaaagtatgaattatccctctgaactattgcgacagtacgaattaccccctgaaccacaaaaccacacatattaaacctcgaactattgataccggacaaattaccccactgactcaatcctgagcggtttttctcctacgtgccatacacatggcgtcgacgtggaaatccaattagcaaaaagaaataaaagaaaaaatagggcccacctgtcattacccctctcccctcttccccttcccccttctctctctcgggcgcgcgtggacgggcagtgggcggcggcagcgacgtgcggacgggcggtcggcgtgtggggggcggcggcagagcacgggaatggcacggtgtgcggcgctgaggagggtgttggaggaggccagctacgtcatcatcatcatccctctctctctctctcctcaggctagcggcgagcccggtggggagggcgagacgagtagcgggcggcgctaaggacattggagatggtaggcgtctctctctccccctcgttctctctctctctatggcgccgtcaggagagccgagcaaggaggaggcggcagatcctgaccggcggcctccaaagaagaggacaggcggatgaggtggacggcatccagctgccgccaggagggggcgaatgaggttggaggatgcaccggcgagggtgcgccctcctcgccgcagcccgccgcctcccgcgccctctccgtgagtccgtgacgccacagccccacagcctcctcgctggcatccgtggcccgcggtgcgcctcccacgctgccgcccatcacccgcccccgcgcaatgccgtgggcgccgaccgtccaccgctgctcgacctgcgctagacgacccgaaccccaacgagaacgtcaccatgaacgccgccgccaccgccacgctcgtcgtcgccgaccacaattcggagccaggagatgacacacagagggagaagccgaggacaaagagagacacggccattttgacttgccaccaccgcccaccacccgcccatgcacgccgccatgcacgttgacctcccgccgccgctcgacatatgccagatggcctagacagaggggggagagagagtccggcggcccgagagagagggggagagagagagagagaccgacggagtggaaggggaaagaggaggtgagagagtatatatgacaggtgggccctaccattaaaaaaagaaaatgctgactggattgtcaagcatacgctacgtaggataagatcgctctagattgagtcgaggggctaatttgtccggtattgaacgatctctggttctcgggtttggggggggtaattcggtcgaccgcgatagttcaggggggtaattcgtacttttttccggtggccctcccttctcctcctcctcctcccgatttggtggcggaggtagcagcaaaggctggcgcagagcacgaggtggtggccggtgactaggaagaagatggaggtggaaaaggaggctcccccctctctcctggtggccctcctctctgttcacctcctcccttctcctcctccagatctggcgacgacggtggcggtggagaaggccggctcggagggcaaggtggaggccgttggctgggtaggaggtggaggtgaaggccgtcgcactcctcccctcaccgagctcttccctggcctcgccatgcgcctcgccgtcagctgccggatccggcaatgacggcttcttaggctcttttttgttatttcacttaatactataggtgttggtcatagggtaagaacctgacacctattgccggtttctaactggcacctatgggggttcatgtatactagcgatcattatcatagaatcattgatgtgtgatttaaattgtatgaaattctgtgagtttgttgcaagcctgaaacagctcaatagactcctgtttctagcgagtagtatattttatcaacgccacacaagttgtagtgcaactagtttcttaactattcagggctacctgtatttagtatcatagcttgacttaattgaacacttagaaataagtataatactgtggttgattagcgcgtacttgagtttacttaacaaaatcttcttttgaccaacaaactacctaccacggaatgtgttgtacactacaaaatcaaattttacaggcgagacactttcaagttgcaggcggatcataactacccaacatgcaaaaatcgcttcccaaacgcagttcaagggttgcatacgaaaatctatttttgaaggcgacctcttaagaggtccaatgcaataatacaccaattatcgcatgtgggcctcttaagggggcctacaaaaatagattttcgcaagcaggcaacgtggagagcaagtgggctatctccacgtgtcctcgcactggccacgcactactcttttttctcccgcaccttttttctcctcatcccccttctcactcaatgtgcctcctttttttctcttctcctcctctccatcgtccgctgcctccccatctgctccacctcccatcactcctctcccactccctctcctcatatcttccccttcgctccccccttctcctctcctacacagcggctgaggtggatgcgacgatcggctcttctagtggcggtcaacaggcgcggcgaatctggcgacgacagtcctcgggaagggtggatttgccgtcggcgaactcgggagtagcagatccaccggccattggtaggcttcggaagggcagatccaccaccagcgggctcgagagcgatggatccaccctcgcgcgtggtggagaggaggcgaaagggcggccctgcaccgggagcagcgaccaagatcaccgtagctacgtgcgggctcgagagtggcggatccaccaccggcgggcttaggaacggtggatccattgccagcaacctcgggagcggcggatacgtcctcgcgtccggtggagaggaggcggaagggcagcgccgcactggaagcggagaccaggaccacagcggctgcgtgtgggctcaggagcggcggatccaccctcacacgtggcggagaggaggtggaagggtggtgtggcaccaggaacggcaaccacgaacttgcgggtacgtgcgggctaaatcgagagcggacaacccaccgtcgacaagcttaggaatggtggattcgctgccggagtgctcgagagtggtggatccgcccttgcacatgtggagaggaggcggaagggtggcgcaacaccaggagtggcgaccacgaccacgacggcgatgtgagtgcttggaagagggcggatccgtcctcgcgtgctgcacggaggaggcggaagggcggcacgacatcgcgagcggcaaccacaaccgcaggcagcgggggcaagggctgtagcgcggcacacaacggcggcgaccaagggtttgggttttggattttttttttctttttttattttttaaatcattgcaatcaagcatccttatttgcccgcatgcaaaaatcgggtctttgcaagcggctttcttaggtcatctgtccgcgaaaatgattttatgcatgcaattgtgttgcccgcatgcaaaatgccgatttttgcagacacctggcgctccaggcgagtgctcactcgcctgtgaaaattagtttttgtcggcatgaaaagatcatttatgtagtatagtggtatattgtgcagacatctaaacaacacattttttttcttctctctttctctcggtcaggaaattatggagaataaaaataaaatggtattacattttaaaagtataatgggatgcataaaacccacgaaacactagactcacacggtcatggcgtaaacatgtacaccaaaatgctgtctaaatatctttgtatttagtataatccctctggtttttgacggataatgtcgttaatttttgaactaccatttgtctcatatttttttgcaaatattaaaagcataagtcatgcttaaattatttaatgattaaaaaaatcagaacaaaataaatggcaataacatattttttttaacaagataaatggttaaatgtatatttaaaagtcgatgttatcgtactctagaacacgtagggaatataatgcatgtgtatgtgatttgttgggttagaacatctatgttcactaagctataactgaagaaaaatatatgaaacttcttgaatgtataccatgtttcacaatgtttatttcagattctgtgaaatttcatgatagttttataggtttgatgatgtatcctggtgttaagaacttaagtgaaacttatttcaagataacctggtgtaaagtgaaagtatatgctaaacctagtgcaaaacgaaacacgatgcggtttatacccgatgtagtacaatttattgagctagtgtcatagtgatcacgccgttgtccaaaacatcacatattctgtgactggagatagaattcgttccaacatgacaagaaaacacgcgggaagtcatgttgtccttaggatcttgtcaagagttttgacttgaaaacagcaaaagtatttagttatccaaaaggtcagccgtgcttattgcaggacattgaattcatcttgttgaatgtgtcgcccatcgcacttggttcatccgtacttggtcctgcgcgttgccaaactcccgtaaaatctcaatcctatgagtcatgaatctcgaatcaaatttgtaccatgccaagttaccaagttgcctcgttgtagcgcgtcgctgtttgaactctttgcaaattactgccgggccaaaggattcaaatttgattcaaatcacatattcatgacgatcgatgatgctcacatttcacgatgttagtgtccaaagaaaattgaaaattgtcaaaattgaaagacaatattctgctctatttatgagcagagctctttcttgtaggagtactagtagtagtagtagtatgtgattacatgggaatctctatgcacaatgtggtcaccttaattacaagtttaaaattgcaaaatccaaattagcctaggaatcagacaaggagtagaagtcgtatctcaagctgcagcttccacccaacactttgcctccctccttggcgcaacccctcgccagcagttgatcaatggcggattccaggcacatcttgcagtcgccgccggagaggtccttggtgcactgtgccatcccgtgcagcctctgcgcaccgccgaccgccacggcctccccggcggcgaacagcagcggcgacaggtaggccgtcctcgtcagccgcttcatcagccgggacacctccctgtcgaggtcggccgacctgtccgcgccccgcaggacgcgggccggcgggacgacggcgcggtgctggcgtgacctcgccgaagaatggctcgccggagtagcggagcatgcaggcgtcgagccagacgacggcgtccttcttggacgggcacacgcgccgcgccagcgcacccgccgcccggatgcactcggcgcacgttgcccttgcgacgtcgccgcggcagagcgccaggccgcgcacgcgctgatcctccccatcgccgccgaccccgaccgtggcgatgtcgaacccgatggccggggccttggcctccaggagcgagacgaggcgccccaggttaccggcgaaggagctgtcggcggcgaagctgtccgtggcggagcacgacgcgacaggctccaccacggtgctcgcgccgccggcggcggcggcggcggttagaagaaggaatgctgccgcctcaagaatcatcatggcgcgctgcgctggtgagtacgtggtgagcacggaaacgatttccgaatgctagctaggttgtagaatgcagtttgagcgattgagggagggaggatcgatgcggcggatgaggtggtgcgggttataaagagcatgagggtggcgagagcggaggaagggaagaagtagaaagggtgggggatatgctatgcggtctgaaaagttggaggtggtagagtagttggggttggaccgtagttggaagatggaaggaggaaggcgcgcagggtgggagggagggagggagagactggacgaggtcgtactcgcggcgcttactactactactcggcagcggcaggccggcagcctggatggacggaggaggagccgcaaatcatgcaggttttcttcttgttgatgttggtagcaagtagtagtagcaaccaacgttgaccctgaccaagccagccaatcacacgcgcgcgcagcggggcaacacggtttgctgtgctttacgcgaacgcgaggaatgttttttgattttgattataaatgttgtgtgttttaggatctgcgtcgtcttaatctgtggattattcctaactcctaacacactcgatcggtctgcctcccgtcgtagaaaaacgactgctaatattataccagtgcattttgatcgctaattatgttttatttaagtagagccaaattggtcaacacaaagtacatacttcagtcagatttgtttagcttcttcattatgcctccgccggccaattacgatgacatgatttagagtttagacggatgattctctcatattatctttcgttttagtttgatgtcagtcgtcagtggtaattaatgtatatgaaattctatcaacacagtaatcagtcattgattctgagattttacttttgagttaaggaaaataggactacatataacttgtaagtcgttgagaacaaacaatgttatgatgattctccccaactataaaataatgaaagtaagtagtggttttcataattcgtagtcactcgtcatttctcctttgtattgattagttgtaatttccttgaagcaaagtccaaaataaatttcattatgttaaacaaggccaattgtgaatggaatatctacatttcaaatggcttatgcttcacattctttggataaaaatctaaaggctctcaccacaaccctcattctctattcgaacttgtcgaatggttgaaacacaattacaatagttgtgggtgtgtagggcaacctggtatgaagatacgtacgtacgaagaacacatcacataaaagatatgagatttatataggtctgggctcatggaaacatacgaaatagccttcctcatatttatgtgttgactagatgttgacatgtacaagagtatatggtggaagcctagcaaactaatacattgagattgtgatctcgatgggttgtggcaagggctcctgatggattagcttttgtgaaaagagcttagccccctccatcacaaaaataacgaatggatgtgacaaatcctagtatatctagatttgttatactagaagtgtcacattcagtcttaggttagttttttatgggatagatagactatgtctctgtattgatcctaacgaaaacttctacttgtcttgtcgtactcaactcggactttggtagttgtgttatgaataaaatttagcagtatgagatatacctagtaagaggttcacaccttaggatacgatttcgtttgggcaggttcccaactcctcttcctcatcttctacgtgcacgcttttcgaattgctaaatggtgcgtttttttaaaaaagtttctatacgaaagttgtttaaaaaatcaaaataatctatttttgaaaaaaaattaacaaatacttaattaatcacgtgctaatagactgctctgttttccgtgcaggggagttgggttcccaaccgcctgacacgaaacagagacactcaaaaatatggtttgcagtatatggtatctgcgaggagagttaacttgtgtgatgcatatcacatatttactttcttgatacaactcatttagataaaaggttcaacaatgaattgttctaagataaaaataaaataaatttataataactgacagtaatatgtgcacaagtaattaaacttagataaaaataaagtaaaaccattggtaacaaaattaatgcttaactaaaataaaattgtatattagatatcattaaaattttagtcctagcaatgtacaactttaaattactgaaacattataccttttcgagcccttggaataccattacaaatatatgactaacttgtgtagtggtttgaaattatatgcatgcaaatcaccggtgctttgcaaacttaactttagtcgaggattacaactcaaaaaatagtaagaaatataatatattgaaaatgtttgtcctaattgaaagtaacgacggacctagtagatctcagccacctaggtcgctgatcttttcttctttctctttcaccatgttaattcaaacaaagctcaaaatagaataggtcgacttatgccaacttgccggaacatttaactatttgccacttttaagatatggcaattaacgatttgccactcgctgtctatgacatgtgggtccactggcaaatcctttagaaccacttgtaagagtagcaaatagttaattattcccaccttgccaaggtttacaacaattaacaggacatctcttagccaataatataatatatttcttttgtttagtgaattacagagaatgaacagacagaagcaagccataacattttgacggcttggacacaataaggtactgtgtaatattgagaatcctccccgtcggtcgctcgggggggagggaggaaaatcgagcactccctccctccacgatgtgcgcgccccctggggcctcacccacgtgccgctgcccccacctgtcatgtgtctccatcacatactccattgaaacaaatcacccatatattttagaaaccctctattaagggaattcattttattttttgttccaccaaaaatgtttcacctagtgtatttataatgtttcattatgtatggatcaaatgttgcagtgaactgaaacattctttcgctacttgtgaacattatttttatataaggtgaaacaatgaccgatttaaacgattgaaacattttcaatctacttaatgaaacaattccgatatacttggtggaacatcgtgcaacattttaaaataattcaataataagctaaaaaaattttcatcggaatatatccatgtgtggtcttgttttgaagatttaattgcaacgaatttaatggtgaaccagatcatgatttggataaataatttaagagaaaaaatagtttaaagtggttttgcacgtatgcgtatatgctgacgtcagcgcccgatttttccacgcctggatcgagcgcccgatcggtagtctcgttcgtgtaatataataaatttctcttgccatattaattgtctaatgtgtatgcctcttattatacgcataaaaaagtataaagatggatattggtatttgagaaaatttatgtttcgttaaagatggatattggtatttgagggaattttgtctaacgaaacatggcctttagggcatccacaatatggatgaaaaatgggttgtaagaccctttactttatcattgtggaggtggataatagaggagatagcaactatgccataaaagacattaaactattacctctctcgccctctctcttttctatccaaccattgctttacatgtgcgccatatcttactcacacattgtgagagatagaaacaactataacctaattttgtaagtcccacatacattgaggatgcccttataatctggtttgtatgccacattttgccatgaattaactaaggcatcatcaatgtttattgcaaaactaggtagtaaggtgggcccatgtcaggtggtaatagtgtgtagagtggatagtacggtgggacccatctaaaaagttatttaaacatgagtcatgccaattgccacaattaaaaaaatagatgggacccaccataaagtatacctggtagtaagcttataccctggtagtagttctttaccacctccacaatgtataatagctggtagtagggatgcattcaatacttattaaccactacttcattacatcgtggatgcccgaataaaaacctgctccttcgccatcattagacccgacgagaagcgggagtcatttggtttgaaaacgaactaggacattgtttatgcttttaacattcattttcagaatctcttgtcacacgccatcttggttcaaagcttaaaaaaatcatttaccaagaagtcactttctttcgagttctatcctttacccgtccgatttagttttgtcctaagttaaatttgtctcattttaattacttttataaaaattataccaatatctacaataaaaagtcaatacaatattaagatatatttcatggtgaatttagttaaactaatttaatgttatgttgatatatttttctataaacccggtcaaaattttagaaatttgctaataacaaaatttaaatgactcataatatgaacggagaaagttggtcgtgaatgctcgcaattgatatttttgtttgtacataatctctcacttaaccaatttatgattcctccttggcagtaaaacctagatcaataaaatttaaatatacgttagggtatgaaaaagaaaagcataaaattattatcgtctatcgatcgaactaaacatatatgatcgttgctacatctcgatcaagaacagagaatatatattaaatttgtttgtattagtaatcctcttgtcctcaaaatcaagaccgatcattttgactttctgtgtatcatcttaatttatcatttgtatgatgaccgtccagctcgtaccacttggacggctgagaataggaaaaaattaaacttgcacctcagagtatcttatgaaatagaattaaagcatcatcaacatactaccaaaattcaatcctctttttttaatctctaatggtatttaaagggggagtagctacatttatgacgccatatttttcaaaaaaaaaaatagtcggtatatatttacattgtaaatttacaaattacatatgtaattttagtgtatttataatgtaagtcctaaatttacatatgtaaatcccaaaaatacatatgtaattttagtgtatttacaatataagtctcaaaattacatatgtaagttcgaaaattacatatgtaagtcctaaaattacatataatgtaattaatatatagtcatcactcatcatgatgtatgtgagaaaataatcttcaatctcacggtaacacagttgggaggcctctgtgcagttgtgtggtatagcgcataggtatgcaaaccgactgtaatcaatggaattttatggcgccagagatttagcaaatccgtttaaaggataaaaatatcctcccttctaacacaattaaactttgaaaggtgggccacataaaaaattaaacgaatcggtcgtctcctcccgtgctcccgtatgcaacgacttcaaactttttaagagatgagatgagatttttttttaagagtttgtttagggctactattcaatacccatttttacttaaaacctcaataatctaggaattaggatcatgggcagtataggcactctgttggccacgctcttgtaaacatgattgcagttttttatttttcacaaaaagatcgcagtgtccttttcttgttagtaatgccaagttttgtttcctaaatgatttggtagctagtaaaaatatttctctgttattattgagttgcgtgtgcgtgcactactgtcgctttattatagggcattattctttttaggtgattagcataggagattagaatatgcctaagtagtaggttgctaccagtccctaaatattaagaaagggaaaagagaaaagaatcgacctcgacatatatattttatgtttgtttcggaaacttccccggataactcccgatcctaatcagcaagggtgacgcccccacctactgctgccggtcgctgcagcaattattctaagaggctgcaacttttttttttaaaacagaggctgcaactggggacgcatacactgtgcagagagatcaacccaatcatctatccaaatgcaggcttctaccactcgcccgttataagatacttcctccataaaagaaaaattaagattagatgcaacgttttatctagatttattatactcagatatgtctgtcggtgacatggggccgggggtatcgtgactagaggcttgggtagccgcggtcacccacgtggcccgaccccctcgggggggtcgggcccgagggtgacgtggccacccctccctctgtctccccgaggggtcaggccgctcccgtttcggccccgagggctggagcgccccgaccccctgtggttttggcgccacgtatgtgggttagatgagcacagcgggctcacctaaccgcatttatagcaggttggacgagcgcgccacgccgcatttaatgcggggcagcgcacgcttatccggtccgtgaccggtcacggtgtgtgaccggtcacagaccggtcagatcgcgggttaggtggcaacaggcggcctgtcacacgcctcgccccgtcccgtcggaatgatgagagctgcgaagggacgacgagtctcttcgctcgtacattcagcggttctgtcaagtccgcaacaccataccgtgcatccccgcacacgcggtgatctacgcgttcaggaggggcgtgcggcacaaccgcatgctcgagaagatcgcctccaaggagccccagaccacagcgcagctttttgagctcgcggaccgtgtggctcgcaaggaggaggcctggtcctggaactcctccggttctggtgtggcagctccggccgcccccgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccagcaagtggtgtaccgtgcacaacacctccctccacgacctcgcggactgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgccgaggacatcgatgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgcccctcaccttcgaccaaaccgaccacccgccgtgcgttgcctggggaggacagatcgcgatggtggtttcccccaccgtttgcaatgtgaagttggggcgtgtcctcatagacgggggtgcagccctcaacatcctttccctcgcagcctttgacgccatcaaggtcccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccaccttgccgcggcgtccaagcccgcgggtggcgacgagagactcagcacctccatcccggccgccccaaggcagcagatggtcacgtgcgacgaggtcccggtcaaggaggttaccctgggcgacggcccgtccaagaccacacgaatcggtggtcttctggacgacaaataggaagacgcgctcgtctccttcctgcgggcaaacgccgacgtcttcgcctggagaccggcggacatgcccgtggtccccagggaggtgattgagcaccgtctcaccgtgcggccgggcgcaaggccggtccggcagaaagtgcggcggcaggccccggaacgtcaagccttcatccgcgaggaggtggcgcgacttctggaggccggattcatccgtgaggtcatccatccgaagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcagatcctacttttcaacgtactactcgaatttctttgggtagccagataagacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttgtcgggttcttggtctctgcccgaggcatcgaggccaacctcgagaagatacgagctatagagcggatgcgcccccccagcaagcttagggatgtgcagtgcgtcaccggctgcatggccgccctaagtcggttcatatcgaggctgggagagaaggcgctacccctatttaagctcctcaaacgctccgggccgtttacctagacggaggaggctgagcgggccttcactcagttgaaggcgtacctcagttctcccccagtcctggtcgccccggagccagatgagccgttgctactctacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccgaggcccccgacggccggagctggccctccgcctgcttgtccgacggtgccaggtgcccccgacccccaggatggccccggggccattgcgggaaggccgcgcctgtcgccctctaaccccgaggtcgtcggcacagaagccgagtgcgccccgcgtggcctctcggacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctgatgacttcgaggaagttgcgccattatttccaagcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctccgggtgttaggcgactcccagttggtcgttaaccaggtctgtaaggagtaccagtgctctgacccgcagatggacgcttacgtgcgccaggtgcggcgtatggagcgccatttcgacgggatagagcttcggcacgtgcccagaagggataacgcggtcgccgacgaactctcaaggctcgcttcctcgcgagcccagaccccaccgggcgcctttgaagaaaggcttgcccagccgtcggcgcgacccgaccccctatgggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggaatgaacgcgtccggcgcatctccaagcgctacgtgctggtggaaaggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagtttcacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcaataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcaccaacgcggaaatcctcaagggcctcaaaaccaagaccttcaacatcctcaagaagcacggcgactcgtggatcgaggagctgccagcggtgctcagggcgaaccgaaccatgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgttctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagcgggggtcgggtgtcatgtctcgggctcgggccaaccccgcaccccccccccgggcgtgcagggttagccgggggctaccacatgcatatacttaccctttttctcttccgcatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctagccagtctcgacacgaggatctccccaggcactagcctcgacccgcgccgtttgaggctgggacctgggcacgagcccttgttcaagccaagacacagaaggaccgcggcacagaccattctcgtctcatacacacaacaaacagaactgacgcagaaatttcctctttacttgattgcagattaaatcagtctatacaagaagggggcccgaaggcctcggaagaagaaggaaaagttattaagattggcgggggcctgggggctcactccgacgcgcccgggtcgtcggcctcgtcgtcactgtcgtccgcaccgtcgtcaccgccctcctcgtcggagtcgagcacgaacgcgagccgaggggccgtaccctcgaagctgtggacgatgtggtcggcggcgtcccggacctgcgcgcgcgcgccgtcctcggttccgggagggaactcttccagcgctgcccacggagagaagtcagggtccctgtcctggtagcttgccagtacgagctccaccgccccccgggcgaggtccctcgaggatgacttgatcgtctcctcgagctcctcggggagccgctcgagggccccggccatctttgagaggcgctgggcgaggcccccctggttggcggcgtacttcgcgtattgcccgccccagaggcccgcctgccgcccggcgcggtctagacgggagacggcgtcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgtggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgcggcctcggcctcctcgagagctcgcccccgctcggtgagcgcgtcctcgcggaggcggagtgcggactcctcttcggcgcaggcggcctcgtgcgccgccagtgttgcctcccgggtggcgacggtggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttcccgggcagcggcggcgtcaaggactccccaggtggcgtcaagcttctcctctagctccaccgcccggctcccgtattggaggcggaggtcgtcccgcgcctcgtcgagcacggcggtggcgatgagggcagtctcccgctcctcctccacctccctggcgatctccgccaggtccttacgacgggcctcgagctgtgaggcgtgccggcggtgtgccttgtggcccgcctccaccatggcctccaccgagcgccgcccctcctcgacgcacgcccacgccgcgttgagctccgcccgctccgcctgtagggcctccatctgggcacttaacccgtccagcaccgtgctgttcgcggcggccaaggcctgcaggaggggctccgcgctcagtggggcagcggaaggcagaggggagagccccctcggtgtgggtgccgcgcggctcggcccgccgatcgacgtgccggactcgggggcgtcccccgaagctggctcgtcccaagcgtcgcccgaggggtcgggcccgagcggcgtgcccgcggcctcgtcgtgggtggcctcggaagtcgtcatcgcctcgggcggagtcgggtcgggggtttggcaggccgcctggcgtgcgcgcgccgcctctgcctcctggacggactccccggcccagcggagtctgacctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccggccggacttggaatggcggggggcgcgacgggatctcgctaaggcagaagaaaagccagaacacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggcacgatccccccatcttgcggagccgtttcttctttcgctccccctcgggctgcggcgtcggcacggcaccctccgggcgcctgctgctggcacgcaccgccccgccccctcggggaggagatgggggaggggtaccctcctgcttcctcttcccc

SEQ ID NO: 67385 - DNA, 4261 bp, Oryza sativa
cgagagcgagcggcgagcggcggaatcggaagagcggagctcggggagcgattatatagcaacgggagggagagagggcggccgtagagagagcaaacgggcgcggagatctcggccgccattgaatatgccggcgaggtttgcgggattgattccgagcgaatccgagggagagagagaggggaaagagggggaatcgggagaggggattgcggggaataattcccccctcattaaggcgcgcggggaaggcgggatgcggcggattcggcggcggcggcggcgctagggcacgggcggcgacggacgcggcgggaggagggagatgacaggtgggccccacccgtcagcgagagtggcgggcgggcccgcctgtcagcggcgcgcgcgcgcgggggagccgatgggccgcgggagaggagagagagagggagagggaaatgggccgagccggcccaagagggaaaaaggggggggaaaagaacttcttttagggtttttctttttataaacctttttaactttgcttatttcttttcaattattatttgtgctctgaaaattccactaaaatttgtttaagcattttaggcttttaggaaatatacaaaaatcctccaagcctcatttgacttttatctttgcacattttaattgttggaggctttcacatcgaattttaattattctattgcacaattttgaggatgaattttagagtcgatttgggacgcgacaagattaagtggctaccattcaaatatacattgcttgatggagatttatatagccgaaatatagatggagtttggagaggacgtgagcgtattagggtgtgtttggttgggtggatgagtctagatgggagatggccgcccgattttttgtggtgtttggttggagggcagggtgaatggggtggcccggaattgggaatattccctcaatatgctggatgagtgcatccggccgattttgctggatgaagccatccagttttggtctaggtgacgtgtcctattctgattgggtgtggtggcttgattttctgttaagcaagctccaaatgatctttctcctaaaccgtttatctaatttatgattttattacaccgttatatttgttacaattaaatgtttaaaacaagatctcggatgattatattttgattaaaaaatatatatgacaaatgggtcaccaacttatggcttttcccatccatgctatatccctccaaccaaacaagaaattggatcaccatatccatacaaaccgaccaaaaaattggatcgccatatccaacaaaatatgtgttggatagtatagggagtgaggaatactttgaatatttgacacgttgtattgagcctcaggggggcggtatatataggattacatggggaggagataaggaatgattacagatatggaaggagtccacacaaatcaatcctattctaatatgactctaactactatatactctaacatccccccgcagtccaagcgtgagcagcgcggacacttggactaggcggacacttggactagagaagaaaccggcgagagtgctcaatatcgacgatagcccttttgtgccgtagtcgatgtagccaaagcgaagggtgcgagggagccgtggtcgatgtagctgaagtcggggaatcgaggatgtcgaggtagccgtgccgcagggcgcgcatgggacactgtagaatggtcgtggactctcgagagggtgtcatggaccaaggtgcacgaggacgagctgaagacgaacgcggtgacatgatcgtggcaatcgttgaggaagatgatgctgaagagccgatgtagtcgaaccgtgaaggacgagacatcacacagggtttgccaaaccccgggataactcaagacgaatgcgcgcgccggtgttgctaataccgtgcaggcgaggcaggggaccaccatgaatcatacgccaatgttggaggagactagcagagaagcctccaagacggttgtggcacgagaacggcgtagagggagaattgctggagcagcacgcggttgtcggagaagagcgaagtgcagtcaaggaagatacggcgacgctggcgatgaatcatgctggacgaagtagaaggcgatgtagcaggaccaacggcctggatggcaacgtcgatagccatgtagaggtagctggaccaccggcctagagcggcgacggtggcaacttggagatgcggcagtaatgctcaaagtagatgaagaagaacccgacggctagagatgaccaatgcggacgacgaggatgtcgatgcatgaacggcgatgaagacgacgagaggggtgacgctgtgacccgaaggggcgacacaggtgcggcccgatgtcgatatagcggcgagaactccaccggtagtgaggccacgctgaggagggcgcctctccgtgttccaacaaccagtggaggtggaccacgggcggcggcactgcagcccaagggggcaacgcagcggcaacccgaagattgatggcgtagacgcatgctcgataacgattggttacagaagtcgttgtagccgggcacctgaacgggtgatcaagccgaagatgcgcagggctgaacgatgaaatcgaagcagagtcgatgccgatgtcggagacacatagatgtcgacgaggcagtgggcgacgcaaactcgatctctaatcgggaaaaaaaaacagatacatgcagcagcagaacagcatcagttgcaagcttacccactcacacatggtccatagaccaagtccacgtccagcaacctctctgcccaactgtaccagcagcagcgacacatgcattccctccacaagtccatagccagccagccaacaaactctctgcaaccatcttgtctctctctcctctcccttgctaatcacgtgcaagatgactagcaaagtgacggacaaccagacaatacagggagcgagaggcaagacagacgcggatgcgtaggggctgaccggcggagggcgtcgaggccgcaagcggcgacaatggtgcagatcctggtggcgaggtgtcggcccgcgccagagacgacgggccagcggcgtcttgcctgccacgagggaggaggcaggcggagaggcggtgaagacgtgggtctatcccccgggcggcagtagaggcggatggggatgccgacgtctggtggagcttgatgaagacagcggtcgaggcggaaggacctgacaacgacggttgtgaaatcattgtcatgattaatatttatgatgaacaattggttttgtaaatgatttaatcaatgaattggttttaaaagatttgtggatgttggtgggagtgcgtgtgactaatgtgggtcaggttgtgatatttgtgctcaggaacagttgttttatctgattgtgtacaggtaacttgaggtcaaccttggtcaatggtgaggaccaggactatactcagggtggagcagaggtctagtacggtcgggataccatgtgagaaggcgactagagtcaggattcttggaggtcaacttcggtcaacggtggggatcgggactagactcagggaggagttgaggtccagacggttaaggataccgggtgatgaagttggatacgagatggcacacagtggatggacaccgtgtgggagtgatcttcgcaacgggcttcacaaggtgtacgtgcaagcgtcggtgttcacggaggagattggttgagaaattggagcataagtatatagttctacagtactctaggtactgtagcggtgttactgtattgtgcatgtatgcgaaaacgctttgtatcgagcgtccgatacaagacaaactccggacagtcgacgggacccacctttccccaatcttatcctcattccttctcatccccaacctctcgttcaacttcttctcctcggcgtctccaactctccatgctgcacacgcggccgcggcgtcatcagggggcgcaggcgccgctgccgccgccgacggcggggcttcctgtgcgggtggccagattatggcgccaccagtgatgttcgtcagcggcatcgtgtggcaggcacggtggctgtgttccgggtggcgtcgatggcgacgacagatggaagagagggaggaagcgtggggtggtgctcgtcgccggcgaggactaccatgcgcttgagcggcggccggtgcagcagttccagcggtagggtgcggtgagcaccggcaaccacgttggcggcaacggggcagcacgacggaa

SEQ ID NO: 67386 - DNA, 5066 bp, Oryza sativa
ccctcttcagtaagagaagctttggagaatatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcgtgtttgtatggtgtaccccggcttttcctgggacggggattaatacactagcgttcgggaaaatgcaattttcccggtcgcgacaataatgcctcaacttggtgcaagagaaatataaacataagcacaatttttccaccggagaataccttgtctctgcatccaagagcctacgacttaaataaaatatagccctttcttttccttcaagctcttgaatcaatactgagccaatcgacttatcaccagccgataggtacaatctgaaaggtatccctttttgtggagaaatttgtcacaccctgaaaattcaaaatatataaattgttgtttaattggaatttttagaaataattttgaaaagtcttgaaaagaaaatctaattttaattaataaattccaatataaaatgggcccagataaaatttcattaaatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaacctctcttctctctcctcggcccaagccggcccagtccgcagccgcagccgcccacgcgcgagtgcgctgtcgctgacaggtgggtcccacctgtcgggatcttcgtcttcctcgggccgaaaccctagtttcgcgccgccgccgccgctttccaatccggccgctcctttccttctccggccgaatcaatagaggggaaacattctccgggatctcctctaccttttctcctttggaatcatcggttaaatcggtttggaaatcgagggattcgagttcgtctcggattcgtttttgccgaaccttccttcctcgtcgccggtcgccgtgggcctttgccgccgcctccgagcccctttaaaaggacccccggtgtctcctctacccgtcgccgccttcgccttcgcctctcgtcgtcggaaaagccctagcgccgtgtgccctagctttgccgtcgccgccgccgctccagccgtgcttcgccgtcgctccagccgtcgccgtcgctcgggaagaccgccgtcgtggtcgccgtcgcgtcgccgtcctcgtccgccccttcgctgtcgccggagatcgccggagcatcgtcgccgtcgtcaagccgaagagcgccgccgcttcaatctcgtcgccgtcgccgtccgttcctctttcgccgtcgctttggtcgccggtgagttcgccgtgccgtccgctacccgttggtgccctccgttcgtgccgtaacgccgccgttcgccggcaagcgtgcgccgcccgagccgttcgctccgccgatgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcgaaaataaacagcagcggactagcgggcctacggctccatcttcacaggcgctcaactggggtataagccaggactccacctaagactacttctccaaagcttctcttactgaaggggggaaagattgagcaagaatgagtacaaccacagtactcagcaagccacaccggcagatgcatgattaatgcaagggggtacaaggggtaataatataggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccatattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcccacctatggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacagggtttaggggttttgaaagaggaagagaggtgtatgtccaattccaccataaaccaacaattccatagtgtccaaatgatatgagaattcccaaagtctaaagttataaaaccacctaatattgcctaattaatcagcgaagcatctacctaaattcatactagtggaaccataaatagagtacccactagttggggttttattttcctagggtgaacaaggtaataataacaatagcaataataatgtcttaacaatgataaataggcatggctaagtaaaacagtgataacgcgggaatttaaataaagcggtaatgcattaatttaaatcaaaataattttataaactgggattcaatatgctcaaggatgatgtgacttgccttgctcagagagaacggccttccgaaccttcggcgacgaccacgaaccacgctttgggaacctccggaacgacgaaagctacacgaagcacacaagcaaagctacaagcctataaagaagcaataacaatacataaaaagaaagcacagggttctttaggttataacaaacattaagagacttgaacgggtcgattcggagctcgtatgaccaagatatgatcatccgaagtttaatgctgttatatggagatttgcggattattataattaagctttgcaattataaaacatgtgtaagcgctagcctggaaaagacaggagggctgcgccgttgacatgcggaccccacatgtcaacctaaaggaccgcggtagaccgggtacacagagacggtccacgggtcgacggaagcggaccccgtgtgtcaaccgaggcaagtggccgacaaacggactccactagacaccacacggcctgcacacgtggaaaccacgcggctaccgagcgggcacactaacacggacactacacggtcaccacccgcacgcgtgaacgactaccgataccggtacacgggtaccggggtcgacaaccgcacaacgggtacggggtgacactgaaaggacgaggacggggcagcgagaggacggatccttaccaccacgcgacgaggcgtgggaacgacaacgacgaacgggcgcggcggacggcgagggaacgacttcggcggcgatccttgaacgaaggcgagacacggccggtacgaggcttgatgacgcggaggcgaggacgaagacgaggacggggctgccgcggcttgcttgacggacgcggacgacggacgagaacggcttgacggagggacgaacgccacgacgaccgggaacgacgagaggacgacgacgacgacgatgacctggaccggcgaggaggcgatgaggacagccggcagcggctgcacggggacgaggacggcggggaacacgccgcagcgatgatgatgacggaggcggcgccgcgagacgacgagccgggcgaccgacgggacgtcgacgacgagaacgatcggagacgacaatgatggaccgcggaggggtttggatggaggggaaacgatgccgaggacgaccttgccgctgcgatgccggaggtggtagtggtgcagcaagccgacgagccggggaggaggaaggggcggccgaaagaacgccggcgacgaagaggatggagaggccggcacggcgacggcgttccggtgaaaccgaggagcagccggggtggagggcgatgcggcgacgccgagggaggagacggcgacgtcggccgacgctcaggcgaggcggcagggatggctggagatggtggagtggtggcgacaccactagtcgtcggtgaggacgcgtctccggtgatttccccgcgaaacggaggcgaagccgggaaagagggggcagctgcgacgccgggagaggtggcggcgcagccggagggtgcacgggcgaggcgggaggtgcggctggaggtggccggcacggaggaaagagaagggcgacggcggaaaggcagctccgggggtctccgcgggaaatggagggcaggccggggtggaggaggtggcggcgacgctggaggaggcaacggcgcggccggccggcgcacgggcaaggcggtaggggcggctggaggcgtccagcggcacgggagagagagggcgacggtggggaggtggctagggaccacgggagaccgcgggagggggctaaagcgatagaacggagcgagagggttgcattttataggagaggagagggagccagccacgggggaggtcggaacggcggcgataaaggcggccggcggccatggttggtggccgggaaaacgcgggcgttcccggcgattgggggcacgattcaagggggaaattggggggaattgaagaggattcaatggggatta

SEQ ID NO: 67387 - DNA, 1696 bp, Oryza sativa
cgccccgactacctgcatgatgaccaggatcttggcgcgctctggatcgcagcagagggggaggaccccttgggggatgagggatgcctccacggagctgagattcagcacccgttggaccaccatcctgaagtcctcagggtcccagtcccatttgcgcccctggtgggtcctcatgtagtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggcgacaccggctgtacggtgaagaaccaccggaacagccggagagatgggcgcaccccgataaacatctcgcacaggtgcgcgaagatggccaacgtcattatcgcgttgggggtgaggtgcgccatctggagatcatacaactccagaatatccatgaaaaaaatagagaatggccggaccagccccgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatccctttctcggcgtctttacacccttgccaatgctatgcccggctcctcgcttcccgcgcccgctacctcgccccctcgtttctcgcgcccacgcctccactaaccccactcgcccgtttgcggcgcacgcggcagatgtgcggccgtagcggttgagatggggcagatcgtgcgcgcattaactacgcccgccaaccgtgaaaagcgccatcatcatgtctccaggcgaaacgaaccggctcgtcccgattcgcgcgctgctcgagtaatgtagcagtcttaaagaggccgctcattattgtcggtcggttttcccttgccgatgcgcgcgatttgcgaccgctgggtttctgcccgcctatagggaccggccccacctgtcaccgggcctaaggagtggcgtcacgcccgagcgcttccctcgaggggggcgatcgctctggcataacgccgggggctcctgtcggtgacatggggccgttggtatcgtgactagaggcttgggtagccgcggtcacccacgtggctctgaccccctcgggggggtcgggcccgagggtgacgtggccacccctccctctgtctccccgaggggacgggccgctcccgtttcggccccgaggtgggggcgccccgaacccctgtggttttggcgccacgt

SEQ ID NO: 67388 - DNA, 675 bp, Oryza sativa
aggcccgggagaggagggaaagagagggaggagagggagacttcggccgcgggccgaaagagagagaggggagactttgggccaaacttggcccaaaggaaaaggaggattatttttagattttctttttattaaactttgataattgtttttgttgcttaataattatttccggtgctctgaaaattcaagtaaaatttgagggctccttttagaccaaggagaatttaacaaaaattctccgggccacatttgaatatttcttgtacgtatttttagtgtttgccaatttcttttcgaattttaattaattctattattccttttagcgaatgatttttaattcgggatgaatttatcaggacgtgacagccgagccgccgccgctgtcggtgacgtcaccgctgacgtcatcggggtcgtccgccgtgagccggtcgtggaccgatcgatctcggccgtccatcttggatcggttagatctcggccgtccgttcgcgtgaaccgccgcccgtgcgcccggtccaccaaaaccctagccgctgacgcaataaaccttctcttccttttcaaaattaattcattattgcgtcataattcaattttaaccaatttaagtgttttaatccggtttaatctttaaaaattcataactaattcatcttagctccgatt

SEQ ID NO: 67389 - DNA, 33463 bp, Oryza sativa
catttaatgcggcgcagcgtacgcttatccggtccgtgaccggtcgcggtgtgtgaccggtcacagaccggtcagatcgcaggttaggtggcaataggcggcctgtcacacgcctcgccccgtcccgtcggaatgatgagagcttcctggctctcgtccctagccggagccggtgtgctaactcctggagttagtatgtcagtcccggtcagatccattccaggcttcagcgcaagtatggcaaggaagtcgctggccattaaatgaatgttgaaatgggcgtccaccggaaaagcgggcgagcggggcaggaggcgtgtgctctgcttgtcagaggtcacttccggctgtagactagccctcattgtaaaaagcatgtttcctttcttaggtagctggaggcccttgtggtgacccctgaccagataaaaaggaggcccaggcctagtaaaaaaaaaaggaggagagaaaagagaaaggggttgggactctggcgaatgggttctagagcctgaactctctctcgctctccggctctctgtattccttcacgcacagatccaccagaacacaggagtagggtgttacgcttctcagcggcccgaacctgtctacgtcgcccgtgtcttgtgcacttcctctctcgctgactttcctcagatcgagagcgaagaacctcacttagcgcccccggccgaaccggcaaaggggggcctgcacggtctcccggtgaggagccccacgctccgtcaatgtcatatttaattttagatttatctttttttatggaggaagtagttaaattaaaagattcatttttgtcggtttagttgttaatttttaaattttttaattgcttggattttcaatctaattagctttagaatgattgcaatgattggaattatgaaaattagtatagaaatacttacattatgatataaaacttaaatatcctacaaatctttatatttaggacggaggttgtagcttaacaagtgtaattgcttaacacatttgcgatttgcgaggcaacgtgtgctagctacgtactcacttattacgccgtacctgtttaatttctgcctaattccttctgaaagtcgtcgctactacgttcagccgtagacttggctaatcataattcagacgtgtcaagttgcggcattgtactgttgttatacaaataaagtgcatatttgggggttgattttgcatggggtagatggatagctgctcgtccagatggaattgaaacatgcctctaatcgttgctaacatgcgcaattaattatcaatgcttctggagaccaacgcatactgcgcttaatttgtcgtcctcctcgttttagttaatgtactagagcagaagtttccgcatgtttctgtccaatgaaaatgtttaattttgacaagcttataaacaatatatagtgttcgcacgattcaagagttggcaatttgacatacgtatcagatactccacgagctacctagttctcgaagggaatattacaataatttgcacttggacaatacatgtatggataacaaacatccaccctaattacgaaactcctgagaggatctccagtagcagtaacctctagtttagagctcctaaatgtcaaatgggggctgccccaattcttttggacctaaatatgtcatcaactctagcagtagccctcatatcttagcctctatttcttttcctcttttattttagtatataatttatgtttatatatagtttaacaccataataattcaaacataaataattctagcacatagaatttaaccatattcgaatttacaatttcaaacatcacgattcaaatttgagttcaaatttttctaacatgaaaatgataaatcttacaagcaaatattgaaaataacccatagttgatagaaaatgcaaatgaacaaactaccgagcaccatgaagtgcccacaaatatttcacaagatcatctcgaagttgctcatgtgcttgttggtcttcaatttctttatgtatctttagaaacttctccaacacatgtttatcgcgtcgctggtaatcctccttcctcaacacctcactgtccccctgatcatagtcaaagtctacatcttcatctcgctcattgtcgatgatcatgttgtgcatgattacgcaagctatcattatgtaccatagggtctctgtatcccaaaatctagcaggacctctcaccattgcaaagcgggcttataaaacaccaaatgctctttcaacatccttcctcactccttgaacttttgcgtaatggattctttttgttaccttgtggattagaaatggtcttcacaaaagtagcccaagaaggatatatgccatcagcaagatagtaccctatggtgtatttcttaccattcaccataaactccaactcgggcgctgtccctggagtaagcctttgaaagagcggtgatctctgtaggacattgatatcattaagggaacctggtaatccaaagaaggaatgccaaatccacaaatctttagatgcaacagcttcaagaatcatggttggcccatccacatgccctgagtactgtcctttccagcctgttgggcaattcttccacctccaatgcatacagtcaaacctgtccctatgaattatctcacgacctgggactgaaccacaacactttcttttggttctcttatgctctatgtccgtaagaagagcagctgcaatatagtagttgtcatcatcggacaacacctcttgctcccaccattcagcaaggagatcatcgtcatcgtcggaaaagtccatgtacaaaaatcactgccatcacaacattgcaaaattagagaatataaatgcaactacagaagcatatgcacagcacatagtatatatatgtgcaagattatatatatgcataggacaagcaattattttaggataaacttgatgaagtatatatgtcaatggttcagatcgatccattgcaatactagtgcagtccaacacaatgcagtgctactaatataggtacagtgatacatagggatgaaactggttcggatagtttccgtccgtccggactaattttcggattcggaaaaattcggtcggaactattcggaatctctcggattcggaaacgaattcggatattttttctcggatacgaaaacgaatacagtaagggtgatatccgacggaatcggaaaacggtcggaaactatccgggattttttcccggatatccggagttgtcatcaaccattcagaataatcagcccaaagagcccatcagcccaacccaacccaacatgcaacaggcaacacaaaccctagctagctaagcaacaggcgacactcacacaacagccgccccacgcggccacgcatgacggcggccgccgccaccgcccaccgccgccgcgccccttcgccgctgccgccgccgccatcttgccccttcgccacagccgccgccgccgcctcgccccttcgccgccgccgcctcgtcgtctcgtcccttcgtcggcgtcgtcccatcaccacagccgccgcctcttcgtcggtgtcgtcgcctcggccaacagccgccgcctgttcgtcagcgtcgtcgcgtcaggccgtcagccaacagccacctcttcgtcggcgccgtcggccaagatggtgatggtaatattgagatggactatgttgatgatgatgacgacgacaaagtgccaatgagacaatgagtgtttgaatgaaatgtttgtcaatttaatttgcaggttgcatctaaactatgtctgtaatgaactactacgtccaagttgcatttaaactttctgtaagaactacttaaattttctgtaagaactacgtccatgatggacagtccatcagtccatgttacatctaaattctaaactatgtactgtgacttttatgtgttaatgtgtgtgactatgcaaatgtgtgcaagtttgtggctgttatgtgttaatgcgtgtgactgtcagcatgtacaagtttgtaaccggtaatgtgtgtgacagtgtgactttgtcactatttgcaagtttgtggatgtttctagttatggtattattaatcgttgatctttggaaatgtaacattctctattagaaaaaacaataagttatatttctttgttgatttgtgaaggtcagtttgatgggcttttatgttccgattaatattcgttaccgtattcgtttcgattcgtattcgctccgtatctgtattcgataatattcgattccattttcgtatcccggtttccgtttccgatttcgatttcgagaaaaaaaatatgaaaacgaatatgataaagctagtttccgatcgtatccgatccattttcatccctagtgatacaggtcagaattcaggttctcctctacggtctacaaagtctagcacaattctcaaaacgtattaaaaaaaagtaaagatccaccaggacaaccacagtaccacaagtactccgatcaagaagtgctttcagaaaagatgaactagtattcctaccacaaaactacttctgagttctccagaaaaatcgatcggtgagtgactgggcggtgtgaaggctggctggcgcgtggacgggcgaccagtgtaggggcgagcggcgtgcggatggggaccagtgtgtggaagcgaggaactcctacggtgaggagattacgtgttgataattgccacaaaacgggcgccaggattacaatgaggtatatagcttcggttcagagtttgttgtgagaacctagattacaggtataagttctatctcttctaactaacacaacaaactctatccggcagctatatggagcattatcacatgtacaaagaatatccggactctaacactccccctcaatcttatcctgtaaggtttagattatttctgaacatctctacctgtttgacagtcagagttttggtaaatccatctacaacttgatcattagtagatatatattcaacctgcaacagcttctgcgcaactcgttctcgaacaaagtgatagtctacctcaatatgctttgtacgagcataaaacacagggttagctatcatataagttgcaccaatattgtcacaccataccttagcagttttaggcacctgaatccccagttcatgaagcaaagtttgtatccacataatctcagcagtagcattttccagtgctttatattctgcttctgtactggatctagacacagtagcttgtttacgtgcactccatgatacaagattgggtcctataaacacggcaaaacctccagttgaacgcctgtcatccagacatcctgcccaatctgcatcagaaaaagcactaacaagcaaggaattagatttaccaatcttcaaaccaagcttaactgtatgttttagatatctcagaatcctcttggcagcagcccagtgttctgttgttggagcatgcagatactgacaaactttgtttactgagaaggataaatcaggtctagtcaaagtcaaataatgcagggcaccaacaagacttctgtaccatgtactatcaactggtccaagaggtgttccttcataagcactcaacttttctgagatagacagtggagtattaactgctttacagtcactcatattaactcgttttaacacatccttagcatacttctcttgcgttaaaactataccatcatttaccttcttcacttcaatccctagaaagtaatgcaactcacctagatcctttagtgcaaactcttgattaagactcttaagcagaacatcagtagcattatttgaggagctagctattataatgtcatctacatacactaacataaacattgtaatatctcccttactataaaagaacaaggatgtatctgatttagatgacttgaaccctagctcatgtaactttgtgcttagcctagagtaccatgctctaggagcctgttttaaaccatacaaagccttatcaagtttgcacacctagttaccttgttcatatcctggtggttgcctcatgtatacttcttcctctaggattccatgaagaaaagcattctatacatctagctgacgaagcatccaccctctagaagctgctatagacagtacagttctgatagtagcaaccttgactacaggactaataatctatgccatacctttgtttaaacccctttgctacaagcctgactttatatctgtctagactaccatcagttttcctcttaattttgtaaacccatttatagtctatcacatttaatcctctgctaggaggtactagatgccaagttttatttttcatgagtgcattatattcactattcattgcctctgtccaatttgaaaaattttgctacatgacacttctattgtgtgattttagccctaggacactgctcaaactcacttttgagggaaaacactccataaacatgatattttgccggtggacattgcgccgactaaaataataatttccagttgaggaggagattgaaatcgcgtgaaatgccaaaaatgcccttgggcccacatgccagctcttccatctccgcctgatccccatcgcgacctaccaccctctccgatctctctcgatctcctccggccggccgtcaccgctgtccgttttcgtgccgtcgtcgtcgtcgccgccgccgctgccacattcaccgtcgccatgccgacgcagcgccaccgccgccatcaaagccgtcgcaattgccgctgcaactaagcgccactgccaccactgccatcgccaccgccaccactgccaccgccgcgcgccaggatcttgatctcggggccgtccgccgtcgcctcctcgtcgtcgtcctcacccttcgccacagcctcctggttgtcgtcctcatcctccgccactgccaccccacgcggcgaaggcgtagacaccacacgccgcatttgccgcagccgccatcgccgcgtgtcgtcgtggtcgtcgtcggcgtcgccgcccccacaaccgggacagtcgcagccaccgctgccaccgccacttccgccattgacgccgccgcacaactcccagtgctccggcgctacactccaccactgccggcggcggacaactcccaacgctcccgatgctccactctacggacgatggcgctcccggtggaagagagatggaagatatggcatgtgggcccaaggacattatagaactttcacgcgatttctctctcctcttcaaccggaaattattattttaatcagcgtggtgcccactagcaaattactacgtttatggagtgttttcccccaaaagtgagtttgggcagtgtcctagggataaaaccacacaatagcaatgtcctgtagcaaaatttgccttccaatttttatctcctaaggcctcatccaaagtttgtggctctccagaatatgtgaaacacagctgtatctaacaggttcatcagtgtaaactttttcctttctaatgccactttgtagcctagtttttggtctcattacctcagtagacacaccgtgctgtgctggctccatttgtgtagatgatcctgacggatgtgactgctgcacacctggcgccgaggaagtgctggtactgctgtgctgtcggggagagctggcgacaggagatgacgcgccggctcccgattggtccctcgccggcgagcgcggcagccgtgcaggggagcctgcctgctccccctgagttccagatcccgagaccgccgtcgtctcgtcatgcactgctgccgaggaggattctcccgccaaatttccggtgctccgtgcacccggctgtgtgtaccagcacagctctctgattcaccattttcgttgctgatttgaccactgtcctcagcactgcacctgtcatttatccctgcgtctgtacaggcatcattagtagcatttggtatgtgaatattaaacatttgatcattttgttcctctcccccttgatccaatgtgctagtgttcataagatttgaaggaagcaaagatatttctgctctaagacgggcaccggcatttggatgaagggttgcaaagggaaaaacttgttcatcaaatgtaacatcacgagaaacatacaccttgccggtagacacatctaagcatttgaatcctttgtgaagattgctaaaaccaagaaagacacactgtttggatcaaaattggagcttatgagagttatagggacggagatttggccaacacgcataaccaaaggttctgagagatttataatcaggagcctatttaaacaaacgctcaagaggagtatcaaaatttataactctacttgggaggcgatttatgaggtagcaagctgctaaaaatgcctcatcccagaacttgagtggcatagaagcatgggctagaagagttagaccgacctcaactatgtggcgatgcttgtgctcaacagctccattttgttggtgtgtatgaggacaagacacatggtgggatatgcctatcccattaaaaaaggtattcaacttgacatattcacctccccaatcggtttgcatggcaaggatttttcgatctaattgtctttcaacaagtttttgaaactcatgaaatttctagaaaacctcagatttatgtttgaggaaataaatccaaacaaatttactgtaataatcaataaagctaacataatatttctttacccctacagaagtagaagaaggtccccaaacattagaatgaataagttccaagggattattcgacacactagatgatctaggaaaaggtaattgatgacattttgcttgttgacaagtatcacacacagactcattaactgaattactaagacatggcaacttattttgactaaggactcgaagaacaaccggcttggagggatgaccaagatgaccatgccaccgttcaaacgatggcgcaacagcaaaggcttgtctcaagggggtgccgacaggaagagggtagagacccccgccgacatggtccttcaagaattgtcctcctcgtggccttgtccttaatcaaaaaatattttccatgaatctcaagaaaggcataattatctgcaatgagtctatgaacagagactaaattctttgatgcttgtggaacatgaagtatatttttaagatgtaagggacgactaggggtaggaacaatggtatgaccaatatgtttaatattcataccttcgccactagcagtgtggatctgatctgttcccttgtacttctcccttgtagtcagcttatctagctgccctgtgatgtgatctgttgccccggtgtccacataccaattggtgtcaacaccataggcatatgtggccgcgtcgcctagcttctcgtcggggacgtagttctcatcatagcggtgccagcagtcacttgcaatgtgacctcgtttatggcaggcttgacacaccgggtgggtgtcgttaccgcgccctcgcccagtgttggccccgcctgcgccaccacggccgccactgcgaccgccgcgaggagcaccgcccgcgatttccaccgcgaccaccacgaccgccacgatttgcagtgtttgccgaagtagggaggtaggtttggcgaatactgatcctgttttcatagctcaaaagttgggaatacacatgagagattaagagaggagcaattcttgtcgttgccatcaatccttcaaccgctgcgtcgaagtcggagtcgaggccgttgatgatgtacgctatcagctcttcatcgtcaaggagcttccctgccgccgccatctcatcgccaagggatcgcatcttggcaatgtactcacttatggacatgggtcccttctgagtagtcgtcaaggcgaggaggacgttgatggcgcccgccttggatttgcaggagaatatgtcgttgatcatgttccatgcttgggctgtcgtctgcgcgccagccacctgctgcaggatctcccgtgatagggaggagaagaggaaccccaggacttgttgatcctgactgaatcacttgatgtattccgggttggagatggtggtcttgactttcttgtcgccatcttccttctcgcactcggccgccggagcttcaactgtgccggtgacatgcccttccagctgcgcaccccatagggtggtaaggatttgcgcagaccagagggggtgatttttcttggtgagtttatccgagatttgaatcccgaacagaggattggagatcgccgctgctgaggaagagctcgccatttgcagaaacacaaagacgaactaatctaatctagcaacaggctctgataccatgtggaagcgaggaactcctacggtgaggagattacgtgttgatgattgccacaaaatgggtgccaggattacaatgaggtatatagcttcggttcagagtttgttgtgagaacctagattacatggataagttctatcgcttctaactaacacaacaaactctgtccgacagctatatggagcattatcacatgtacaaagaatatccggactctaacacagtgtgcaggcaagcagcgtgtggccaggcggacgatggccgagcgtttgaacggctggcatgcaggcggaggccaggcgtgcaagcggaggtcggaggccctgtggacgacgacgacaacaaaggtaggaaaaaatcctcaccttttttggggcgatcttggcggaggtgggtgggggagtcgatggcggccgtcggaggagatctggtcgtagtgccgcgcgggcgaggcgagatcgcgcgaagcggattttttttcacgccaggaaaaaaagtcgatgggggccgtactcggaacccccaggactgggggcttgggaggagaatctagggtcctcctcactttgggggctctagtagggtccctgctgaatctagtttttatctctaaaccctcaaaaactgattaggggctgagtttagggtctctgctggagttgctctaatggggattgatcgccaggggcgatcgggtctcccccctctcctccacgtggtttcctttttaggcaccgctttactttcctattttagtaaatttatacacctaaagtttgtacacctcaagtttacacatctaaagtttacagacccaaagtttataaatcaaaaattatatatcccattcaaatttgaatttgaattcaaatattttttgtatatagtatttctatacatctaaagtttatacacctaaagtttatagacccaaagtttataagtcaaaagtttaattaccctcttcaaatttaaatttgaattcaaatattttttatatatagtatttctatacataaatttttccaactttgttttttatttttttttaaatttgtagtgtagtaggaagagaagaaggggaggaggaagggaggagaggtgtgtacagggggggcatggggatcgatctctccaagcgatcgatcgcccattagccacaccccctaattatccatttagttgaattatccatacccaaatatacaaaggtaaaaattactggatgtccattacacctaccaaatcatgatgtggaaaggacgggcatgcacagtactatccatttacatcacccaagcccattaaggctccgtttggcacagctccaattcccaactccaacttacttcgagctggagctgtgccaaatagtaccgattctcctttttttttggagcgaagttagtagagttgctacagaaatttgtactatgggggtggagctagttttttgctgctccataactccacaccaaaagacccattaccctttaatttttttactatatttacacaaaaatgccattgaactaccccttcctacctctctcctcccgttctctctcctctccatcatcttccccatccttctccgatggccacaactggttgtggcggcggcggcggcgtctacgttggcagcatgcgggggtggcgagcgcgggccacggcgtgttggcgtcggctcgcgggcggcggccgcggctcgcaggcggcagcgtcgacaggtggcggcctaggtggcggcgtgcgcgaggcagccggggaggcggcggcgtcgacagtcggtggccaggggcggtggcggagatgcgtgggccaaccggcggcggtggctcgcgggctgaccggtgccagcggctcgcgggctgcccggcggcggcaacgccagggtaacgcctacaaggtgttggacgaaatggcgatgagggatgtggtaacgtggagctgagtaatctagccaaacacttttttacctacctcagctcctaaaggagccagctctcactggagttgaagtttagagttgtgagtttgaattaggagctctactaaatggggcctaaatatgaaccaagagtttgtatttaaattttcttaatttgcttttgcactataaagaggccttgaaatagtccaaactttttggacatgatttacatcctattatctcgcttacacttacgcttttaagccaaaatttgatactttttaaatttaattttgggattggttttgtggttttttcatcatagtttattttatagccataatataaatttaaaattttcatttttgaagttgattttatgtttttttatcatagtttgttctttaaattttgaagttgattttgtgatttttttttcgtcgtgattatttcatagcatttgcttgataagggttcaacaggttataccctatatggtattcataaagtatggggatcgttggaaccaggatgtacgcgagatcggatatacaaacatgggataaggattgatactagttcgagcccttaggatgagtaataagcctactcaagtttatatggatatatggatgggaataccacaaagattacaatgggaaataggacaactagactgatccactgaccagaagctgtcgagaacgacctgacgaaatctactcagcgaatatggctctggcttcctccggattgcttcttgatgtggctttggctatggcttgtaactcaattcccctccctggacaagggggccttgtatttatagcgtagattattctattctccaaatataattcgaagagataaaacaggatatgggcctaagaagaccttatcttccccaactaagactcggacaccttatattccaggaagataatttcattctttatcaatcgtatttccttaattaaaggatacattctcatatactatcgagtatatggtattgccgtattacacaaacccatgtataggaggtatgtcttatccttgacactgacagtaacgccctgacactgacagtaacacccgactctaatgcaaatgagtaggttaatgttccagagcaaagatcctgaagaaaatcattgtcgaactcacctaaccattctcgaacagctgagtaagtttagagtacatgacatggtccttctattctctttgtccgagacttcaactcaaatttgaatttggattgaagtcagaaactttaaactgctataaacaaatccacaaaaactccgacggtgatttctccgtcttcctccaaattcgaaccgtcggacgtgggttataaattccacttatgagatccatttgggttacgttttcctaaacaaacattttgcttccccttcgcgcaccttcccactgctccaacaagcaaaaaaaaaaccctaagccacaaacttccctcatctcctcagcgactctccatggatcttccggagtccttccgagtttctttcacttcttcttgatttctatgatatgcaccttctccatctgaatcctaactcccttgattccttagtatcttcactcatttatgcgaggcttaccttggggtacagcttttcatagctctatttagatattttataagcttggatggatggaggcctttagaatctctggatgttgtagtctccatctgagggacaagatgaagggtagatacatcccctttaactgtccatcctctagaaaatactagagggatagctggttttatcttcatgtcactgataccactccttgtcttgctattcccgaagaaaatccctcatattctggggtcatggacctccaaacattctctgacccctgctctgaagggattcaatgacaaaattcatgatctctaagaacgcggtctgactgggtacgaagttgtagagaagactttgttcgtcgtctaatccagtctctccaagcccgtgctcaccctgcatacgagtacatgggggcaaaggacatgacgtggatatcgcactttggtagaacccaaagttttctgataaccctagtactatgaactgtctctaacatctaatctttcactgttatctttgttatagctgtttctgatgcagccgtggtgaagtgggtagggcaggtagtggtcgatccaccatcggccactgctgacatcccgatgccgataagcaacctcccataggccaagaaggacatcatcgtgaacgtaagcatctcggactattctccatatctatcatatatttggctatagaagtagtaatcttgacccatactagcatggcctctaacggatgtgatcggccagcttgtcaaccactaggcgttcgcttctttgaaggagctggctgtgttggagcaagcagccgccaccctcgtgcccagggcagtggatccaaaagaaaacgtttgccctctctcgagaagactactggggtggagacactagttaggacgagcagctctgaggtgaggcttctatttcaggtttgtctgacaatcatggtagccttctcgatcttaacctttcttgtttgcaaataacttccagcacaaagtccgcctccatcaagaagggaatgctaccgatgaaacaaaaagtcggatgagtaccaacttgacctttttttgtttccacttgacgtcgtgtagcttttgtaacccaagatgttttgaatgcagcccttcacctgcggcctcgggacaatgtgccaaggcttgtgaggaggtgagctccaagtcgcctcatgctactgctgctgctactgttgtccctacatttcttcctccgtcggccggcgcccttgtcatctcaggctcgacctctgcctccaacaagctgctacaagcttatcgattgttggaagcaagtgcctgagatgctgtggctgagcttggacaacttgcaaaagtcgcctattcggttgacaccgcattgtggccctggaagcccatctaacggaagagcgtgcggacaacgccaagctgcaggaggagattgccagcgcggaggaatcaccaagtccaaggacaacctggcttcactctggcaagctctgcactagaactacgggcgcctcgatgtggccgcaaaagggcctggggatgagcgttcctcatcccgagtttcctgacgaaaccacggtcctggtgtcccttgggtcgctgataaccaagctggagaccgccgcgagctcccatgcagaccaagtagacaagggaatgaggtctaggatccagaccgacgcatgccacgttcttatgtgcctcaaactcacacgcccggaggtcaacattgaacaaatgatgaccaagggaggagccaacaagcgtcgcgaggacatgatatcagaattggaggatgtcgaggagtctgtgatccccttttttgaagagtaatatgctaattttagtttcattgcaaccttaaggacaagtatttcgtctgttgcccgagaacacttcccttctgttatccttttaaggtttccatcttgtcttttgtattctgtagatgctttgaagtcgagaatgagaacgtccagcaaggcggacgctcgtcaggcttaattgcacatcctagtacgccctaggcctcgtcaaccccgagtgatggcgaccgtgctctggtcgtcgtcacttctgatggcacgttggcctctcaagatgatcaactcacgctccttcgtgagaaatatcaaggtgcgaaaacccgaaattatagtgtattgctcctgtactcagaacaaaggatgctaatggtgtcgctgtctattctagatcttaaacattctctcgaggagatgaaacgctgggccgagtactggagaactaagttcgaaaagaaagagccggagcgagcaaccgacaatatcaagaaaggctagaactcgaagcttctcaaggaaagagaagtccagatggaagcttatactgaaggttgttgcacatcgcttgatcagctatgccaagagttgcatgtggttcgtctagctcctaagagatccataacaggttatctaggctggctgtggagtacatgcgatgacctggttggcaccgctcattggatcaacaaaagcctcaagcaagagagtgtcggaccaatcagttcgctggtggtcatgtgctcgcgtgcatccgtattttgtgaccgcagatgaacatgaactgtcttcggcaaaggttttctctttctccacagacggccgccaagatcgatcaactagcccccgagccaatgtcggtggtgatattgatgtcgtcgtccagcgaactcttaacagatggactgattaatacttctaggaacatgccaggttccatttgctctctactagaagctcgtcgagcaagtttgtcgacgtcggcgttgtctttgctttagacatggtgtactataggcccgtcaaacctatgctccagttttctgacttctacaaggtacttggacaattcaggattagagcatttgtaatccttatgcacttgtttggtgactatttctgagtcgcctttctgaactagtcgtttgaccacaagtgatgcggctgctctaagtccttcgtactctgcagtgttgttggttgctcagaaatctaattggacagcgtgtcgaaattgatctccggttggtgacgtgagaacgaatgcagctcttgctccttggttgttgaatgctccatcaaaggccattgtccatcgctcgttgtccatacgatcgactttgccgtccttggggcggtccagtcggtgacgaaatctgcgggtacctgagacttgatagtcgtttgtgggacgaagtggacattgaattggccaagctcgatgacccatttggcaatgcatcctatgacttctttgttgcgaagaactttaccaagggggtatgacaagacaaccatgaccttgtgggtttggaagcagtgacgcagctttcgggatgtcatgaccatggcaaagagcagcttctagatcttcggatatctagtcttggcatcatgaaggacttaactgacatagtagactaggaattggaccttgtcgtgctcgacaacaatgacagtacctatggagaacggcgttttggcgatgtagaggaagagttccacctatggttgtggggcaacaagtgctggtggatcggcgaggtatcgcttgagtacaaggaatgcctcttcagcctctgatgtccactcgaacctgtcaatgtttcttcaataaattaaagaaaggcagtcctcgttctcccatcttggccacaaatcgactaagtattgtcatacatctggcaagcttctggacttcctcgagcctcatcggtgatttcatttcctcgatggccttgattttgttggggtttgcttcgctacctcgtccaaagactaggaatccgagcagtttgcccaatagtactctgaacatacactactctggatatagcttgagccgatgtctccgaagaatgttgaatgtttcccttaggtcatcgatcagacgatctcgattttttttttcttgacgatgatgtcgtcaatgtaggcctccacgttattgctgagttgggattggaaagccccttggatttggcgctgataagttgatctagcactaatcaggccaaaaggcgtcttgacgtagcagaatacaccgaagtggtgatgaaggttgccctttcctcgtcttccttggccatgctgatttaatggtacccggagtaggtgtcaaggaaactcaacagctcacaccctgcgatagaatctatcggttggtcaatccgtggaaggggaaaatagtccttgggcatgccttgttgagatttgtgaagtgtacccacatcctccacttatcgttggatttgcgtaccatgattgggttggcaagccactctggatggaggatttctctgatgaagcctactttgaaaagtttattgagctcttcttggatagcctctttgcgatctggcgtgaagcgacgcaacttctgcttgacaggttttgcgtcgggtcaaaccatcaacttgttctcaatcacctccctgaagactccggacatgtcggacggctgctaggtaaatacatctgcattgtcatagaggaaggtgatgagcttgagttccaatttgcagtcgagctcggcgccaatcttggccgtgtttgtcaagtgtgctactagacagcgggattatctttatggcgtcgtctggtttgggtgccaagttgggtttgctcactttcccaggaggctcgattgtggcgggactgcggtagtttgctcgactatatcaaggctcatcttgtcacattgcacggccatcttcgcgttccctggcaccgtgattatccttttaggtcccggaatcttaatcaactggtaggcgtaatgcgaagccgccatgaatttggtgagtgttgttattctgaatatagtgttgtaggcaatatcgaactctgctacatcaaaatgatatgctatgtctgcaagttgtcaactctgccaaaggtcacgggcaatgtaatcttcccccaacaaccttgatgatgactctggggtaatgccatggaagggctgttctgaggggatgagctcgcttctaggaatccccattgcgtcaagcgcgctgaggaagaggagattgattgagctgccaccgtcaatgagaaatcgcgcgactagaacgttctgaatagtaggcttgactactatcgggtatcgtccaggggttgtcgtcagagaagggtagtcgatgtcagagaactctatcttctgatttgaccaattcatcttagacgtcgatacccgagatgtagagcatacttcgtgttcttgtattcccgcttagaagaatagaaggttgaaccgccgaagatatacgccacatgttgatcgaagtcaggaaaatctagttcggcatcgaacggaaggtcattggtgccctactctaccatgcaaactcgttttcccttgtcttgggctatcttcctagtcatggctttctaaaatacattgcactccttgaacatgtgagcgttggtcttgtgcaccggacaccattgcagtacaaggccatcatcttgaggaggaggtcgttggggagcgcttttctcttattctgcgacaagaacctccgactgtgccttttgctttcctcctttcttgcgactagattgccaacttgattccatagcatcttgtttggccaactattttcattgactaacttccccttcccatcatttcttcgaacggccttgtctgcgtgagcacacctatcaatgacctcaaacagcttcattgtagatattatccgtcatgtcgccagttcttggattgtgtagcaatcttagacatctgatttgaatgctcatatcacatatgcatcggtgatctctgggatcatattctgacattcgttgaattgtcggataaaatctcgaagaggttcaccgtgcttttgtttgagggcatgcaaggcatcttagaccacatgtctcttgtaggtgccttgaaaattcgcgatgaaatgcttccaaagatccgcgcaggaagatattgagggaggaaggtgcaccagccatgaccgagcagatcctttcaatgttgccagcaagtaatttgccagtgcattgtcatctgcactggcggtgtataggatagtagaatagacgtgcaaaaactcctctagatctatgctcatgtcgtacttctctaccgctgcaggacggaattttaagggctagttgactttaaaggctctgcatccacctctaggtaataggggtggtcggcgactatgaggtccacgtgaaccgccttggatgatgacgaggacgatgaaggcggggtatcggtagtcatggcttcggccttgccttagagctggagatcgtgagtcttgtcattctcgatcatcgcgatgacttcgatgacctcgttcgttctcgtcttgtcggctctagcaatcatgacgatctcgatctcggtcgcagttacgattgtcatctcgacgattgtctctacaattctggtcgcgaggttgtcggtgtccggcatcgtgttggtcttgttgctcccgccttcggccgttcaattggtcgcggagatcgtgagcattttgatagggaggcggttgatgagtatgtcgtcgtggcgatgcgttctcggggatgcgatgctcactgttgttggcatagggccgttggcagcgttagcgtcctcgagaacctcatcgttctggagagggtcttgagggggcggaggcccagcatcagccactaaggcggagttgaggttagcgacagtggactccattcactttaactacgcttctgcatttcagcgggttactagatcaaacggagcttgtcatagtagggaatttacgaaagttaggtgctcggcaggagtgcagagtggcttgacttgtctaggaactctcccaagaacagatttcgccatcttcagtggagccctaagtatggctgtccgtgcccatgtcttcgaccacaccctgacgttcacgtcacgcatagaattggacccagaagattctatgctaaatttttctgcaaacttagtcaaacttgaaaaaattaatgaggaaaacaatcaaagcgacctatttataatatgaaacggaggaagaatatgcataagctgaacaacgttagtgcatttgcaaattggtggccgtgtgaaaatgtgccccataaccgtgcagcaagattttgtgataattcaaattttgcaagccggttatgttcccaataatttttttttctcaagatcaactaaaattcgttgaatatgatccaacaaataacaaatttcattgaatatgatccagattgtagattgatcttcaaatgcttgcgactcaataggtgaagaactttatataacgctggcacctaaaatacaatctaatctaacagtatatagtagttgtctagttgcctaattatgctgccaaattgcggtaccacccatgggtgaaaagaacacggggattgcttctggaagcaagcatatcgcatccaacatttacagaggtcactgacctattggccccttcaatgctaatgatttccattaagcaattttccaaaatgacaatgcacctgacaagctacatcaaccacgatacatcattcgaagaaaccaaaccaataattcaaaagccaaactttcttgttcaagtgatagatgtgcaatgtcataattcctctgcataactaacatgacttgaggtctacatatttcatactacagcatcagaaatttgcaaaaataaacttggcaagtcccaacactccaaaatatgctctatctcagcacggtcaaagttggataattccataacctgaaataacataagcaaataatgaaatagttgtccaacgtagcatagcaattgttatgtaaaaagactaaatgatgacaattagtaaacagtactccctccatcccaccctctatcccataatataacacgcggtcaaagctggcacggtctccaaaactaatctttagcttataatttctcatatactataaggtttgtagcaacaaaattataaccatattaaagtaaatttaaatctcaatctaatgatataatttttaataaataaaattaatttcatattatactaagtgttggtcaaatgttttaaaagttgaatcttaatatgtgtgcgcgccatatattgtggtatggagggagtattttgatgtcattggctttagtgccctttacttagaggatgatcaatctgggatggagggagtactatttgtacattcttttaagaaacctgtagtttaacctacccatttttgaaaataaacatggcagcttcattattaatctactatattcaagacgcaaggtccggagcataaatgaactacttgttaaccacaacttcacttttttgcggccttcacaaaggagaggctaaacagcgaattgatcgtgaacttaaaagagatctaatcacattatagctccatcatggatactaatcagaacaaatgcatttttattgtctggcaatagagtagactagacactgtgaaatgaaccaaatactgataggcataatatcacacacaacattcattggctacttgttatgtttatcaatggcagggcatatgaaacaatttcatgcatggcatttgtattttttttcaatccacttctaggatgttgatgttcgctaaaaatatcaggtaagtatgtagattatatgaaaatgctaataccatttatcatgaaaaattattttatcatgcttttctagtatttaccagaatattgaaaacattttgaagactaaagtaatgaaatattaatcttcgaacattaaaaacatactataaaagaagattgtttgcaaaataatgttttgcatacacaattaataaatcccaaagtttccattagaactaacattatgttaaaccccaaccatcttcccattaggaaacgcccacaaccaagcctaagccttcctcccaactgcacacatgatttttaggctttaagcttttgttgctcaggaacagaatggttaaaccctatagcttcttgtgttttccaactacaatatggtatggccgcattagccctacatgtttgacttttctaaaagtgtggagtgtggattgcaggtaatttattttcattaagacataaaataacatggcaattttttagctacatggcactttggagttgctcgttcaagtgggtaaggtcaggccaagcaactgagccatcagcagagtcccatttgcttgacaaacagttgaaatacatgttttcagagtagaagcaatcaggtaatagtaaatcatcaactgaatgcactggaatccaaaacaattttgcagctagactattaacatatctaaaatgtccaaaatactattgagcatatcagttttctttgaaaaaaagtattagttaactgtatgctcaacaatgagattactgtgcctatcattagatcatcaggataaaaaaaatctgaactgcgttggctttcaacaatcctattgactgctacaactattcataatgatatagccaaaatggtttaactgcacatttccaattctgacacttggtcgtgattggagagtatagtagtacaccacccaaatggccaaatcattatgccccttggagttgaacaacagtatgacccagagtagcacagtcaaagaaaatatattgttacatctactctgagttacttagtaataacaaactaattgtaaataggacaggagggaagttgaaaaaagactgacccaagcttgcactgtatttttctcctttcgtgtcaacaaaaatgtttgaacatacagtaacttctacaagtagccactacttttacatacaagtttagataatattttgactgcggtcaaagcatctagctagtagaacttgaatttgttattaagtaggcattggttgagacagccaaatctagtagtatctatacacaaaccttggtgaatgagtctttgaaactgttcatgcattagcatcaagaaacccaaaatccaagaacatcaatcatatccacacaagatgtttcaatagacaaggtcaatggcaaaaagctgatcacatgttctatatgacggatcacatattgtttacaaatgcaggatgaaactgaagcattgatgtggaacagcaaagccaatatagagagcacatgggaaacataatgtaccctaaaagaaacaatatagcatcaatcctagactaaacactttgatgcctaattatacatttcatccgagttcattgatgagaacataagcacccctaggtgctcaaaggtgctaacgaagattaaaaaaaaaaagctaccatgggtctaagcaatgtggagccgatatgtattcatgaaaaaaggaatgtaaaggtaggtgcggctaaaggtttgaaagctaaaaatgcttaccatctaagattaacacagtaacacctagtgctaagaaacatatttttttcaacgtgattttagtcaacactgtcaaaatttgataaccttagccagtgacaggtccacaactctgtccacatagaaattgtggggtcagctcaaccccgcagctttttagaaccaccttgtaaaacttcattttcatgtgtaaatccagaaagaattagatatgacttcacttaaatatgggtaagaattgacccaatagtataaaattccttgatctaccattgaccttagcatcttcgatggagcacaaaaaactaacaagcatcttgagggagaaagtgctaaagcatccaccgtgatacctaaaataggtcttaagggatgcacatgctcttatcatctagcagtacgttatacaaaagacaattagaacaacagcaaattcatgcatattaagcacatataaggcgtcactgtagtatacatatcctaaggctcttcagaaaggacatggtccctttttccattagagaagccaatagcaaaatacgtggaacttcatagctacaacaaagtaccaactactaaggatgcatatgcctatctatccacctatagaaattgggcacttcctaggagctcccacgttaaccataaagatctaaccgttaattagatggatcatcttcttataaccgtagattggatttaggatttgtgctaaataaaacacgacctgaaaatatcgtggactctttggatgcaatctctacatccataatgacattgatatctctatcaggctcagtatcgtagaaattcatggctctgcccgcgactgtatcgtcgacagccactctaggactgcgagacatggcatatcgatctccttcgccttcttagcttcgcggtacacctgggagaggcaaagcagcagggttgctgcatattgccgcaaaacacaacataccgctgtagctggtgtggcgacaaagcagttaggtggcactgaatttatggagaaaaagccgtcaataaattgtgattttgtattgcattgaggcagcgggcagcagatggtgggggtgaagacacaaattggatcaaaagcggaattcgatggacaacagtagtagagaaccaaaatgatgaatgtaggtgggattgagggcctgttcactttattgccaaaaaaaaccttaccaaattttggcattgccaaaattttggcatagttaccaaaattttggcaacttgccaaaattttggcaggatttcttatatagttaccaaaatttgacagcaaactaaatgtagccacttttttggcaactttaccaaaatttggtaaggttgaaaatggcatcaaagtaaacaggccctgagttagaagatagagaatgatgtactaatttgcatgaaatcatgattcatgaaggcacagaactcaacagtgaagacaaagaagacaaagcgagatcacagtgtcaaataaaagcattctggtctatccatgaaccaatcaaataccactatgcgtcttttaattggccatgcatgcattgaagcaaattaaagcaagaagaggaatatacgatgcatggcagcttagggaccggggtgacacaactgaacaagttggaggatctaaatgagtgatctgcaaatttagggaccgggatgacacagtcgaacaagtttgaggacctgaatggtcgatttgcgagtttagggaccgggatgacacagcggtacaagtttagggaccggtgatggactttactctttatgagtttgtaattgcagcaagtgctttagagcctcatcggttgcccatatttcctaataagcccaaacggcttattagggaataaaaaattaatttataggtaaaaatttaatatatttgtttgtagcgacttaaaagccaacactaaaaagaaattacgctaaaaatatcttaaaatcaagctcaaaatcaagttcaaaaattcaaattttggcttttgctttggcttattaggccaaccgatggggctcttagcgtttaaatattaagttcaatcattcaaagggattttgaagaaaaaacattcaaccacttattcatcagtttaaaatttgacagatatttacattttttacaatactgtcaagtgcaacgcacgggtgagcaactagtgttatataacgaggctagcaagtcctgcacaaaatattgaatgatctttgattctgttgttcgatttatgttaggaatctgttatgtcactcagaagttggggcagagtagtgtttgactgaagaagaatttctgaattaccaaaatctacaccaaacataacaagtagttgctaaaaaaagcacagtcatgccaaacgttcaagttacaatatttcatccaaaattacagacatgaaaggaaggtgaaattccatacctcagaaaccgaaggaagaaaccatccatatcgtctgccattgtacaagcatttacctccagctgctgggccagaaggtatgaatgctatatccagtcttccagttatccaaaagaatcaccttcttcactgcccaccacccaattatcatgaccgccagcatcgtaaaacgctggatctgcaggctctccaccctcaccagcaagtgtgtcaccatggcgatcatgagccccacgagagtgtacaagaacccaaccgcaaaaccctcggcgccgagctgcatcccagacccctggtagaagaacacgagcttgtttggatcggaccggtcggtgatgaacatcggcgtgtgcctgatgatcccgtacatccccccggacacgctgaagaagtaaatgaacagcgccccagccatccaaacccgtcggtcatggaacaaggtctccccgtccatgatcctcttgatgaggaacggaatggagaccaagaagaggatgacgagtaggatcatctggttgcgggagacgaggggcgggcggacgatggggccgacctcgaggccggtgcgggactccacgaactccgccatggagtcggcgaggcgggagaagtgggactggtccatctgctcggagccagcgaggcgggtgtgctcggggcggacgaggcggacgtgggggagggagttgacgccgaactgcgcgaacgagtgctgcgactccgagaactcgatgtcggcgaagaagaggtcggcggaggcggggttgtgggcgaggaaggaggcggagaggagggcgaactcgcggcggagctgggggaggtggaggtcggtcttggagtggagcgaggcggcgtcgaagaagacgagcacggagtaggggcgcggcgccggggcggataggaagcgggtgatggaggtgtcggtgaggtggatcacgcccgacggggagcgggaccgcagggattgcagctcggcgaccaggtcatcggcgccggcggaggcggcgccggcggcgacgaggagcgtgagaaggaggaggagggggtggggtggggactccatgggcgattggcggatctgggcgaggagacgaacggacgagacgaggaagaagacttgggttggaggtattggactggtactggtaggtgggcccgcggagtcgtacggcctactcgtactactagtgatgggctagtgccccgaaaattcggcccaaactgaacccaatgccattttttgcggttttgttttcaaaggtttttcccttaaaatttatccatttttcagccgttagattagaggtatttaactatttcccattcttcaatgtagtatttaacgatttaccaccggatccaatggcaaatttgttaaatttcacatcttaaaaatggcaaatagttaattaacccgttagattaaccccgtgatatgcgcatactttcatgtggttttggtcccacattaaagttccaactcggcatactttcagatggttttggtcccacattaaagtttcaactcggctgtagagaatatgtaaaacaagtcacatacataatccagtctgaatctgatttgggttttgggccttgtaaatatatcgtgggctaagtccaaggggtggacgacctagggctaacccccagcctagtcctctttgcggaattcacattagctgtcatagttttatagccggatttttcttatattatttatgtcgttgcagtttcgctgcaagttcagtttgtggaaacccaactttaagttcttaatcattcatctgcaaaataagttgtaatataccttgttcttgcttgagttcttcaattcgcatgcagggattagccttctcgaagaggccaatcgggtagcacacggttgattaccagaggagacgtggtgttgcgattgtagggtttggatcgtgttgattggaagccggatcatgtgtgtcaagtgtccgccaaatcaagagttataaatacctatcagaagattagaaccttgttcctcaccagagcccatgcacgggccaggcttggttggctactcttccaccatcgaggagtcgggatagatggctaggtggcgctcggctagggaatctctcctccctcttgagaggacgcaacatcacttggggatggttcgctaacatttgtagcgggaatttctttcgatgaccacctgcatagatcacagctatacaagatacactcaaagacatcacatgcaagttcaagccaaagtcaagaagttgacaactttatggtgggagcgccacgatagctgagtctcgacgcctcaccttgctcctctgtatgatgtggaggcaaaggaccagtgtctcttgcctaaggccaaaaacggtacggaaactttccggattccggacctatttttgaaaacggaatctgacggtcggaatttttcgaaaacggaaacgaggaaatattttctcgtaaacggaatcgaaaatgataagggaagtttccgtagcaactcggaatcggttggaaactttccaaaaattttctcggaatttttggaatttttttcggaatttccaaaaattttgtaactgaaataccctgcgttattttttaaagcacttaatagtgaataccatggtgttttactgttattttttaaaaaatattttttatgcaaatctaaaattacataagaatatttttttcctacattgggatttatcaacatcattactctcttaaacatagataatttttttcatagattgtgttttgtgatgtactgttaatacttaacaattggacttatatgattatgttttatgataaatcgttgaccgttgagacttgagaattggatttatcagtttgatgggttttttattccgataaattttcgttacagtatttgcgccgattcattttcgcttcgttttcagtttcgataatattcgattccgctttcgtatccgaggttttcgattccaattccaattccgaaaaaaaatatgaaaatgaaaacgataaagatggtttctatccgtttctgtaccgttttcacccctactcttgcctatgcgtgcggcaacgacagatatcctagcctcgagcctatgagatgaatgtgcaggtggtgaggacagtgataaatcgatggtagtagatatcctagcctcgagcgatgcaaatctcttggcgatgagtgctagagtagatgtgcctaccttggcgttttcacatgattgagtggatagtgaaaggaccttgatgtcgcctagaggttgggtgaataggcgttcctaaaaattatcacaacttcatagcatatcagagtgatgataacttttgattcaaatcgaaacttccggtatgggattggaagttccggtctcaatcgaaaagttcggcggataacggaataaacactagctatgaacttgtagctcaaacaaacaaaatgtatatgaatcaaaaggtgacaaataaggtatctaagcaagatataaggtcacctactaaatcaattaagcatgcaagtagatcaggtaaaaacaagctcaagcacaatatgagagaatgcaagaacgggcaaaccaagaggggagatgcgtgatttgtttcccgaagttcggatccacggatcctacgtctccgttgaggagccacaagggccaggcctatttcaaccctttcctcacgagggtgcacaaatgcactcctcggtttcactattgatttcttcccttgcggaggcgaaatcgaagccttcacaaactttccatggcacaccacaaccttgggtgctcaccggcaacgcctagccgtctaggagaccttagtctccaagagtaacaaacacaatcgaagatttgcttgctatgaactcgagtgctcaaagtatggagtgaagctcactagctctcaacttctcaatcactcaatccaactctttccccttctcaaatccctctcacaaagaggcacacaaaggatggagtgaagctcactagctctcaactcctcactctctcaatccaactctctccccttctcaaatccccctcacaaagaggcaccacaaaggtagggaaatggggatggctatttggctttggatgtgtctaatactccccaagagcagcagcccctcaaaagaggggtggaggagtttatatacccgagcccctcaaaaactagccgttggaggccaagactgtaatttttggagtttccgaaaagcattttcggacaagtccgaaaacttacagaagcaaatctcatattcgcagccactttcggaatgtccgaaaattttcggagtttccggtaatttttcggactttccgaaaagcacagagtaaaacgactataacttttcactcgggagtccgttttcgatgaacttggactctatagaaagctcactcagaggactacccaactcaaccaaaaacaaggtctaaaaccactcaaaggataggttaaagcttgggcttctctcaaggtagcactatgataggtcactttgagcaccgagacatacacaaacacctcgacgttgcatccctcttaatagtacggcattcctaaactcaaatgtaaataagaagataattataccattaggaatgcctttttttcatccttctttcattgtctagagggacgccaatgccgataccgtttcaccatatattcttcaaatgattgatgcggttacttgtagcttcaaatggtctctcacggtccatcatgacaaagccgtcactcgccctttaccaccaccggatttggtccttcggcgccaagccccttgcttgcccttcaccgccgcatggtccatcgcgaccgagcatcgcttgcccttcaccatcttgccataatagccacttcgtatcacacatcttcaatatcttcactttgtcattcttggtattgttaggtgtaatgatatcacttgagcatcaacacctttgtaatccttgggacctatttctttcattcaactcaataaaattattagtcccaatgatccggttgtcaacctccacatgttgaccaaccgatcgcatgtataaaaggatatgaataaatgatgagtattaatcaacaccacaagtgtcatatactcaaatatatgttcaaatgtaaagatcccaattaaatgaaggtgaataacttggattgattacatgcataactaaagtataggatttgctccccctaaatgtatgcatacaaaatatttgtgtgaagcaagagcatgcataacaagatattaaacattgagagcttatcctatacaagaatagaaggcatttctcaaatatagatattaaaataaaaatataccttcatcatctccacgttctcaatgtaaatagactaaataagagataatactcaaacaaaacattagtctcacatgcatatgccaatcacgtggaaatattatatacgaacatatcaatatgtacatgaagagaaagagtgatacatatagcttgatctccatgcatttcatccttgtgatttaggtccaccaacactccaatttcatatccacatgagaataggcaaagaaatgcttataaaaacattagtctcacataattggatttgttattaatcatcaaaaccaaatcaatgtcacttgaactttcagatagctctctttgcggggtagtaggcttttgttgacgtatccctaatgagggataagggtggcctcacgcctacccaaaggctaccgactttggggccacgcaaagcggctactctgggagcctgcttcttagctttttccctgcacgcttggagcttaggaactcggcgggatctttggcgggcctttttcaggagcccttctccgaccatcttaggggctcggatataaagatcttagcatgatgactaacagttatgggtggaagtaaaacgaaggacatagacaataatgtgcgagctttacctaaagatgtggattctcgatgttgaaagagtatgggcaccccttggtagtaaccactacgcctagcttgaagatttttgtccaggtggtggcctcattgtccctattcctctcatccaattcccaagtgggatatgtgggggccacaatactcaaaactcatatgcaccctgttcttgagtgtttggatgtgccgaagcacgaagttcaaagcgatgtagacgtcggccagattcgcctccttcaacttgttgaaagaagataagaggggcatgactagcatacggaggaagagaaggggaggggtttgagtagtaaaaaacactcaaaattccaccccttcaaagaagatttgaggggaagattgaagtaatccttcttcttcttgggccacagctggtggacgacgcctccaaccacctggggatttgctcaggaaggctggggcttgaggttgaacaagtgacggaagagggcgaagtgtgggggatcccaagaaagcttcacaaaggttgatgaagatagcaatctggagaatagagttaggtttacatgaataagctcgattccatagaaatcagaggttgcaagagcaaagccatggtggaagaagggctctaatcctataatctcactcgtattaggggtggggaagagctccgtgatggctaggcgccagccgatgatctcttgtgctggcaatagcttgtcctccaccagatcatctagtttgctcccattgatg

SEQ ID NO: 67390 - DNA, 574 bp, Oryza sativa
caataatgaattattttgaaaagaaaagagggttatggcatcaccgggctagggtttcggtggaccgggcgcacgcagacggttcacgcgaacggacgcccgagatcgacttgatccaaaacggacggccgagatcgaacggtccacgaccggctcacgggagagggcgacgatgacgtcagcgatgacgtcaccaccggcggcggcggctcggacggcgcacgctcgccggcgaacggcggcacttcggcacgaacggaggacaccaacgggtagagcgcgacgcgacgaactcaccggtgaccaaaggagcggcggaagaccaacggacggcgacggcgacgacgaaggaacggcggcaaacttcgggtcgacggctgcgacggtgctccggcggtcttcggcggcggcgaaggggcggacgaggacggtgacgacttggcgaccacgacggcggtcttcccgagcgacggcgacgtctggaacggcggcggcgcacggctggagcgacggcggcgacggcggcgctagggcacacggcgctaggacgctacggacgacgagaggcgaaggc

SEQ ID NO: 67391 - DNA, 7831 bp, Oryza sativa
tttttcttatacgcattttagtgtttgccaatttctttcgaattttaattaattctattattccttttagaaaatgatttttatttcgggatgaatttatcaggacgtgacaaatccaccccccttacaagaatctcgtccccgagattcgaggaggctagcatgaagataggttgggcggccttctcttcttgtctgacttcttccgctccgtcttctataacaaacttgcctaacaaaacttctccactctggactgcttggctcgatctcctgttgcaggtggaatcttcttttcacctgactcgaaccagggtgcacctttcagctgacgcagactaggttgcggtagtttaatgatgcttccgttccagaacttctcacgattcatatcttcggcgtcaacctcacacaagttatcaacttcatgtcatgtgtcgtaacctgcttgtcattactaggataccatgcttgtcatcatgagaataccctgcttggcgtttccttccagcttaccaccatatgctttagactatgatatcccccttactaaggataccatgattgacaacttgccattaactgtctcatattagctttcctggtctccggtgctaggtacttctgctattcgatgcaagggtcaaccactctaactataagttatgcttcccaagagaaccaatttatcccacttgacatgctttgacgtcttcccgaatgactttgctgctggacttgttattgtctgatcgtgatcctgccagatctgaagcttcgttgttagaggtgattttaatctgacctctgtagactatcttcgaacatatcacttggttcataactgggaatagctcccacgaacaagcagctcagattcactttctttacattcagtttacttcccattattatcttcaggttgtcctcagttagcattcaacgtattcctttacacctttaaccttgatgtgttctttcccattggatcatctcccaagacatggcattacctggtaaccggtgcttgcacttttcacttcgtgtagcatctgataccgagttgaagatttcactccttgccttcatagaaacacttttacctaggtcatcttgcttacttaatgacaaggtgattgttgcggggcaattactatcaggggtcttccttgagcgatgcagagcatgtttctgtttatcaatcacctttcggcctacttctttcatgctggagaacatctttgccaatctcttttatcaatcatctttcggcttatctctaacaggtggtattctttaatgtggattgcggacgcttctggggacgatgaggtcctttggcttgctgcctttcagcgaaacctggatgtggttcgtcaaaaagctgcactgactaccttcagggaaatacattgcttgctatctgtatctatgccactagggtttaattgccgatgatcatctttagtgcttcctcgagatggggagcatccatattgttcttctgccatatcacctttgacccttttctgatacctgatagactaattaccaaccatcgactattatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaaccctatccccaactactgtctcattggctttttaacccaacacagtttaattggttttcttttccatccacaggttggttattaactcgaggttagaatatagttcctctgacacgagaccctaggtctcctttgtcagtaaacaattatacacatgatcacatatccgcatcttccaaaagaatcctcttagaacttgtctgtattacacatttctcccttattacacgaatacaaggcactgccttaaacaaaaagggaaggtgcttatcatcggtacattgtatcctcaacatgaatcatccctaaacatagcaagctcactgtttacagacatgaatatatttattaattacatgattgctgcaaactttcgattacacaatgataagtagcgaactgaaaaccacaagcgtggctgctcattttgattctggagagatatagctggcgttgttctagtgactgcatcatccttgattggttctgtgatgatgtgataggactgcatattgccatcattcacaggagaagcttccttctgagtgctgtttgaagcggatgacggtcttctgcttggtatcgccctccagaggttgattgcccttggctcggcctggagtaggtcggggagagacacaacttcttccatcgacgacaattctttgctgaggctgtcggtgcagagaatggttggtgctaaaggtattattgctatgatttattgcagagttaggtggagcaggaggagcattggtgctgtggatgatgtcgtcaatgttgctgttggagctgactagctgatgagacaatcgtagggttgttcgttggatttctgcggtcttggtcaacaacacactgagttggcaatccttgggcacatggtttgttccttcgcacagaaaacatgtcaccttgcgagtgggacactcccctggtggatggtcttcttcatagtgagtgcagagtgtgagacacatgctagcaacgtgtccaatttctccacaacgggtgcatgcctttgatccgaagaagacatatctgaaactcttagtccaaacaaatatctctttggttgatcacttgattttcttcgccatcaatcgctaggttatttgattcataataagattatgagcttacggaaatgagaccctaggtctccctaatcagcaacaaaatgtacacaactcacagcacttgcaatcttaacatggatccttcataaacttatcaaactccttcataatctcatgtttctctgttattacatgattgacgggaacaactataaaacaaaagtatttgaacactgatataagagtattatggttgcttctgactagcgctaggcttaacaggtactgcatttgctccagtgaccacttggcgattggcatgcctgcttccttaacaggtactacagttgtaacagacaataactttcttacgctcgggttcttcatcttgtacttgatttcttggctgctgtgctggaacatccaaaggtacaatgccgatactggcctctgtcttatcaactgatggctggggctgaaattgagcattgacaccttgtggtaatgcactcgctggagttggagctgttgcaacgcgggatataggactgcttcgggatgcatggatgacaattcgctgagaagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaattgaattgacaatcttttggtatatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttacgttccatttcgtcttcatcatctgaggagacttgatctgaatcttcactatcagacactctacctccattagctaaaagatgctctgtcaactgtgatacacctcggaaggtatttcttctctgacgttttgtcattcctggtggaggccattctgtgctggtaatgatcatcttacggacttcatcttcggttcgcattggtgtttttcttttctgctgaggacactcccttgcatagtgcccttgctcatcacacataaaacaaatgatacttgcttcttttgagccaacatgtggcacatcaccatgggtccttcgggatgctggcggcatgctgacttgtggtgtgagtgcttggactgcctccaactgcacttgaggttgtatttgactcaggttcagaattggcgtctgatgctgctctagtatctctataagcaatcggttctggttaatcaggtgttggaccagtgtcacacaactggtgtctggtgcttcattcattcgggagcttgaggtaccaatgtcctgacttctgaccttattgcctttctcattgtcagccatctgttgcaaaggtttggagagggagagagggaaaacaaaggggagagacagattagaaactaaggatgggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttcccaagatcttcactcctgcttcacagctggcttcactgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggagaaggagaaaaaaggaactttcgcaaatagttttatttataaaatatgtccttaggttttatccacttggcttatcctacagtcgagatggctctgataccagcttgtcgcgaccgggaaaattgcattttcccgaacgctagtgtattaatccccgtcccaggaaaagccggggtacaccatacaaacacgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcgtactgaaaaggggaaagattgagcaagaatgagtacaaccacagtactcagcaagccacaccggagatgcataattaatgcaagggagtacaaggagataataatataggggttaagttttgcagtaaacagcatttaaaagtcacttagttgcccaaagccattttataaagacgatcctagagctacacagtattattaatcaaggccgtgaccccacacgaacctgccttaacccaaggcctacgatgattcagaccgaactggcaacccgaccctgggtctcagctcgtcccaagccaacccaggccaaccattccacatttcagttgttgagcaagttttaagaatttaaacactaacttgggtacattgctaggcttgcccattaccgagggcgcggctattcgaataggtttactctgatcagaggtgtacatctttacccacaagacacgtcttcctcacgtgcaaccacgtgccacataccaccacggtatacagacggaagacgtgacatagtttccaacccatcctagccatagacaagagtaccgacccaaccccacctacggccggaacttccgggacaggtaggcaggattgagcccctagcagcaggacaccagccctgtgccatgacatctcgactaccgggccgcagctcgtgtagccttcatttgtcctagagatgtccatcgacccccgactttgtccatctccatccgtgtacttttgtttataaccagactgagccacaaactaagccttacccactagacatgtggaagtacggtagtgctttgcaacagaggcccgaagaccggtccttatatggccgaggtgccactatcaaaaccatgcaccccgagcccagcctaaaaccattttgggggattttgaatagagggggcggtgtgaatccaattccacaataaaccaacaattccaaagtgtccaggtgatgagaatatcccaaagtctagagttgtaaaaccacctaatgttacctaattaaacagcgaagcatctacctaaaatcatactagtggtaccatgagtagagtatccactagttggggttttgtttaatctagggtgaacaaggtaataataacagtaacaataataataaggtcataacaaaggtaaataggcatggctaaataaaacagtgataacgcgggaatttaaaataagcgacaatgcaataatttaaatcaaaataattttataaactgggattcaatatgtttaaggatgatgtgacttgccttgctcgctttcccaaacgacggcttcaacttccacgaaaagcggatcttccgaagctgcagcgtctacacgaccaacggaaaagaaaaggcttttactctaataaactccacataacaagcagaaacaaagcactaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatcggatttattgcgtcagccgaggggaggggtgcgcggaccgggtccacgggagtggggcccacgcggcagccacacggtccacggtggactgggtgcacccggctcacaccggccggcgccgtgggtcccacgcgtcagccgcacccgagggcgcgggcggctgacggccgggccccacgcggcagccactcggcgcgcccgagggcggccaagccagcgcggccggcgggagacggcgcgcccgcgtcccgatggtcgccgccggcgaccaccggcacggtggagcggcggccgatagaagggagggtagggggaaaggaagcgacggtccacggctcaccccggggcgacggcggcgacggaggaggcggccggagcggagggaggtggtggcgcggctcgggtcgacggggtttgtgcggcgtaccggcggtcggcgtccgaaacggagaggtggatgaggtcgatcgagtatgcggcaatgccgaaggaggtggctgccgaggtgggaggcggtccggggtgatgtcggcagcgggccggagctcggtcggcgtcggcggagagatagagagcgacgtcgcgagctcgaatccggcgagcaggaagggcagcgagaggcggaaccggacggaggaggtgcggggagggtttaaatagagccggggcgagagagggtggccgggaagggaggaaaccggcgcgggaggtcggccgccttcaatggcgccggcgagatttgcgggggcaaatccgcccgtttgaacgcgggagagagagggagaaatggggggaaagagagagggaatcccggggaataattccccccactttaatgtgcgcggggacggcgggaggcggcgggattcgcagcggcggcggcgctagggcacgggcgaggcggcgggagcggcgcgaggtaggggatgacgggtgggccccacccgtcagcgagggtggcgggcgggcccgcccgtcagcggcgcgcgcgcgggggaaggccggatgggccgcggggaggaggagagagagggagggagctgggccgagccggcccaagaggggaaaggggggggggaa

SEQ ID NO: 67392 - DNA, 10624 bp, Oryza sativa
attctccgggccacatttgaatttttcttatacgcattttagtgtttgccaatttcttttcgaattttaattaattctattattccttttagaaaatgatttttatttcgggatgaatttatcaggacgtgacaattatctatggtccaatgaatgtactgtgatatgtaaagccgatgtggttaagtatatgctatcagctccgattctaaaagatagggttggaaagtggatatttgctttgacaaagtttgaccttcggtacgaatcgccaaaggcaattaagggataggctatagccgattttattgtggatcatcgtaatgattcaatcggctcagttgatattgtaccatggactttattcttcgacggatcagtatgcactcatggttgtgatatcggcttggttataatttcaccttggggggcaaattttgagtttgcctatactattaaacctcatgtaactaacaatcaagctgaatatgaagcagttcttaaagggttacaattacttaaggaagttgaagccgatgctattgaaattatgggtgattcattgttggtgatcaatcaattggcaggagaatgattgcaagtatgaaacattgatgatttatcatgagaagtaccgaaagttaattgatgaggttcggcttgtaacctttgagacatacatctcgaaaacaaaatatcgaggctaatgacttggctcaaggtgcatcgggatataagccgatgatgaaagatattgagatagagattgctacgattaccgtcgatgattggagatacgatgtgtttcaatatttgcaaaatctgtctcagtcggtttagtagaaattgcgttataaggcgttgaaatataccttgttagatgatgagttgtactatcggacgattgatggggtgttactcaagtgtttaagtactgatcatgccaaagttgcgataggcgaggtacatgaaggaatttgtggtactcatcaatcggctcataagatgaagtggttgcttcggcgtgcaggatatttttggccaacaatgttggaaaattgcttcagatactacaaaggatgtcaagattatcagaagtttggagcaattcaaagagcaccagcatcggctatgaatcccattatcaagccatggccatttcgagggtggggtatggacatgatcggccagattaatccactttcaggtaaaggacataaatttatattggtggcaactgattattttaccaagtgggtagaagctgttcctatgaagaaggttgattcaggagatgctatccaatttgtcaaggaacacattatctaccgatttggtattccccagaccattaccactgactagggctcaatatttgtgtccgatgagtttgttcaatttgctgatagcatgggtatcaagttgttgaattcttcaccatattatgcacaagccattgggcaagctgagatatccaacaagagcttgattaagttgattaagaagtagatttccgattatcctcggcaatggcacactaggttagccgaatcattatggtcttatcggatggcttgtcatggatcgattcaagttcctccctacaagctggtttatggacatgaagcagttttaccatgggaagtcagaatcggctcaagaaggacggatttacaggatacatggacagccgatgagtactacaaccttatggccgatgagagggaagatttggtccagtcaagattacgagctcttgcaaaagttaccaaggataaggagagaattgctcggcattataacaagaaggtggtgcctaaatctttttctggatgggagcttgtttggaaattgatcttgccgataggaactcgtgatagtaaatttggcaagtggtcaccaaatcgggaaggaccgtttcagatccacaaagtggtgtccaaaggagcttatatgttgcaaggacttgatggagaggtttatggacgggcactcaatggtaaatatttgaagaaatattacccaagtgtgtgggttcattcatgatcggctaagtttgccgatatatgtacaaccgatgtgtttacatcgacttgagatggccgatatagttatatcgcccttagtcgtttttcttatcataatcggctgtgactttgccgatgtatgatggctgatatggttatatcgcccttagcagttttggtttcatttagcataatcggatgtgactttgccgatgtatgatggccgatatggttatatcgcccttagatcaaagtataattttatcaatgccttcatcattgcaaaattaggggggcacatatatatacgataacgatgttggaaaaagttcgaaattaaaaaaagtatcttagctgattacagaaattgttctaagccctattacatgtatgatcattgcgacaaatatcgctggatagacgatatagcccgttgcctaatttgttctacttcttctatggcttgagtgtcttgagcatcggttccaggaataactttgagggatttagtcatatcagcaacatttctgatagccgatttcaaccgtgatttctgttcttcaattgcctttgggagatcggttagcttcttttgctctagagccaactcggcgttgcattcttcaagttgggctatgagctcaatcttccgagcttcgagccgatcaatgttggatttatcagaccctcagacagttgatcaagcttggacttttcttcgtgcacaagctgccgattggcttggattgtggcttcgatatccttgcgctcccggcgatcggctaatctttgcttggccttctccagcttgaattggtgctgctcgaggttgacggctggagtgagggcgtcggctagctcatctgggatcagagcttgaatttcgtgaagccgagtcctgattgacccacagtcgaccaccaagttgtctaatgatgatccctctagccgatgagatatgtcgtcaagtgttctcttcacatcatcggataaaggggccaaggctttgctggttgtatcttcttctgtctcatcaagatagtccttgatatcgaatgagaacagatcggctaagacctgcaagagagaaaattgaaggcagctgaatatcaagacagattatatagccgatttgagatttttaaaaggcaaaacttaccgggatagcaggagtagctgattgctcttcctcttcgacattatgactgcctgcagccgatggagtgcggttgcttgtttctggttgcacaggaggcaaaggaggaggaggaggctaaagaaaagacaagtgttagttgaacatcggctataatcagacttaaggagataaagggaaatttaccggtggagctggcttagatatagacaatgccgatttcttcttcacagcagtcttctttctctacaaagttaagattaataagcaatcggcaatttaaatttttttatctcaagaaataagtgaggtgagtcccttactcgtgaaaagtgagctggagcagcgggagttggaggagtctgcttgggtgaagccgatggtgtcttctctggatcacccaattcggctgctgcttggttgatatcctcttcgatctcttcttcatccaaagcttgttctatggatggatctaaagcaggaaaatcatcggttggcttggatttcttcctcttgacctttttcttcggagccagagttgatgggtcaatagccgatgccttggtctttctcttctttccggcatcggctggttcccttaattgcccttgaagcagacttgaggtgttgggagcatggtagccgatgacagggggagataatccacctccatttggaataaggccaggagcatagtctatgtccctgccactgttgctctggcgaggaggagaagattctgtggtctgcaagatggaagatgaaattagttaaaatattaatcggctaatggttatgtttacaaaattgacaaaaagaagaaaaaacttacttgggggatgacatctggaaagagatctgtcatatacatagaagccgattgatcgaacaaatgcagcttccattctccccaccatctgtcaaaggaccagctcctgaatcttgctaattcaatattctcaatgctgccaagttgtggtcctgggatgttcagcagccaatccatcatcaaggctgaagagatgtcacctctacactggatcttgtcggcaaagtacaagccgattagcagttgtcccattccaaattgcctagccgaagtcattgggtgataaaactcataggagacttgaatatttctcaattgatggatgccaacagggaggatacatgggctgataacagtagtaaagacttctctagattgctgaaattttcaatgattgatgtcttcaaatctgaaatcagctggcagttcaaagtccattgagtcggcataaggaaaccaggctcgggcatccttctgaaacccgtcgtagaagctgacaaaccaatccttcagcagctcagccgatagctttgctccagcatcggctggtgtagatgcatattctccataagacatgcacctgtggtgggtttgctcttccccatcttcatttgtgatcggttccagtcttgggaattctgcttctgtcgttgatggccgattaacagctttcatggctaccaaatttagccaagtttgcaacaaccaccatgatccgcctgctccaaccaccgagccaacggctatcttagctgatgcattattcaacatttggtatagatagccgaggagaatcttgcccaaggggaattgtctctttgtttctaaggcttcggctaagaactgtcagttggttgtagggctgcagcttgatccacaaaatagaaatttgtccagccacattagcagaaaagctacatgctctcgagaggtggctcgccctttgcccatgtaagctgcaatatatcctgaccagcctccaatactttttgttttgaactcaaaggtgttcttagtgttcaagctcatgggattagccgacgaggtcacatctaagccagtgagcatgatgatgtctaacagagaaggggtcataggcccttgattgaagaggagagcattaagggcattggaccagaaataagtggcagcagctataaggggctcatccttagccgaatttcctattgtaagggctagggcttggccgatcccaatttcatcccaatgggcctgcttgatagccgatactcgtttgtaccatacaggccaacttttctcaagggaaggccaggatttaaaagtgtttttccaatgacttatgtttggattggctagtctaaaagggatcctattggtttcggctatgataaactcagtaggatcaaggttgctgattggaccaagaaagtactgatggtcatgcgacaaactggaaatcgcaacaagattggaaagatgctacaagtgcaaaagaggtagagaagaagaaaacaagatgagatgaaaaaatcgatctactgcatgggaaaagggatctagccgatggatacatacctctgcgtattcggttgatggcgcagcagacgggctggttgatggtgcagcggacgggccggcggaagtcgacatatcccgcggacggaagcttggtcggagaggagatcgcttgaaaatcgccttgcgcaccgaggggatcgccggagagagagaaaatgaggtttgcttaagcggtgaaaacggaggtgacggtgtgaaatttctcgggggtggcagttagtatttaaagcaatggagtaacggtcggaaaacggcaagcgcgagtttctctcggaaatggatatggcaaatccgaaacattaccaaatattccggacttggggggcatgtgttaacgaccaaatttggcaatctgagtatcggaggtaaagattagatcgaagcggaatccatgatgaagatcgttttggaaacaaagcaagaatcggctggagtccaaatcggctacaactagatcggctgagtccgagtcagaaagggttagccgatacagccgattttggcaatatggctcggtttacgtcgtcaggctgagttaatgtgcttcacgtggattgccacacacggataaagtcctaagaaggcaattgtatctattgattaggataattttatgtaattttcttagagataagtgtgggcaaaagtctgccgcaaggtcttatggtatcttagagtttgttagagataagagtcgtgtccgacaaggacatattttgtaatctcgggtataaatagaccccgaaccccatgtaattagataacacgtgttcaaatacaatctcggtgtatcgccacccttttactttcgttttgtttcgacgagttcttgctttcgggttgagctgcatcggtttcgatcttcaactagaggtatgacttgttatggcggcttgcgttctcgggattagtgcttccatcattatgatactctaatcttgtctatgtaagttgtcgagttatcatatatcttatataatctctgataatattgctatctaacctccaatcggctaatatctatcactagggagtagtcgattaggttagatatcgatgttggcatagattatataggatatctaccactctatgaagcttccaatagcttgattgtctagatattgtcgttcttttcatacttatggttgcatcagttgagtttgatctcataagtcatgcttagaactataatctctagcctgcttcttggttgtcgattagagtagtatcggggtttcagccgatcttacctgatttagctttatattccatgtgcttagttgatatgctagatcttttaggtgtattagactttacgtttgatatattttacttgctttaatatcttaatgtagagtagtatcggaatattagccaatacacactagatctatctgattggctatgctatgaatggttatagtttccttgttaatatatatttcgatctaagtgatttatactgtctcggcatggcgaccgatctatcccaatcacttgatttaagtatatgtcgatatgaaaattatatatcattgatatgtacagccaatcgaatagatctagttcctttattattgcctcgcacagccgatcgatacagagatgacatcggctcgagtataaatgatacgtcatcggtggctggccgatcgactatcatttatggattaactatggtttatttgtctttgtttctagttgattgcaggatcaaatcaactggcatgctcacgaacctaaaaggcaagattttggacttgcactggagttaagcagatctcccaggcctcgtgtctttacatcaacactatttcaccgtggtgtttcaaatgtggactgacttagagtagactaactcacaagatagctcttgcggctgagctttttagttgaacgtaaaatgtgacgagtcattagcacgattaattgataactattaaatattaaaaacttaaaaaatattttattattattattaaaggaaccttatatatactccatccattccaaaaaataagttacaaccaccattaaaaaaaccaaaaaataataattattattttctaatttggatcacctgataaatataatacatacacccaatagaattagatatttgagggtagaagattcaaaaatgataatttagtagagagaatgtgttagttaattattttatacatgtatgcacatcttatattatgaaacatctgaaaaaaaatatgtgtgctttatattatggaaacaaagggagtcgtaagtttttttttaaaaaaatgaacatggcctaaaaagtatgatcattaataatgaagaactagctaagccctaaagtgtttagaatgcatatggtacccaaagtcttattataatagtactccgtacaaggttatggtcatctcattatgcaaaattggttgatgatgttaacctataactacattgattggtgatggtttggcatcgatgagggtggactcgcaaacatgaagtcttcttatagtactaagtagtactacactaattaataatggagaaaattggcattatgccatcgtcaaaaacaggtttcgcctaaataccattcttcaaagtggattcgttaaattgccactctcaaccgaagtctacacgctataataccatctgggacgaaaatgccatttgtcctctacttctccaactccggtcatcacgtcttggccgtgacggtgaactcttcgaccggagcccctccgtgcgaacaccggagttgaagatgcggagcccggagggatcccggaatcgaaagagaccaggggtatttttgtctgggattgcattatagcgtgtagcctctaattgaaagtggcaatttagtgaatccccttttcataatggcatttgggcgaaacctatttttaacaatggcataatatcaattttctcgtaataatgttacacgaagaaatatatataggatggtggggtgtactagctatcaagtggagaaggggtatgtatcacgcttcttctgcatgcggtgcatcgggcagttagcacatgagcccaagtgactttggtctgtgggaccaggtcggccgagtgtgctgcatgcaacttaattgttgtgttggcctgatggatattgaaaatttgccaggacaggggagacccaacgtatgtgtagctgtggggtgcatgaattgatgtatgtatatattttctttaacaaaaactcgtaacattttattaaacaagacagttcaggagagcaaacccccgtacatcgccatagatattagctgaaatcattcaaccatccttaggttcactgaactagggaaacaatcttcctaataaacataacagcagaattggagcagatcgacaggaagctccggcgatagatggctgcatatacgaagcgcgtgactatttatatgcatgcacaagtttacattagagcaagtactaaaagttactgtaagcggattatataattattagttgaggtcttagctagtatttattaacatataggtaattaatgtacggatgaactattaatcttttatagatgatatcactggtggagaaaccatctttggtcggtcggccgaattccacgatagtactggttgcaacaaaagggtaacgggcatattaacaccaacctagtcccggttcaaatgctgtcagggcttgtcaggccccccgggatctttagtcccggttggtgttaccaaccggtactaaagaacaccaaccgggactaaagtcccacccctttatatatgtcttcttcctcctccagcccgagcaagcttcaaaatttcttagaaaaagaggagaggtcattccaaaatttatagtgaatttactttggtgattatatataaatcggaggtgcctaaaaggttagcaacttcatcctccaatgtttttttttggtcatattacatttggagctatgttttgcacacttttttgtctccaaaattttgttgtaagttgatgagagagaaaatttgtgtgggaaaagaaagaatatatagaaattttgtttatttgctaaataaggttttataaaatagttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgtcattattggacgaataattatttgtctacgattttttttacatttcatgtagatggatcggcaatggatgtacgctgaccggcggtccaaagagtttattgacggcgtgcattattttttgagagtggccgaagctaacaagcagaagggttttatttgttgtccatgcaataagtgtaagaatcagaaggagtattctgcatccaggactattcatttccacttgtttgagtcggggttcatgccaagctataattgttggacatcccacggagagcaaggggttaaaatggaagaagatgaagtggaagacgacaatattccagactttgctcagtacgctggatttgaaggaaatcaaacgggcgaggaggacatagatgctgattataacgacgttgcggatgttcttggtcagatgttgcaggatgccaaagaggactgcgaaagtgaaaagggggcccataaattggacaagatgttagaggaccacagaacgtcgttgtacccaggttgcgagcacgggcacaaaaagttggataccactctggagttcttgcaatggaaggcaaaaaatggtgttagtgacaaggtatttggcgatttattaaaactcgtcaagaacattcttccggagggaaacaaattgcccgagacaacgtacgaggctaagaagatagtctgccctctaggactggaagttcagaagattcatgcatgtccgaatgatcgtatcctatatcacggtgaggagtacgagaacctagaagcatgccctgtttgtaaagcactacgatacaagattaga

SEQ ID NO: 67393 - DNA, 13916 bp, Oryza sativa
ggaagtaacatgggtaaaataaatttctttagtagtattagatattgcacgcataaaatccatgtcacacaaaacaacatacgacataaccctagtgcatcaagcacaataatggagtaatgtctattgtatacatgtgacttctttaaataacactgcacccaatttcttttaaattctgcaggttatgaactgcccttcacattttggggaacttactccgcatacccttttctttggcattcttctgccaattttcaggaaccttaatatttctagtgatgatgaatggggagcaaaacaagacggaaccaataaggagattatatctggactaaattgcaaagtgtgggtgcaatttgagaactacgacgatttcaacagtgcaatgcaggcattatgtggacgttcattagaaaaagtaagattttcatattctgttaccagttatctctcaatccttaactttttattagttcacataacacatataaatgatattgtgagcataccctctagattttttttttgaagtcaatatcctctagattttcctttctggtttccttctatataggttttttgtttcaactgtgcagctctgttttagcattacctactggcaattatcatgcactgacgttgcatagcacacatccttcagaccttcacatgcccttctgatgtgtgaacttgtatgctagaggtatttgtggtagtgtaggattgtgtttcttgtatcctatatattttgtcctgttggccttttcaaatacatccaagcgttctgagtcttccaataaagttagcaggatatcacatcactatcttccactgaagttaaccatcaccctctatcagcgtgtgtttgtttcaagggatgggatgggttgggttgggttgaacccacttttagagtgccaggcagtaccttcatgcgttagcttatggttatctggttgcttccttgtttggtgaaccctgccgataaacattccatggtcagataaatggctatgtttattgaaagcaaagtgaccacattagtgtttactaactagagagatcattactaaattagctagacaagaggactacaaaattactaaggtattagatacttcaggtattagaaattattagaatgcatcagcttctatgaggattgaggaccacaattgttggtaggatttgttgctttccttccacatacagctctgatgagtgatgactgatatatactatctcatattcactaccttggcaccacaacttaagtttaagctgcataaatttgttacacatggataaatccacatatgtatactatatatgccagaacagcctcaattaatgtcttgttatcatttatgttttatgttttagaaaacataatggaagctgactcatctattctgtttgaaggaaggatcacggttgaaggtagactatgaagtaacttgggatcatgaaggtttcttccgcaatgcacaatacgagcctgttcgcagcaatttagaagagagaaattcatcggctcatggaaggaagaaacattacacatcgcgaattgagtcagatcatagaaagagatttagggtaggacaacatatcaaatctttctaatataagtatttgtgatgtgatgtgcattcatcttcattgggtgcatcctgatgcatattttcatcttgccgggggtttaatagtgctgaacggctgggagcatagaatgcaatatcaaccgcatcccatttagttatcatggatgatttgcctgtggctgtattgataattgtatatatttgttcctcttggcccgaatgctgtattgcttacttcatttttaccattctctttgtaacattttctaacatctattatttcccttatgattcaggattgatggatatagggcatggcatgatggtgggattacttggttccaaggacagggaaaatgattgtactgtatcattctgttgtttcatcattagtctaacagtaaagtctttctgaattaggtattgcgtagttattactattagcctatgtcctggttgattcccagagatcatcacaacacagtcttgcttgtgatttgtaaaagaatttgcactgttggcatctcaatgtatgctcattcattgttcaatcacaaactcacaattttgctgaatgagaaattgcaatggctaagatcagcctaagcctgcaaattctaagcataactgtttgtattggttaaaagtcagataatgtgaattgacattgacgaggcaggtacaattgcattttcttctggattgtcaaacaagtaagttctctaacttctagaagtaaacatgcttgactttctattcattgtgatatgcgtggctacacaatcacatgcctgaatctagaagttctttactgatgattgtacctaaaaacaaggtcaacggatagagccaaaaaaaaaaaacatgtttccacaacgtataaacgaatggcgctctctcaaatcaaccagagatccagaagtcgaaggcatagttaacatacatagagatgaaaataaactgccagtacaccagggacgagttaatggacaaaattctgtaaaatttatgaacaattttgggtagccacacaagaagggggctgatgctacatgaacactggatgcaattgcaaccaaactgaatcgaaacggtaggaaagataacaaaaaaaatctgatcttcctggccaccctactgtacaaacatttacaaacacggcgttgattttttcacagcgtgtggtgaatgaatccacgcgaattactaccctttcttcccatgtggatgacttctcggcgagatcaactcatggacaccggagctacccctcttgccgtgcgaaggacccagcaatggcgtcacggccatcttcttgtcgctcgccttcttgccgagaaccttgacggcggccttcgatctcctcacgccgtgcgccccgccggcgccgccggcgccattagagctggccgtcaggatcggcacgaggtaccaccagacggaggtgcagcagatggcgaacaccttgccgaacaccacgaggctcgccagcagcagcaccgccacgaacggcatgtagtggcgcggccgcacgtccgaccacgaccacctcacgccggccttccgcttcgcactccccggctccgccgccgccgcggcggcggcggggcgcgcgggcttgatcacgtcctccctggggctggcgggctccgacgtcggtggcgtggacgactgcgaaaggtcgccgacgtcgcggccgcttgctgcttcggcttgttcttccttcccttccgctgctgctgttcctcctcctcaggcgggagcttgacgacgatgggcacccaccctttcccctccgactgcacgaccggacgagcacatgctcaccaccaccaccgccgccgccctcccccggtgcgccgccgccgccggcgccgccgacttggcgaaggatcttctcccgccgcgactcgagctcggacagcacggtggagaacttgtcgagccccctcgacgcgtacgggttctccttcttcccaccaccaccaccgccgccctgcttcttcttcttcgcctccggcgccgccgccttgccgtcgacgtccttgaaactgcccgtgccgcagaacaacatctcttgcatattaccgtgtgcggatcaacgatttctggcgccacgggcacgagccttttaaagaggatttgccaacgcaacgcaacgcaacgcgatcgcctctgtttctgtcccgactcgtttatttcttgggtctccgcgacgacctgctcttcttctagtacgtgttattattattttttttgtgtgtttttctttctggagcaaagacttgatcttcagatgttggcgcgtgattgctgcctgcctatgcgtgtgcttggtcaagtatggatgtctgaaagaaatatgtattcaatttcgttcagaaagatactactgttcagttttgtaaaagaaaattaatttcgtgccttgcttgccacgattgacccggtggagttgtgcgagtaacaaaatgcagaggaatctgccgagagcaatttggccggtactagctttttagtatgtgatgataactaaaatcttactattaatttactcttgtgattctgcatcaagctagctaccgacaatgacagttacccgtcgatcgagctcggttcgagctcacgatctgcgccggattgtatatcgagctcagctcgagcacagaatcgatctgattatgtgcagctcggatcagattagctctaagatgctggttaattggttgaccatatcaaatgggatcggatcattacagttcctgcatctattattccttttcttgaaaaaaaaaagagaaaacaacgtttctgcagcacgatttttttgctgcaggtttcgggtaatcacgttggtttcacgagctaacggcgctgagattggtttttcgacgtcatcggtttctctcgtttcgtggttttggagatgatgattgcctgcatttttctgccagatcatgatgtcatcgcgttttgcagcgttgatttctcgcgagcgtgagagcttctggcccgcggtaatatttgattgctgggcaaggcgtggactctgaattctgaaagcccttatcgctcgcgccgcgcagataaccttgaacagttgaatggatcaaaactcaaaaggctgcgtgattaattcatctgaaaacgagtcaaagtttcgagtgcaggtataagtcaaacttaaattataaatgtctattatttcttttttgaaaaactaactatgtaaattttaacctgaagaagaacagccataatatttgaaatcaatccggtagcctactgtaattagtttaaccagttttagttaatggcaggggagctgatcttgtttttgggtgcagttaattactacgttagttcgtaatcatttaatttgcttgactcaacgggctaaagacctgtggcattctagtatctctatctgctttatctgaagaagaatgttcgacggaagtggtcaagaacacggcagatagatatgacgacgtgcatcacgtacctcacgtacagtacaatcaagttaattcatcgccaattcctactagttagttagttactcctgctaattcttatcaagttcatcactgacatcagcgagacagttattatatagtatagtacttcactagcaatgtcacaattgatcatcgttacctggctgaaaacaattgattatcattcaacatcaccacaattcacacagtttacggagtatgataaatctcttcaaaatttattgtaaaaaaaatcagccaaagatcagctaagtactatattattttattaaccaattcactgacgaatcaacagacagttgcgtcagctatatacggcttgaactctgttttttttttaaaaaagaaatttatgtacgacttgaaaattgattaatcatcagtattactgagttagccgccggccggcgcctgacaaggataagctgccacgccagttaaattaacatgtgaatctaattaagctctcgattaatttcaaaccttctggatggattgtgtctaaccatgcgtgcagaaaattaacgcaggatgttgctgtcacttgctcatccatgactatcattacgaccatgctttcatagcagaatgtcataatgcaccgcaactatccaataaaaaaaagtcgttatcgtaatgtttttctaatagaacgcaaacaaagaagacttttatgtatttttctacgtgagcacgtacattaaaatccacattttgtactttctggaaaaaatcttactggatatgaatgaggacagggattgagattttagggttgtgcatgatttcctcgatgatcgtggaaaaataaatagtggattaacgtgaccttagaagagtgttacacgtcagctgttgcttgttaaataaaatgcactgttctagaactaggaaaaagatccaagataggaataccgtttgtatttattactgtattcaggtggacttatttgtggatttcgttggcatcaatgttgaaagtgatttagagatgtcatattgcattttcatgtgatcatagtcatacgtatttgtcctacacaatgttaatcacctttcatttttaggcgaaatactagagatttactccctcgttttgtagatatttaacgtttaaaacaagtttcgatcaactagtataagtttataaaatttaattagtctatattataagcagaatacacttatacttctaattcttttgtttttaaactaagcatgcgaaactattgatagttaaagtttcaaaataagatccaaatattttcctaaacatcaaatattcaataccaaatggtgtattaaattatctgaatacacttattatgggtggttatgctcttgatgaacttcatcacagggtagttgatataacggaactgaaaaatgaagtctataatttatcgaaggaataagtttatctgaggtctcttaattttacaccgattccgtttttcgttcttgaaccctaaaaccagatacaaccagtccttaaactgtcaaaaccggtgcaaatgaggtctctcagtggtttggaaggcggttttggctgacgtgggcctaacgtggctggtttgactaggtctccatcccacatgacattgacgtagcgcttacctggcaattatatctcggaaaataataaaaatcgtttcccacatgtgagctacacacaaaaatatttttaaaatagtggggcccacgtgggcctcacatgtcattctctctcctctctcggttctccctcttcttccctccgccgaccccgacctcttcttcgccgtccttgatcggcggcctcggccagttcggcatcatcacccgtgcccgcatccctctctcccctgcattttgtactctctggaaaaaaaaatcttactgtatatgaatgaggacagggattgagagttttagggttgtgcatgatttcctctatgatcgtgggaaaaaatagtggattaacgtgaccttataagagtgttacacgtcagctattgcttgttaaataaaatgtactgttctagaactaggaaaaagatccaagataggaatatcgtttgtatttatactatattcaggtggacttatttgtggatttctttggcatcgatattgaaaatgatttagagatgtaatcttgcattttcatgtgatcttttttttttcagaacttcatgtgatcatagtcatacgtatttgtcctcctacacaatgttaatcacttttcattcttaggcgaaatacaaaagacttactccctcgttttctagatagttaacgtttaaaacaagtttcggccaattagtattaagtttataaaatttaattagtctatattatgggcataaaacattgatactaccaagtcttttgtttttaaactaagcatttcaaagactattgatagttaaagtttcaaaagtaagatccaaataggtaaagttaactataggacactcaaaatttgtgtttgttgatagaaatcataaaaacgtgtcacggctgaaagacactcttaaaaaactgataatttgctaaatgacactttcggctcaattgaaaagaaaagttcttaaaaaagacaaggatgcccccacggtcaaaagattttgaactgagactagggtgaagataaaatatcacgtatactagtgatgtacttggggtgatgctaaatttggagttgcataatttctaaattcgtactttaacgttatgtttgaagcatgtgattctaggggcattcttgtctttctcaagaatttatctttttaattgagtcgatattgttctctaacaaattactagtatttttagatgtctttcatttgtgaatgttttttcgatgtctatcagcaaattacacgaaatttagatgttttgtagtaaaatttgccatccaaatattgtccggcctaaccatcaaatattcacgaccaaatggtgtattaaattatctgaatacacttattatgggtgattatgctcttgatgaacttcatcacggtgtagttgaaataacggaactgaaaaatgaattctataaattatcaaaagggccatcaagaattattccagaggcagcccaatataacattgccggcccagataagtcagtggttcatctggaccaaaacccaacgagctagtctaacctcggtatgggccttcaactccaaggctgcagatcacccactggaccataactgggcccagcacacagaaacaaatcgaattcgcaccagtctgggccgcaaggcccggcccataaaccaatcggatcccacaacactgggccgagaagattggcccaacatgagctgcttccaacatatcctcggtccagccgtctcttctcccaagttctgaagtgctctctctctctctctctcggtgtttccccttcggccttctcgtccgccccttctctcctccaccatccgcctcaccggcgtacggctccgacgagatggccgccccgctccggcggagcctcccctccctggggcgcacgctcctctcgccgtcccccgcgcccgcgcggatgctctccgcggcggcgtccgacgccctcgtcgagatcaagccaggcgagatcggcatggtctccggcatccccgaggagcacctccgccgcaaggtgcggtgcttcgctgaccttacctctgatttatgtagtggcgatagattggctagccctcgcggatccgtgtgggaatcgctcgagatgtccaggtttggtgggttgttttggtcgttactcgtgtttagggatagaggcatagagcctggaggcgtcgggtcgtgaactcgtcgtacggactacagtgctatcgctagtagacgttcgaatcgtggagtggatagaaatgcgaatttggtgatgatgttttacgcttgtgtggtttgaactgcgtttagaacttgggaggaatgtgctgctctccaggttgggttctcccactttagattatgttagtggagggctggaggcaacagagtttgatcaaattatcctgatttggtttatgtactgtgaatgactgaatgtatataggtgtatgttcttacctttcaaattgtttgtgattagagttgacagtattggtgttagagaactgtacataccagagtttagatgatgctaggatgcttattatttatccattttcttggtgtacatcaaacttaaaaatacatttgatagaactaactgcatacaaagaaagatgaaattgctagcaatgcttagctattgaatttagataacttgttggactatgaactaatgtctgtttcataccatttcatagttcttgtaattacctcaaaatccatgtagaggcctacttgtagagtggtagtttcttgttctgacttctgaggaacagagcttccatgaaatagttttctctacaacataatctcgttaatacgaatattgtttgatgatcaattcttctgttgtttcaaagatccgtcttaacttcaaagagcttagaagcatcttatgatatggcccaatgctgatagcaccacttcagtcacatttttcatggtattatcaaccttatgtttgtctgcagagagaggatgcctacacatcaatagatcttatgtttttgcagatttattatacagagtgagccctagaaaatattttgattgtgatctatgttcttgtagatcattagactgttaacaagtggtctcccccaccttttagtgtttatacagtaaacggccttctaaatggcctacgacaggattgtgttattcagataggtttaaatatttatactgtaaagaaaatatgatttttgttgctgccacttttgttcttttaagactcactgtatgcttttcaactacctagctgggaagacatgatcaacttatccttgtgtatttgcaggttgtaatatattcacccgctaggactgcatctcagcagggttcaggcaaagtcgggaggtggaaaatcaactttgtgtcaacccaaaagtatgtttccagttttgttttattggttattgttgattcattttcatgaattatttacctcaaaccctgtgttgctgtttggtgaactgcctcaataatatatcaaatgaaaacaaatagtctcatattaaaacttgatttacattcataacagaagaattcattgacgattgaagtctgtttctttttttcctttaacgtgagattacccccccttttttttgtacaatgaaagccttgcaactgatgcatttgacctctcattgaggtggtcaccttggtttggtcaaacagtgtgtacttagtctatttcatttcttttatgtctcatgcatttacttcatttagctttatgtatcacctccttattatatagcattctagcatacaattagatattactatttcagttgctgccgctttttccccttctaacatttgtgtgaataataggtgggagaacccattaatgggatggacatctactggagatccatatgctaatgttggtgaagcagggcttacgtttgacagtgcagattcagcaaaggcatttgctgaaaagcatggatgggattatgtggtgagttcttactatctgtctatccattcctgatacttaacatcaggtttaaaaaataaggctatacttatttctgaaatattaggatatattggagcaggatttaattgcatattctctcttgaatgtataggatcatttgattcttaattctttacaatttagaggttaaagtaaggaatgttcttttatagtgttctgaattctgatggtcaggtttctgaaggaaatttggtccatttatgggtgcatggtcttttattttcagattgccttgcatccaatgtgccatatgatttaatgttatttgccttaaatctttgtcttcagaatcacttgtcgatgtttcaattttgaaaaataaaatctctaaaaatccttcgtataactcaaggagtaaatctgttgttcccgatttttgttgtacttgtaattttagttaggacacatggaactttgattttatttctgtggcaaactagagctttttcaaacaatttgtaactcgtatattatttgcgtataaaatatgttctcgacagtaggaatgcttttggggggctatggtgcagtattcattggcataccacgagcctttatatttgttggaatccacctcctaaatttcttaagaaattagaactctttactcacataatgtctatttcctgcaggttaggaaacgccatacacctcttttgaaggtctgtacacctccctacgtatcttccattttactgtgttgatgcattttttttatatctacccagttggttgctttgattcttgcatccttataattttgtcaattcatgcattacaagttactactaagtgccccttttttaactttgttcaacaacataccgtgttctggatggtggaatatgtgatgttgaacgtggtctgcatcattttggtggatataacgtagtcacagcctcacagtcccacaggaaatagttgatattgtggttcaagtgccaaagtgaagaaaaagccaccagtgaatagaaaaaaaaaacttagacaatttcatctatactaatcatattagctcattttgtataaaatgaggctatgtagcttattgcaaataagtatacttattatttatgtgcttgcatgtagcacatacctgatacatgaaacatggtagacggggcagatcatgtcaaatgcattacaatgtgcccttggtgagaagattgtagggacgaaactgtggcatacttttaagactgagggagtgggcggaggcctacgtaggagggaagttgagagtgccatcttggaagtgtaagacaagaagaggagacgtggaatcatgtgatgggatgctttaacattgggtgtgaggaaggattaatcagattagtttgaaggaccaacttgagcaggggttgaaatgaatgccaatgacccaaatgggagagacgacgggaggtcctgatcgaacgggtgttctgctacatgatggtggcactcgactgatttgttgaccttcgaattttctgtctccgtgactttgaattgaacgaaaggcactcctttcattctagaaagtagatagcaatagagcattcacattaatcacaacttagcaagtcagaagattgatagggaaaaatccaaaatttgcatcaactgtaggagtacatcgaatgtgatctagtcagagagtccctcatcctcatcaactcctatcttttgttagtaccaagccgatgaggacaagctagtcaccactggctaccatagtagttgaatttacgtgcctaaagcttacggatgcaacgcgaccactgttttggcagccttttcagggtgcatgcattctttcatacatcctgccaagggtgtaattaaccatctctgctaccctttttgctaaggatttgaaggacaaatactgcgggacgaaggggatatcactcttctcccagattttttgaccaatttaatacataccgtccaggttgttgtgcattaagttagtagcttccctgtaattaaccaattgtttttctgtcatgcaggccaaatcttatgcagagaacttcaagtggaggggtcccccgaaggcagagcaagcctgagcactaatcttgcatgctacattgctagcaggacatgcacaagatggtgtttacccccatatgtgttgtttttggtttctccaatctgttgtgcgagtgtggcttagaccgttcctcaaccaactctcaattataataagcgtgcactgtgatcaaatagaatgatttcctgtgtactaaaattgtttaccattatccttccacatcatttcataaagatcctttacctgtttgcttaggttgttaaagcaaaacttaagtgttgttctgccctggtttgctctcaactcttggaacacgacagtgaagacgtttttctttattttgtttgataacgcgacacggataatgtgattgcgaccacgcatttgtctaacctgggttgtccatgcatgcatctatcctgggatgtccatgcatgcagacgcaatcacttgtcgctgtcaaatggatcattagtgctaaactacatgagaacaaacaaatctcactaaagcaaaagttacaattttcccttgcattctccggtcaacatcatatatactttagaacctggccttgcatcctataagcttcgcaaaagaggaagcagccgatctagtttgctactactagtaacattgcaccttaacacgattacatctatgcactactaaagtttgctccggcttgatgcatcacgtcgtcacgcgtcgccggcggcgcggcggtgggtgttgcattcgtcgccggcggcgcggaacctccaggcgaagacgtagtccctcgactcgcactgcagccgggtgacgtcgcacggtgcatggacggatgaccacttgccgtcgcgctcccacgcgatcttggccgagcacgagaaccccttgcatgtctccggcagcgccgccgccgccgccgccggctcggacactaccagcgccacctcgccgctgatcctcctggacgcggcggtggccacggcgtcgagccacgggcactcgggctgccccaccattcgcttgtacgcgtcgttcaccagccggacgcggttgctggagtccgagaccaccgccgggagggagtccgactccagctccgcctccacctcctccgccgtcttcggggc

SEQ ID NO: 67394 - DNA, 87707 bp, Oryza sativa
  unsure (1)..(87707): unsure at all n locations
tgagtacttttatggagaggtgatccatttccaccattccttgcccagcttgccatcgaatccttcccaattccaacaatttccacatgattggaactcccgttcaccatcatggtgatactgttctgtctgtcaatgagagggatctcatcctctggatcctctgcaatctccaaatgccgccttttgccagagtctccatcaacaaaaccttcagccttcctttttcttggacaatcaacaccatcaagttgcttcatctttgcagcattagcaacagcagccgcacacgccgacgaatacggctcccaccattgcgcatactcaaccgtcacaccgggttcatggcgaggaagagtgaacttaacatcctgaggctccatcttgtatgttgcccaagcaacacttgaatttgagctggcacgggggacgttcccgggaacgtcctgatcgaagcccagctgccttgcgacacggtgcgggaggtagtgctcgacgcagcgcaggccgacaagctcgcaggggcgcaggcaatgcgcgaacgacaacaattccctactccgggcaatgtcccggccatgaatccagatgccaaccttgtcgagctgcaatgcgaagccactgcttccgtatggcctccactcaaactccattggtgacatgagcaccgcgtggatgtgcgctggctggagctccgttcgcgcgttgtgccaccgggcagcccatggcggtggcgcgccatggccgtcggcggtggcgtgagcagaggtcgccgccttgtcggggcgtagctccgggaagcgctcccaggcccagagctggacgacgtgcagcggcgcccaggccacgaacgggtggcgccacttggtgctggaggcgaggtggcacttgagcgcggtgaggtcgttgtagatgctggcgagcgcggcgggcgcgagcgccacgctctggccgcgcggcgagggggaagacctgcggccggaccgccttgaacggcggcgccgggagcacgtacagcgagagccacgtggccaggaacgcgccgtgctcgagcagcgattgcgcctccgcctccgtgtcttctccgtcgccgtcgccgccgtcgcgcccgaggaagtggtggagccacgtggaatacgtggagttcttacacttgctccggtgcagcgccgcccggacggcctcgagcgcggcgtcgtcgccggcgagcgtgcccggcagccgcgcggtgacgggcgcgccgagcagcggcagcccgccgagcacggccgcgtcctccagcgtcaccgtcgcctccccccacgggaaggcgaacgagctcgtcgccccacaccagaacgcggcgagctggagcaccaaccagccgtcccggcgcaccgggcacgcggcggcggtggcgagcacggcgtccaggatcccaacctcccgccacagcggctcgtgccgcggccggagcctctccacccaccgccgccacagggcggacgagcacggccacccacagaactcgacgcggtggccgtcgccaagaaccgggcccgcgcagggggcacagccggggagagcagcggcggtggcgcccgcgcgggggaggaggaagcacgccgatcgggcgacggcggcggccccggcgcgggagatgattgcggcggtggattcctcgaccagcggcgtttcctcgtcggcgggcattgcggtggtcggcggaggtgggttttggtgtggtttggggttttgagtgaagaagagtgaagaggagtgattggactggcaggagcttccttcctgcactcaagtgcgctgcagcctgcagacctgcagtagtagtcggtaagaacgtgcgaggtagtctagccgtgtttacttacaagataatttttcaaacttccaattttttcttcacatcaaggctatgtttagttcatactaaacttccccccaactcctaactttccactcctaactttccatcacatcacatcacatccaaaactttcctacacacataaactcctaacttttttctctaaactaccaacttttcccaaacttctccctaatttcaggaactaaacacatcccaaaacttttctacacacaaacttccaacttttccgtcacatcgtttcaatttcaactaaactttcaattttggtatgaactaaacacagcctttggcttaggctaagtttagtttcaaaatttttcttcaaactttcaacttttccatcacatcaaaacttttctacatacataaactttcaacttttccgtcacatcgctccaattttaaccaaactttcaattttggcgtgaactaaacacacccttatctagtattgccaaaaatttcagggtaactttgaaaccctgaattgagaaagcacgtaaatagaaaaaacataaaaatagaatgtcgtattttttggatttctataggattttgaaacatacgaaaagtctccaaactatcttatttttttaacttaaagtagtaccaggactttacctcacagtgtgattttcattaaaagcaaaaaaattacaattacaaggaaaaagaacagaaaaacaccagaaattacaaaagttgtaactaagcctgctagtggggtggcttgatttttccttgagtgaaatgggttggatgctaatttggatggtggtagttgaattcaagtgggttgatattaattttggattggagtgggttggcctatgaagaattgaggtttggactggagtggatacaggttggcctgtgaagacaatccatggactcagcccatgggttagcccccaaaagacacccaaaccctagactccactcccgaactcccgaattccgatagaaaacccttgcccgtgcagagtgcgccgcaaccgccgcgcgccgccagctccgctagccgcggcctcgagccgccaccgccacgagccgccaccactatgagccgccaccgccatgcgccgccaccgccgagcgctgctaccgtcaccggactcactcccggtctgcaaggaggagctgccgagagggaggtcgcttctactacgccgtgacccgctcgccgtcaccgccgcgcgccgccaccatctccagacttgctcccgttctgcaaggaggaggccgccgagagcccgagagggaggtcgcttcaggcttctacaaggaggaggtcgcttcaagaaaaggggaggtggcggcgggattgggtaggcgcagtcgctcggcatcctgctctccaccctcgataacctcgccatcgaccacccacgcatcgacctcgccatcgacggcgccaacgaggttttgacctttttttcacttcttttggattaattcagttccatgctgattgctgttcaggcttccattgctgctttcgacgtgggaaggtttgacttaatattaatcctattttggttgtcctgcaatcacttttacctttgctaacttccctcgcgagaaaaaaagttgtatcttcatgaagaaagtaggaaaaaaaaggaaactttccagattataaaaacttattactccctccgtttccctccgtttcacaatgtaagtcattctaatatttctcacattcatattgatgttaatgattctagacatatatatttatctagattcattaacatcaatatgaatgtgggaaatgctagaatgacttatattgtgaaatgtaggaagtagttgtcagttcttgattatgctgttagtggcatgaacttcaatgatagtcaaccatggaaaaaatttgcccccattgtactcctggatggttgggaggacaatctgccctctttttttttgtcatgcagattagcttgtagcattcgggagagtctatctttgtcattttctttttctgctgtgtagatttgcatctgaaaagtggataatttagcaagattataccatgatttgcagatattaatccctcccatatgtaatatatgtcattagtaaaaggaaacttaggcgtatgttggttcaaagcattatatatttataactagaggtttatgttggatctgaatgactatctcctaactctgttgattatcactattcttattacttttcgcacttatctctgtttatactgatattgtcatggactcatggtggcatggtgcttatcatttcactagtttttagcacaagcagtaaatgtaaatattaattctgcacaagtatattaattttctagtcttgtcaaacacaggtttattaaacatgtctatgcaaaattctgaaagttcatctgccaatagctctagccatgaattgccttcacaaacacgtaaaagagcaaaagtgtgggaacattttgagcaggagcttgtcatgatagatggccttccaaaagcacaatgcaaatattgttgattaatgttttcagcgactagaaaataaggaactagccatctcataaaccatattatttaatcttatccactagttgatggtgaagttagaaataggtttatatcaacaattaggaaaaaacctgtggaaaatttcgtgtttgatctaaaaaaactaaagagcttatgataaaatatttcatccatgctgagataccattccataaaattgaggatccctacttggatgattggatggcgtccatgcagccaacctttaaacttgtgggccgtcaatcaatccgtgacaagatttacaactattacaataggctgaaacaagaattgcatgctgaattagaaaatcttgattcgcgtgtatgcctaacatcggacatgtggacctcaaatcaaaacttaggatacatggttgtcacggcccattatgttgatgcagtattcaaaataaaaagaaaattataagtttgaagcctctgaagtattcacacactagttttgcaattgaagaagccatgatgaggtgtttgactgagtggggcttaagtagcaagctgttcaccttgactttagacaatgctagtaacaacaccgttgcttgtcaagaattagtgaaaactcttaaggatgagttggttttggaaggtaaacagtttcatgtgaggtgttgtgcacacatcttcaatttgttggttcaagatggaatgagggtgattcatgtggcaatagataagatccgtgagatcctaaagtacattgagcattcaccctcacgcattcaagcgtttaattcaattgcttctagtaaaagtcttcctccaaaatctggtttcgctcttgatgtaccaacccattggaactcgaccttcaagatgattagagaaatattgtcttacaaagctgtcttcaatagctatacctctgaaaattgtgaagttctaccaactgaccaagaatggttgcaggctgaatcaagagtgaagtgcatcagcggtccctaaacttgtgcggatgtgtcatctaggtccctaaactctcaaaatgtatttttatgtccctaaacttgtcttaggtgtcatataggtccaaacgggcaccgacccgctccatccgctgacgtggcatgccacggtagcgcctacgtatcagtggggactcacatgtcagtcatatttataatatgatatgataacaatatttacagaaagaaccttacatgttttaaacttactctaatcaaatcctgtacgtgctaatggagcggagcccacctgtcataggcacagggagaaagcagcagcagccgcagagttcgccggccggcgttccttcaagacgatgccgttgacgaacggcgattcttcggccgacacaaccacaagaagaaatgctgaggacttccttgtgatcctgttgaaggtggtctcgtcgctagaggtggccggaatcgatgccagtggtgtcgcgagcggcggtggtcttcaatacgcctgtgcatgtagagtcccagcccgatttagtgcaaaaaaatgcatgcatgcgagtctagcaggtccctgagtgctcactggaacttgattgcggcatggcgaggtctgggtaacagcggtaatggaaaagacagcccggcggtggtggataacgtcggcttcacggcgacggctcgcttgagcggtggaatgcttagagaaggtgcatgggtggttagtgaggtccctaaagagttgcatgcacgattaattagtccgtggctcaccggggagagaggaattggcgatggcactcggcgaccggagttggagaagatgacggcgatctccctcgtctgtgcacgattcttaaaatttcttgagggcttttggccatgatggtgaggcgatgactttggcgcgatggcttggcttgagatggaccatgtcgaccggaacagcgacgacgtcatggcggcggcgcctggtgcgagttccggagctctcatgggcaaggtcgcgtttccgttgctgcagtggataaaacgagatggggtcaaaaggagatttgctcggcatgatgtgggaagtttggaatgggaaagatttggcgatagagacgacttgtcggcaacagcgagcgtcatcttcttcacgattgacgacgagaatgtgggcgacggagaggcatagggctctctctcgtccgagtagttcggctccagaagaatgtagaagagaaggcgacacgtctgaggaagaaaagggaggagctcagcgttgccacgtcctggccacgcgtgatgcgtcgagcaccgccggcgtctctctttcctgctctctctctctctctcttggctcccagggcggtggagatgatgcacagagctgacatgtgggtcccaactgacccgtagcgttaccgtggacaccacgtcagcggatggagcagatcggagcccgtttggacctatatgataccaaagacaagttcggggacccaaaaatgcattttgagagtttaaggatccagatgacacacccacacaagtttaggtaccgctggtgcacttcactcctgaatcaatatgtgaatttcttaaggcttttgaagaggttactagaggtgtgtcagtgttggcagctgttaagtaccaaattaacgccgtcaatacctgcataagaccataaatataaaacatccaacatagtggtagggtttattcctaacaatttccatgagtgttggtgtatattcatatgcaggtgacaaacaacctaagttgagaagaaatatatatgaaggaggaggagaatcaaactcgtatccgaacttatggagttttggacacaaaaacccaattaaacacctccaaatgggccaaacatccataccaataaaatgaggggcccaaaatgagtgtccaggccgaaaaccggggccaacggagccagccagggttcggccgaaccctgacagaggccactggcctaggcccagtttgcgtttagtagcaaaccgctccccaatgatggttatgggcgttttcaccggtggaaaccgtcataaaatggacacttggctcatggaggatgaagatgcccattggatgccatggaggatctctacactcccaagcaaactcacactataaatacccctctcatccttcattccaacacacaccaaagcatgagctgaattacaagagactctattgtacttttttgtatactagattagggagagagtagagtagaggaagtcggagaaattccggagttgtcggtaatcctcttcttatttcttttattttgttaattacttctgttttaattgaatatcattctgagtaattaagatttattccgtgagagttacctcttagttagttttaatcaacgtacgaaacattgttcactatagtccattaaaatatagtgattgcttgagagagttataaacactaaagtagttattaactgcgcagacgtggtggctgggtagttaatttcttatgtttgcttcgtatcccaaagtaggtttgaggtaggtgtagaggtggtgacagaactcaagtacactaaagtcctctctatccaggtacgttgtagagccatatctgggagcagtgggctgaccagcgcctgaagcaccgcgttaggattaaatagaggtttttgtagatactgtctctcactagtaaatcctctctacctttagcctatcttaacttcatgtccttaatgaatctggagaagagctgacacacacgttctctgtggaaatcgataccttggaatactcctgggtgaagtgctacatcggtatcttctgtgcgcttgcggattctatctgtgactttaagaaataccaacagtcagctcataggacaccagctgcacacacattcttgccccatattctttgtatatgtcatgctttaagtgatcctgattggcaaaccagcgatgttttgacacgattggctggtcctatgcacactaagtttgcaaaatattgagatgaaaaattggcaaacaactccaatttggcacttgttattaccactgtgttagatccaagaaggaaaagagactatttagatttttttttttatgagaaagtgtctccccatgggtttaatgttgaaagtaaggtggactctattatagaggagatgaaatcatactttcgtgtatacgaaggaattgcaagaaaaaggagtgtatcctacatgtcacagtctaatgagggagtgttgtaggctcactagttttgggcaaaagaaagcttagagcatgaattcaccctcttcaagtcaaactggaaggttgcacgtactcacaagacaaagattgatacatatttagaagtgtgtgaggatgatagtgaggattttgatgttttggcatggtggaagaaaaatgccaagaagtttcctgtgttggcaattatggctcgagactttcttgcaattccacttagcactgtgccctcagagtctgctttcagcagtggaggaaggattcttggaaacacaagaagttcattgacaccagagatgctcgaggcacttgtttgtgcgaaagattagctgtataggtgctcgaggcacttgtttgtgctagactttcttacaattccacttagcaccgtgccctcagagtctgatttcagcagtggaggaaggattcttggagacacaagaagttcattcagagatgctcgaggcacttgtttgtgcgaaagattagctatataggtgctcgaggcacttgtttatgcgaaagattagctgtatagagccaaaaaacagggggattaaaggtataatatctgtcacatttgcttatttattggaccattgctgctgccttgatttaggaatattagcagttactcctagaacttttacattttagcagttatttaaaaaatgcataagtccctatgttatatgtatatgtgtgtgcttagacttgtgattgacttggtttgtctaaaggtagtacagcacctctagcttgctgcatgttgatgtttacgacaacactgtattgtaatgtgcagtgcattaattagttaacaattctataactatttgtcaagtgatggtcctctaccaggccaaatccttgcatgttttgtggtgtatatactttcagctctccttttgacaactccggttcttttgtggtgagccaactaaccattgtgaagaatatgtaatttgggtaggaggatttcttttggctaggggaagtatgtaattggcattatcaatagttcttttaaatagcatgaaaaatctatgtaattcacatttggcttttaaatagtgctggaaatctgtagtgctggaaacctcatgtatcgataaattagattagacattttttatgcttctctcgtgtggcaatatattgccaaatttttacggtgaggaactgattgttcttgttgtgataaatcataaatgagaataacttactacatttctttgatggtgttatgttctttcaggtatttgcttcctgtaatcaaagaactgtaacagtttccgtgatttgtggctcatgtgaggttcttcatgttgacaagtttagagaagaaactaagggaagtcaggttgtcagtagtaaactacatccaattttcctctgcaagtttgtctttttgatgctttgtcttgaattagttggtgaataatgagttaaaatttgaaatcaaatcctttaaaaaatttaatattaactaatatacatttgttggaacctggctgtgcaaccaacccattgggcagccatagccctaccttacttggagaaaatagttgacttggcttgcaagaatcgcactcttggaatagaaatattttatcatgatcttttttttatgtaacaaacatttgaaacttgcattatctaatacattatcctacttggccttgattcatgtcaatgcatatattgaatatagtaccaaactaccgaacataaaggccacttcctccagggtcattcaattgtcaaaatattttttctcaaaatgtgacaaagggcaaaggagatttgtaatagttgtccaaatttttcccttcacacaacctagtcatatgagactattgtaaggttagaaggcaagttagaaggagtgttactagcttatctttttataaatgaattaccacaaattatagtgagaaatagttgcagctaacaaattatttgggatccaagtcaaagaattaatcggagcatatagtgatcttgtctactctgctttgatatttgtaatttgctgatcttttttcagtataatatctgattgatctccatattagtctaagtcactattatatgttggcatctcacccatgcttaacatatttgtaattatattctccagctgattgactgatcagaagatggatactacttaacaagtgactccccaatacctcagggagagattgtcattggtggtcctaatgtaatttcaagaatgaagctaaaacgaatgaagtattctagctcctccgaactgcaaaagtagcaagtatttgcttgcccaatcatatgagttgtgtattcatgtaatattaagaaagttcagtaaagtctgattaatttaggctgtgctcagcgaagtgagcatagctcaactggttaggttccttgtggtggaaccagcccacccgggttcaaatcctagatttgacacgggtgctcgcatttacggctaattattctttcagtggtaggcgacgtacccgtcgacagcgaggcgcctgtggtgacttcgtcaatctcaagatatgccggcccagtcttccggaggtgctcataggagtagggtgtgcgtgtgtgcgttcataggggtgagtgtgcgcatgttgtgagcgcctgcgtttgtactgtgtttctcaaaaaaaaaaattaggctgtgctcagttaattttcatctggatttatttgcaaatttaatgagaagcatgacgtatatattattgtttgaccatttgtcttcttgctgcttttttcatacatcgttgttttgaattgttgtgctgcactgctgctgtgttggcgcagaccaaagaaaacaaggctacatgcatacttggcgggttggtcatgggtaggatccatgggttggcatacgggttcaacttatggattggactgttgttgaaattataagcatataatgatttaatttattccataaataaatcaagacattgcagatgtaaactagcatgaacgtatcattagatctacacatgtaaactaagcagtaaaatatgaacagatcaaatatgcgtaacatatcgaacacgtaccgaggtggcgaaaagatcgattgctcggcaagaactactcgcggctgtgggcgtcgacgaaggcgcgcagcacgcgagcggagagaaaggcgagccgtcacggacgaacagggagcagtcgcgcgaagcgcttccgaaaaaccttattgccgccttctcccggtgcaggacgtcgaatccagaggttctggagacctgctctcccgatcgccggtgcacgccgacgagcgggatggagtagtctacgagcgacggcgcagcacagagtaggaggcaaaccctagattgatttcgcgtatgttgtgtgaaggcggcggctcggtttatatagagataggtcgcttgatcagggcgcccgcagcaccagatttttcggaatgtttccaaaacaaaacaaatccgaatttccgcagcaaaacaaaactgcaaaaggaggctgcatctgcgcaagggtgaggagccaattttgcggaccattcaacgcgtacgtcgtgcacgcgcgccgcctgccaggcaaggcaagcgagcgcgcgcgtgtgatccccctcttctctccaccacacatgcttcaaggggctaggagggcatcctctcttttaaggaggtccccctctcctagaataaacaaggtggtactaaactccatatgcatgtcaacttatgaggtgggcttttgtgattttccaacgaattaatcttcgaatgggccttagcccgcctattaattccaacactggtttgggtgaaagcaacatgtgggctgggttgggtggggtttaaaaaatgattatgtggaatggtttggattgggtaaactaggtcgattgctttgggttggggtgaatgagggctagatttcaatccattggcagccttagttgtaaccaatcaaaacctatcgtttgattagcacatagaaaaatcgtagaaattttagacactaaaagagaaaaacatgaggtgatgagacctcatgcttattttctttcaaaattgtcctagcaaggttcattcctcgggaatttcaaaagaattgataggaaacaataaacaaaggattatataataaaatcctctagattttctatggtttttactttgtttcaaataggggtctaagggctcattctaaattactgttaccttctcgtcgcttccaagggctcaccgacagttgctgcctcactttcctcgggcaagctagcgagctttgccctcgtccaaggaaggaggggcttgtggtggaggtgggagggaaggagggccttgtggtggaggtgggagggtatttttggatgttgcatctctaaaacaaatcacaaagtagttagaatttttgagcgataaaatattctttctagtagtgaatatttttacatatatttttatcaggaactactccatggactatggtacctttatggaacagaaaatacgcgtgatattcacaatatctccataaacttgcatatccacaaaacgcccttgatatccgtgccagttgctaccacaaaacaggttatactgccatgtaaacaccgattatgttgccgtaaaacttcaacgctgccaccatgataaaccaatgatttttctgtaatacttcctcaaagatactaatgatacacaaaaatgctggtgatgcccataataacaccacgaaaacagcagtataccaacagatgagcaaggctcaccacataggggcagaaacactacaacttgcacatacattactgttgatcgcttcctgcttagctcagtactgttgcaaaactacagaccgtaagaagataatttctcaagatacaaaacttgcactgcctaaagcatatgaaaggaaaattagaattccagtttcctgtgaggattgctggcgatttggcttgtctcacatggtttgaaggtaggaaccaatactagctcgcttaatatcttacaccatcacagattcacagctattggggttcagattatgattgggtcctcaattcaacaagcaccaacagctatatctgattttgcacatggatacaaatacaggaggatccaacagaacagccaaatctgacgatgctgatctaacaacagttgcatcccagaagcaacagtgcaattaattttcttcattctcttacctcttccgcctcttgcttctcttcttgtcactctcatcagagctcgattctgactctgagctggagctgtctgaagcagatcctgaatcacttgatcccgactcagaagaggcgggtttctgttgttgcattatcagtcgaggcatattcttcaagtactctctcagggtctctgtgatacccccaagaccaatggaggtgaaaaaatttatggagaaccttgtattctttggatgatcctttgggaatattgaatcaaatgaatcttgcatgttgggatcattcagtttctcgttgagtagacgaataccaagatgttcagacaactcctgcataacaataaacatatacttcaattgtctactttgataaaagatgagttgacatagtaaataaaagcagaacattaacaacatacctggaagagtattttaatgaaaattcgagatgaagacgttgtgtcctcctcagtcaatctgatgtaggccaaaacgtgccaaggaagtgcatcagtacccaacagatgtgcaaaaaatttagcaacattccttagcttatttgtttcaagacgatgtatcatggaatactgctgcacaaaacacttctcaaagttctcctggtaaactttgttaatcatgcaaaatcgttggcccaataatccataatatcgaagataagttctctcctgactgcaacactcgagaagcatgatgcacaattccatctgtcaatgaaacagacagttggcttaggggaaaataatatgtctggcaaattcagcactgaagaactaaaagaaccaatctgattatgcaaattgaagagggattgtttgacatcaagtactgtattgtgaaaaaacaaaccatctggaagctttttgaccatcgatttttcatcctagcatatgttattatttagtagttaggtctgatcaatgcaataagtgtaaactagcagatgatttgaataagcttatcaactggacctgaaagtgtcatgggcaaggattatgaggagaagaatcgggatgaatagggatagattggattatagtagatgaaataacaaggaacggtcctgaacctaaacggcgcgacgctctctgtcgcactgagaaggcaggccgatgggcaataagataaatcttgatctaatgcctaactaacctaggataggatcccttcttatatagatggaggagtccttaatctaatcctaacaaaccctaatcctatccaatgggcctaggacgaccaacccaaagcccatgacattactcccctctttttgagcagctcgtcctcgagctgcagcggaccctgctagactcaacaaaacatcataacctaaactaagactcttaagccttttacatcttggcttattataaatatatatataactaatactattgcaaacaaccctactcttatattgtcatcaagaacatagacaggaggaccccatcctgaagccctgtatggaaatttaggcccacgccacaatccaaatctaaaagcccaacttgactgacccgtgtgataagcatatctaagccaacatgggctagctgctgatcgaagcccagtccaccagtctggcccatttaattggcgtagctgagggaaaacagaatccctatctccctctatcgtattcagtgccatccccaaaagaacgtgatgaccctgcttcacaccgtgactccaaggtaacagaagtcgccgttttctccaccgccgctgttgaaagtagcgatggaaacagctctgctgttcctgccgcttccaaaaaccgcgccgccatccctgctcctgccggaaaccgtgccatctcggttggaggtgacaacgccatcgacaggcccaacaactaggtcgaagaccccttggaggcggcttgggcagaggtggtgctgttgatgccacctttggctgctgcatgtgacgcatcctgctccgcaaacggcgcttgaagtcctgctgccgtgggcgcaggaacgtcatggcccgccggtcggatcgctcggcggctccgagaggcatggcctgctcggctgattgagccgccaaaacctggagttgcgccgccaagtccatcatcttctttgagatcttggcaaggccttcgctgatgttgggaaccgcagcgatctcggtacccatgggcacggaaccgaagctctaataccaagttgtcatgggcaaggattatgtggagaagaatcgggatgaatagggatagattggattatagtagatgaaataacaaggaacggtcctgaacctaaacagcgcgacgctctctgttgcactgagaaggcaggccgatgggcactaagataaatcttgatctaatgcctaactgacctaggataggatccctccttatatagatggaggagtccttaatctaatcctaacaaaccctaatcctatccaatgggcctaggacgaccaacccaaagcccatgacagaaagttacatgtacaattgaatccttattattgttccttaagaacccccaccatgtaaataacctaaattacaagaaaggagccaaatgaagcaaatggtacttataaaccatatgtaaatggaggcattaactacaaattgctgcattgtactaatgctaagaatttgacacaattttctagaaagacaattagcataataactacacagatggcaaataaaaccattgttgagacaataaagttcatgcattaccacaacaatttgttccaagttctaatataaagaaataagtcaacctacaatacttacctcttggccaggctcgagtttaatttttagaagcttgtgaccagcttcttcaaaatcaacactcgacataattgtcaaatatatggttcttcgaaggttaatgagattagtctcagtttgatccctaatctccatctgctcttcatcctcttcatcgtcagattcttcttcagcgtcctcatcagaagcatcatcagacccttcttcatcatcagaagattctgctcccaggatgcttctttttaggttctcatacgccttctcatcttcagcaaaattaggatttgccctgaaaacatctgcaggttggaaaaggtaagtgcaatagcacacagaagtcttaagacacatgaaatgcaggaaagtttcgagattcctatgggaattgaactggtgtctgaaactccaataaaagcgtcgtattccaaacaaaactaacacaagcttttatctcataaatgtagcaaagtgaatatgttcacagaagaaataaaagctcacttagattagtctctgggtctagctcatcttcaagggatatctcatgagtaaattggtcttcctgctccacaagatccaactctggacggatagcagggaatcccttcacatataagatacaggtcagaatttgttacaagcattcacgaagaatacctgaaaatattagtaacaatatgagcatacctgaaatttagcctttctaattgcaaacagtccttcaattaaaaattgcacacgcttgtctatttcaccttcatgaagaatacctcgaaatctttcgaaaatagctgcaaagattgagaaggcaaatccattgaaaacaataatggaagaagatgaaaaaaattgagcaatggtttgctttagttaatttttgggacaaataaaactacatttagcaacagcacaagtgttcaaattacacaattgtcacaggtaaacctgaattggactgtgttaggtagcatgacttcacctaacctattccttgtacatttttaaggttaacagcaattaaactcactgtttggtactgtacagttcacatgtccaatatcacacagatgaaatgaataccattcctaagtccaaaaaatatcgtgaaacactgttgtgctagccaacaggttcaacaagtcatgcagtcaaaataagcacttgtaataacaggtgatataaagaacctaccatgaagcccttgtggagacaagtcctgtagcattgccccacactctttaacaaaccccactgctacctgtcagacaagaaatatatccatacttcagatattgcacaaaatgaagttctgattaatacaaaggtactcaaaaacaagagtgcacctcaacactatcatcagttgggttctcaagcagcacggtaagaagctccagcgccacgagctcatgagcaacaacctggttaaccaagtgtgctatgaatttggttgctgcaagcaattgtggctgcaacaaccaagagctgttgtttaaaacattgcatatgcaaaaacataaaattaagcaatagataatcttatgaagtgttcgttttcaaacagtgctagaaaccttgactagaattcaggccagacatcactccaacatggcataaaactaaccaaggtcttccatactagttatgtttgagccagtagcagtatcttacattacatgtcaagctgaaaaggagaattgaggaaagttaccttgtcatttcgcttatatgccctcttgagctgaagcacaacacgaacaagaagcaggcggccaatctcagggaacttggtatttacaaccgcgacaagtgcagcaaacacatctgtgaagccaggcgaagccatctgcgacttgatgcacgattggcagaagagcccccttccacgaaccaggttctcggcgaacagctcgggcactatattctttatgttggtggcattcaccttgttcaccagaccattgatactcttcttgagagcatcccagctgagacgctggtactcgggactcgacttgtcctctacctccctcatcatctgcgccatgcggaaaggcgggatgtagattcctcctgtgcggccgggtatcaactccggcaagagcggcggtggcgggggcagcggcggagtcggctccttcctatcagggctcctgcgtcgctcctcgcgaccgcccctgtcccggcgcctctcatctctctgccgcctggagctctcgtcacgacggtggcgacggctacggccaccatcagaggactccgagctggggctccggcggcggtggcgcctccggtggcggtcgcctctctcgtcgtcggagtcggtggagcgcctcctccggcggcggccgccctccttgtcgtcgtcggaaacccgggacggcctcctcctgcggtcaccaccctcctcctccgcatcgggcaccctagcgcggcggggggagcggtcgccgccgttgtccccgccaggcttgggtgctcctcctccgttgctctcggcggggtcggaatcgcgggggcggcggggcggggaagccctagatttgccgcggtggcggtcggcgtcgcggtcggagggggagggggacggggacggggacggggaggcgcggcgcttgcggtcgtcgcggtggcgcggggagtcgtcgtcgtggcggcggcggcggcggggaggggagtcgtcgtggcggtggcggtggcggcggggaggggaggcggcgggcgagacggaggcggccatggagagggttgtgagattggtcgagggtttccgacgactgacgagagtccaaagggtgggggaaaaaagatgatttgattttgctcaagaccgaccactgaaccgggccgaaccgagatgtgggttttggctgtgttcggctggttttttattcagattggctaaaactatggagtcgtattttttttttcacttcggccgtgtttagtttctccttaaaaaaaattttaacgtatacggatacacatttaaaatatattaaactttcatttctagaaatggagatgagggcgtaatgcccttggtctaaaaaaaatttcaagtattaaacgtagactaataacaaaataaattacagattccgcctgtaaactgcgagacaaatttattaagcctaattaatctgtcattagcatttttttcgtccacatttaatgctccatacatgtgtcgaaacatttgatgtaacggaatttttgaaagtttgaagggaactaaacacagccttaactagaaaaaatgaccgtgccaaaaaccctatattgagacagccaaaacctaatttggcctaaaaacacccccttctccgagagatgcctaaaattttagttcccaaaattttagttctcattcttctccgcttagtctatattgtcatttagagagagttagcttgattgatccatatatgtgtcaacatacccttattcataattgactaacccttgcatgagatttcgatcacttaagtgtgatgtacattaataacatagtacactcttaccatatcttcacttgagattaaaaataagacaccttggaaatattttaaggtgaaatgcaacaacggtatatctttgcacttgcggattatatccttgatcgtaagaaaataccgactaatatgtctggtgccattgcctctacttaatgtcgtcaagaaatatcaacgggtagtataattttattattatttatcatcatctacagtgttgcatgagttgatgtgttttcatcatctctgccttcccatgacactatcctccatttctcttatttttggttatatcattttttaagatatttatatacaacatatggttctttataaagctgtaataaacgtctaaaatttaaagttctatctatagcgtgtttgtaagtcatatatagaaaataacataaaaccggcgggcagtggcgttgggggcgggctgcaccgcggcggtagggccctcgtcctcatgctcctctcccggcggtagcggccggcggcggcagcaacaccttcctttgctccccactgctgcctgcctcgccccgcgtcggcctcctcttcatgccgctcttgcccgccgccccggcctcgggacgccatcccgcctgcgccatcacgtgccggccgccgcgtccatccgccggcgcgccatctcctcctgtgctggctcaccccaacactgccgccacgccagatcgagcttgccccaacgccgccgccacaccggatcgagcaccgactacgagaccgcctcctcacgactgccgactagcaactccgtcgccgcgaccccctttccctccctctatcgctgccactctcaactcaccgcgcctcgcgtcgttcggcccgtggagaaggagcgaagagagaaggcagaaaggggaagaaaacgggagaaggaaggagaagatggaaaaggcaggggagagatgggaaaagtgacggcagaggcacagttataattttgtaaaattacaatgtcgctgttacaaacacacgaattgtaatgatattttttctgaatagccaaatttatagtggcatggatcaaattaacccttgatctaatgactttggttgcatatccctatttttgtctccatctgaatccaatggtgaatagtttctaaatgatggcttattccggctacatttttagttttacctttcaatagttaagataagttgtataaaacctttattgtagtttgtgacatacattttgtgatttaggagtataaaaacacattcttattcaaatccgagataaattgtactatatttaaaataagagtgaagtatataggtggtcctaaacttttgcaggtgcgtcatttagatcatatttttgggctcctaaagttgacttcatgccatacaggttcaaacgagctccaatccactccagagtgttgacatggcatatcatggtggtacctacgtgcctatgaattaaaaaaaattaattgacaataagttgatttcatgaaattctactttcttaggcatctataacacaaaatcacgcaaaaccctagttactagatgggtactccgcgcgttgctacgggagaattatgtgataatatagtacatattacttctaaaattttctttcttacctactatacgatttttttatgtgtttatatattttttacatttatcaattatccataggttataaatgattgggttgtatggtgtgtcttttggagggaagagatgtaatttataccctttatgaatcatccaaaagcttaaaaacaattgaggtgatgtgaagagatgcaatttacacccttgatgaatcatccaaagggtaaaaacaattgaggtgatgtggcttcatgagagaatagagaattagcattaactacagttactggggatgaactttatagatatataggatcatcaaagttccaagggcaagcgtcccagcctagggcatctctgcaggtgcaccaaacaaaaatagtcacagggcactcaaaaaggatatgatttgtggtttcagaaacatcacaaagaaaacactcttcagaaccaacccatcctttcaacttaagttcatatttttaaaaaaatagacttagacgaagttcatacttaataacattcaaacgatcagcaaagttctatacttaatccacccctagaatggacggcggcagagacacagacgaacacccgaaccttatgctggcatccagccctcattccgggccaggacgcggtggcgctgccacttcttgttctcctccctcaggctcgaggagttcgccttccccacggtgtggttcttgatatcctccatgctattccaccgggacgccatcttgccggggcagaccaggcacctgaagtagaagccgttgtagatgacgcgcagagcaccgccctgggggaccggccgacggtagccgcggcgccggtcatcttccgaatcggtctcgcagtcggacccggagtcgtcctcatcgtcatccaactccaactctggcaccatcttgtcgtcgtcgcctgccagggagccccgagtggctctgcggccctttctacctactatacgattttttttcatatgtttatatatattttacctttatcaattatccataggttataaatgattgggttgtatggtgtgtcttttggagggaggagatataatttataccctttatgaatcatccaaaagcttaaaaataattgaggtgatgcgaagagatgcaatttacacccttgatgaattatccaataggtaaaaacaattgaggtgatatagcttcatgggagaagagagaattagcattaactacacttagtggggatgaattttatagatatataggattcgtataatttgttttcaaataaccctattttaaggcaaaaggcttgtacaaatttctagatttgtataaatatctatattccatcattggatctgttcgacaggcgggtatctgccgctgctgctgctgtgtgtgtgcagcactattagtgctagctaaggcgcaggcgcggactgagcagctgaacaagcccattatattgtttgttacttaaattaaaaattgtatactctcaatgttaggtgccatcagtcatgtggggtttatataaactttgactataaaaagtttaattggtttcatttccattgatggaatttgaaattgacatgatgtagttaatatattgttctgtaaaaacatcattgaatgtcctcatcgcttttttataggtcctcatcacttatttacgagcagaaaaccagcgtggcgttcttatattttacctaaaaaaagtggtttcttatatttaccttggcttaattttgtcttctcttctttattaccaccctatcaatatattatatattgacccaccagtaaggttgtgttcctttgctacctttcccagctcatattaatccattttataaaaatagctaatactttattaatcatacgctaatgagtcagtacatgttacgtgacggagggattagttcccaacttactccaacgaactcagcctaagaatgacccaacctgtcattcttagcaagattccactcacaaacatgtagctcatttgtcgattgccgtctttttcttcacaataatcgaataaataaataaataaataaataaatatacatacatacatacatacagacacagacacacacacacacacacacacacacacccaccgtttgatcactcctcccatttataagatgcgttttgcatatcaactcattaccagggggtaaaaacagaaacagaataaaccgctttgatcaggccaagcagatctatggacagggaagcgaatacatgaaaacttgagatgccattagaacgtggaaatatacaacaaccgtcctgtactagattacactcagatccttgaccccaggcaacctaaattgccataaaagaaccaacttacatcacagagcatctctctctctccccctcctttcttcagcacccatgttaccactcggccagtgtacctctccctgcttcatcaaatggtttcagtgcagcatgggaggtaaatgaagtagtggagtgaccattgcgaagccttgaagggcgcagctcaggtgaaaatctcgttgaaagcgcaccgcgacacagtcaatatgataattcatggccacgcagtgatatgtacttcttaacccagatggctatatcttcggcgcaagcctgagccagtggtgttttcagcaagacgtccagcgtggcgaactcatggaccgcatccttgtactcgagaacaggggcatccacatttaccttgcggagctcctccgagtaagcgatcgcgcggtccttcatccagtccagctccgcaacactgtcaatgttggaggaatgagcttcaaagggggacctttaccgggaacaagagggtttgcagctggatgatccaagctgaattcaccctcaggcaagaagagtttccaggccagtaagcacgttgacttgtcatagaaataggagtttgccagcttcagttccgattgcgtgggactagtccccatgaaaaatggatacatcaaaacctgagcgacgaccttgatggggtcgaggagtttcccagcctcaacagcttttcgagccacatagtcagcaatgttcgctccgcagctgacaccaaggagaacacacctattaccatcaaagaggaaatgcatgtcagtaactggtatcagtagcacatttaccattaaacaaaatacagaacactgacacttagaagtcacatgtgcaccacaccactacaactaggatgcataagaaatgaaatgtctagaacaggagggatgtataatgtgaggcacacacaacacacagatcaacacgcaaacgaattacactgttacacaaaacaaaaaaggttaaacacacaaggtatcagagaccaggtggggatggggctattctgttgaattaaatagctagagaagaacagatgtagggaaatattagttcaagctacattttgtcgatttatcagaacaatgatcttacaattgttgtggtcatatgttttgccaatttatcagatcaatgaacttacagttgctgtggtcgactggtgggtacctttactgcaattattgtaattgtaaggactactcaccagcattcaacaccaatatcagcaggggatgggagaaagtagacgggttaggaatacaaaggttgacttatttcttgcatgccgaaactgatattatcaactccattgtaaaacactagcacacttcaattcctaaggcatataatgcatatattttcctgattacttttcccagctgagtacgaatctgaattggctccatcctgctttgtcttaccacaagttttcactgatatctggactgctttctaatttctaatcccaagattttagccaaacaaattataccctttagtttggctttcgtcggttaacatacatgatttcaaaggatgttcacaatggtggtactgatccgatcaaattgagcttgcattcgcagcccattgatcaccccagaaacataaaaaatgaaaattatccttcagagagcatgcggcaaaaaaatgtaacataaattattgtcatacttccatcatgaatactagaagcaacaactgaagatataagaaatcataaaatgtatcatggaaaagtataaacaatgcatctttgttgctaacatatttgggctagcagtcactatgctttgtacaatagtttgagtcttttgtaagggcaggttacataaaaagaaatctaaactaacctaatctccatcttgaagatcgtatgttgtttcttctcgccaattatctaacaacgtaatcatgatcaactcagactttaatccttcaacataattcactgaagcacttaatcatgatcaactcagactttaatccttcaacataattcactgaagcactgaatatgccaatgcctaaaaactatcctatataaagggaagcataacagctacacatttttctgtcatccccattaaacttcatgctacaacagaaagctgaatagttgatcaagatttaatctgacacagacatggtcaccatcaaacaaaatgtttttgagaagcgtgactgcatgagtactttaggttctcatatttcaaaatatagtacttttggcctcacatgcaatttatgcccacagatcaaaatgccaacaaaaaaaatatatatataacaaatattcatgcatacgaaacaatctggaacattactgaagatataatagataaacaatgcaatagtggagccacaaggcacttatgaaactctagaaatcatctcaccatgtcccaacaaaagaacaccatgtgccacacatctttcccaatgatgattcaccctttccaatactcatttttttatcccattattttgttcagcacttaagctcctattttttcctcatctctcatttcataaaaccccttccccttcaagtcatatagaacgcaatgggttagtttgattttctgtctccacctgctccttacacccagcaatccagtgccgctaaccatctcctcttattcttcctcaacctcctgatctccaagagcatgcagatgcaaactgatatttctcctccaaggttccaacccttttctccctcccctcgtctcctgactactactattaaccacttgatattgttacacacacattaattctgtcatggtcgacttcaaatttcttgaacacatgagaacccataatccattaagatgcaggcacaggacaaattttgaacatgtataccagaatgaccactgtgcagctcatgctaccaccatctacagagaaggcatctattaaatggttacgatctacagcgaagtacaggctacgatcgagaatagatctaaagccatccatttaaatggtttaacttaaaccactatatttacagtgtaggcttgagaagggaccaactgaattcgaccaacataaagaatcataggactggttgaaagaacaattctaaattcagtctccttattcctaagttgatattgtttactcctacattcaactgcccatcattgaacttatttgaaaaccaatcatgcctgagttggccatgtgtcagtggcagttgaatacagtctgcaaactatcatgtatgccacattatgcagcggcttgagcgttagttctatctcaggtttctcaaccaagaaaataagtatatgactaaatccaaagctccagcacagaattgatcagatctacaaacacaatcctcactagatctgtcaaaacaaaacctacattcccgaaagtttatcagttatcacacacattgcaaagttggacgacgcaaatccgcaagaaatgagattagctcactatagtaaagaccattcatccatcaaacgcaatcacttcatcataacctaacaagtcaccacaccaaatcttgcaatgctcaatgctgactctagaatctagattctagcaaccaggaacgaacaatactcatccacacggcaaccaaaaaacgaatcccaagaaatcaggccaagaaaccgcacctggatggatcggcgtgcgcagctagccacggctcgaccaacgccgcgccgaacgaatcggcccctccagagcccgcccccctcgccatcgtccgcccgcacgcggcgaggttggcctgcttggcgatccatttgagcaccgtgaccccgtcctcgaacgcggcggggtacctgctctccggcgcgagccggtacccgacggccaccacgatggcgtcgcagagccgcgcgacgcggcggcagaaggcgtcgttggcggcgctgtcggccgcgcccgtggcgaacgcgcccccgtggaactgcacgatcaccggcagcctcctcccggagcgcgccgtcggcaggtacccgccgtagcacggcgcggcggagggcgacaccccgctgaagctcgcgctggcgcggcgggagagctcctgccccaccgccgccgcggggctgcccccgtcgtgcgctggctgcgggaacgagttccgccgcagcggaggcggagcgttcgcggcggcggcgggggcggcgctgtggtgcgggttggggaggaagaggcggaggtggagggaggagagcgggtcggggtggaggtccttggtggcaacagcgtcagcgccggcggcggaggagaaggagggattggaaggcggcgaggggtggtggtggtcggcggcggcgcgggaggagacgccgaatgaggaggaggaggaggcggcggaggcggagagggaggagaggcggcggcggaggatgagcttgaagaggaggctgtagagctggattgcgacggggggcatggccgtctccggcggtgggcggcgtgggctcgccggcgggtgagtcagtcggcgtcggcgtcggcgtcagggtggtggtggtgccatgggagaggtggccttccgctttttctctcttttttggtgtttttattttggaatttggtgagcttaggtgtgttgatagggatgattaggctagggatgaagagagtggttagataattttggggggctttggcttggggaaccaaagagatgtgcaccaaagtcggcgcgtcctttgtgattgggtcaggttgttaaaattgagaagttttattactcattggatgaattgatggaatggtatcctagcctttctcccatttcacggtatctcattaccatgagaatcttctattataaacgcgatacgatactgtaataaactcatgtttaatactataatgaaggtgtatatattactggtttatgtgtccgtttgagaatataacttcgtgtagtaaaatgcaatgcatattatatgactgtgattagcacaattgtccttgatgtttgtgaagaaagaaggtgcaacacaatcaagaccatgtgttattatctattgatatctgttcatatagctttaatagaacaacgattatatacatggatatgataaatagcaaatgttggtactgaccgtttgtttgagaagatattatctgatcgatatctacttgattctctatcacattgactcgattatattatcattagcagttcaatattttatattatggatatacgaagagcgcatagaattatgggttataattgatcatatggtcttaaaattttgtataacattttaaaattattaggatagtaacctgaattaagcacaactatgaacccaattaattgtctcatatttaatgttagaatgatactcatatgctttacatgtgacaagtactccaaacataactaatataccagcagaaaacaccaaacatcattaaaacctatgacatcacccccttaccaatatcttgaggagataagcatgaaaacaaaaatatcctagacgtcggggcacaactgctgcctacgagaaagtgacatggaaagaaaaccaacgcttggtgactgtgactcatgtgggtagctttcggctgtgcactttgcaggtctcgaatctccaaccccctcccctgttggctccatccgtccaggtgtaatgtgaccatgcgacagcgtgtgagcgggacagcgcaaagccacgcgaagtgggcgttggtaagggtaattactccctacaatcctattttaaatgcatttatatgtccaatgttaaatttttcgtcttatttaaaaactataaaaaaatttaaaataaatcacgtatacattactatttatatttgatcatctaataatagtaaaatactatttaaaaaaattaaataaaacgacgatcaagcattaattaacaatatatggcatcatccgcggcatgagcaagttgctagtaaattaattagcagcataatctccgtggttaatcacgcttaccctccgtggggttaatggctggtaactaatgctgacttgttacctcacctgcctgcgtgcgcttttgctttgctttgttttgccaccgacgaggtggcgcatgtcggggtcggcgctcgctggcgggtggggcccaccaccaccaacggcaggacgttagggagccgcgctcatctgtgattatgttggccttgggattactccacggttgacgctcggctcatcggaatccgcattgcttttgtgggcgttttgccgtgtcatatcggaggtacgaacacacgtttaaagtattaaatataaattaataataaagcaaattacgtattccgcctgtaaactgcgagacgaaattattaaacctaattaatctatcattattaaaccttattaaacctaattattaaacctaattactatagcaccacattatcaaatcataaagcaattagacttaaaagattcatctcgtactatagcaccacattatcaaatcataaagcaattaggcttaaaagattcatctcgtaatttacacgcaatctatgtaattagttttttttctatttaatactccatgtatatattcaaacattcgatgtaatagggtgaaaagtttttgcgtgcgaactgccttagaaagaaaaatccatggaagttagaaatagttgttgttttacgtaagacttgtattagactttcaaaaactttgagtataaattttaaaaactatgaataatttctaaaatatttgccgtataaaatgaatactctattgtaacatacccaaattctagaccttaaaaatttcctatcaaaatagttggaagctaacttttctatttttgagagccaaaaatttccattttaaacaaaggtgaagttgatcaaactcttgcatgataaaattttagaacaaattaaaacctttgcatctctaacctaggacaaaaaaaaataaatttatgtgtaagcatgcatactctcatagccatgtttgacttgagtccttcatatgcatttggattgcatttggattttcgatttgcatatcataataggtctcatgaatattaattaagatctagataaacaactgaaccattagggcctagtgctagctagaggaagttaaaataggaaccatacaccttaaaatatatcaacaaggccaatgtcaagccccacaaaactatttggtcatccatctgaagactagtcatgaacctggtagtgaacaaataaattaactcatatagggtatattccaccttagttacctttataagcattctcttaattaaatactagagtaaacttatgcataaatagttaaggagcttatgacatgtgtaaggtaaactgtaattctaacatatcaatatcacctcaggttaatgagagtccaaatataacttttataaacatttacatgcatttaggaaaggaaaacacatatataaagataagtcttgcgaattatctaaaataattcgtgcaagataaaatcatgggaaaattcatgtaggctctacttaacatatacaactcactgtaattttggtataatttaataactaaatttggtacctcaaataaattagtcaaactaataaaaactagattaactgtagttcttaatcggctaaaaccatactttgtctaaaagtgcatttaactgcataaaagtgtataagtaaaataatttattcaaatactaggttatttatcatgaataaaaataatttttccagaatttatcttctctgtttaagtctcctaaaaattcgaactagtttccaaagaacccatattcctctaatttctgtgagtaatctatccataatttttgagtgcaactaaagaaaatggaaactaggtacatacacctacctccagtaaaatcaacactagttaatctgatcaacacattgagtattgaagctacaaaattagaggagaaaataattccggaaattcgtccaaaaaccaagctcacccatgtttctgcctacacatatcttttccacttagtttacttcgacctgggcccccttgtcagtccctccgacttgcccttcctctgtgcaacttccctagccgaccgagaaacactgagagggagagatcgaacgccgactggctctggacgccgcgcgacgcgtggccacgacgtgtcgacgccctaaaaacgccgagctccatctctgcctctcccagacgcgtcgccactcttcacccaccattccagtgccaatccatccgagggagagcatcctcgctgctcttctccactggttctccatcgccggccgtgaagaagacgatggccgcaatcgttgatgagccgcggtcgtttccccttctcttgcgttccatactctcctcaccatgccgaatatttctccttttgatttcatcctctctggtgcagccaatcgacgggaacgctgccgtgcacaccggagctctggagcgcgctcagcgcaccgccgcagcgacatcgtcgccgttgccatcaatctagatcaagccggagcgagccaccacgccaccagcttcacctcaacctcctctccatttaccctcaagaaacccatccaatggcgcagcgatcttggaggtcgacatcgtcttttccaactccgttcaaccgcttccatcatcgattccattctctctggtgagcgtcagtcaaattccatgcatgcatggcctctctagatagcctttgacctcttgcatgcaccgtattggtgactccccttacagatcgagcagcggacgtcatccctggagttgtgccatgccgccatggagcttcgccgtcgctgtgactctacagacatccccagccttgtctagcatctcggtgagcacccagaagcctatagaacatacatgcatgcacccaattaaccaatacatgattgtagaagcacatgcatcaccacccgaaaacatcctcttttcagactcgccgctggcgttactccgatgtccactgaccaagaaaagtagaggaatggaatcgcaatagcatgatcttcattttgtcttttgtcgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgggcctaggtctgcgtgttgattcttagaaacctcagagatctttttgtatattgatctctcactgacagtggaccccttggaaacaaaatctgaaattataaaagaacagtaactaaaacatgtaaaatccatataaaattaaatatagctcattttaagatgattcaaatttctgtgaaatcaccaaattgagaactttgatgttatggaataaaaacttgcactcacagtacaaatttagcctctaaaatttatccaagttaaatcacacataaagcatgcacaaacttataaaatgcatacaaaattcatttcaactcattttggagcaatctcagtttctacagatccaccaacttatgttctcctataaagcaaaatgaaatagtatacatactatacatcaaatgcctctaaaactgttacctttaaatgactagttttagataagctgaattttagaagttcatataaaattcatcttagatcctttttgagtaaacccaagttctgtagaatcaccaaaacatacacttccaagttataaaataaaattatatacttactgtatgataaaagcctctaaatacttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggtgctaatcacaaagtatcgattgagcaatatgtatatatataaatgtatatagaaatacactctagctataatgaaacccaaataaaacttgttagaccagtgaatgcatatttctatccccatccaccaaaacttaaggcacttagctcatataataatttctaggttgatataataaattgctaacatggactagagctcccctagtttataaaatatgaaccatgataataaagaccataagcctatgaactaaggttagattggttaactaaaatactcattttatacatcactagctagatgaggaaagttttggacctaaacctctaaagccatgaacctatagaacactatacacctataacacgttataacttgtaaaatacataaagaattcatattaactctaaaaattatgaaaccaaatgtgttagtcttagaaaatacatatattcaccccccacaaacatgaacttaataagaatcaccttacgacagcggttcataatagtacctaagtaaatcctacactataccgacgaaacttctaaaattcataattctcaaatgaaacgagataaaatagaaattctttcacctaaattcattttagaccagtacctattcactgtgctcaaatcatgcattttagagtattttggatttttcgcatatttcggtgtttaattgcataacgtgtactttgtatagatgattgcttaaacggtgaagaagtgatttaggtgctgacattttcctgattcaaggcaagtcccacctccctctctttgatcactttgaacctatgttttggaggttattgaaaatgtttgcaaatcttgcatgtcgattgtacactaataaattaaaattttgttaaacttgttagataaactcctattatttgcattatcaccttaactccacatatatccatattcctcattcctaaccttaggaacaatatgactataccactttatatatgagttttggtgacactaggttactataaagcttagccatgcttagaatggtcttccttgtcattatgggctcattacaaacatgaaaattgatttttaattaatctggacggaactttaatacttgtgattttgataaataaaatgatggaaaacatggattttaggtttgggcctcaagtggtgcacatatggtgattagttgtgtaccgatagggggagagtgtgcccaaaccgacctaaggacttcactcaatgttagttcatttcgtatacagtgcaaccacatgtgctagtatgggatagcccaagcttagtaaattatttatggtttagccttacattctggtaggccggtgtgtatgagttcgtataattcagaggagcttcctatttaccccgaagtggtagtttaggcgactaagcgtgtccaatacaacggtattgtgccacgtggtgggttcctgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctgttgcatgattattatttcgcatcatgtgggtaaagtgtacagactctgcagagttaaaactaatcgattagccatgctcgcggtcaagagcgatgtgtggatatgtattgagtatagacttgtgtttattcttcaaaatgctgaaatttaccttcaaattgtgatgagatttgagaatgatctccttgctaccatggaaggcaatgaggtgcatatttatacatgattaatgcctaccttgatgcccaatatgtcaaatactagcttgctgaaatttatttgaaagtaaacctgatttagaaatgttttatgcaaataaaacttgctttatgctaaaaagaaccatattataccttccttgattatatgccttgcaagtagggtcttaggcttgtgttggtgcttgccagtacattattaaataataatgtactgactcttgctgtggaattaaccttttgcttgcaggatttagacttagcctttgagtgatgcgggtgatcgactgcttcttctaggacttgaacttaatgggggtaaacccctagtcggtatgcttgtgattgggtagacaagcttccactgttctatatatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttaagaatatttgagatgttgtagatctttagctatttttgtcaagtctcctgaatgtgtaacacatctggtcgtcgccttcgagtggtttgacgggcacatctcaggctgaagttgactggcaggctaaagacctagcaatgtctccaatattcttctctcgaggcgtcggatgtttcattatgtttgtttgatgacttgaattattcacttcatccctcaaatataatggaaggtccgtaaagcctacgacatctatgaatagaatgtacttcaccaaaatcatatacatttgttaatcgggatcgctaaaagctgtcacaagtttttttttttgcaaaatactttcaaatgtaattataatgtagttatattataactacattataatctatagataagttagatataaaatggcatatattgttttagtacatattatagttataatatagttatagtggaattatattataattatattatagttagatttgaaactttttccttaaaaaacttatggcagtttttagatagtccctctcttaatatattgtaatagaaaatattggtcaaagtttctatatagtataatgtaaatatttttggagaccgtgttatgattcaaaatgatagcggagagtaccactgtgtctttatcgttaaataattaggcttctttataaataaaatagtcgttgttgtcatgatttattctcaaacttccaacgctcatatttgtaaatttacatatatacatacatgatcaaatattatcgaaatatattttgcatcataaatataatgttcccatgcaattctcattcatgatatctaatcattttcttactgatcagagtaaaattatattgattaaccctgacaattatttgaaaacacagagattatcaaccttaagtccttaattccttggtctcctaaaataacattaaccttgacccacttcggttccataattcttgatattttagacatgaatgaagttaaacttttattatttggattattagtaacttaaaaacaaatatttagtttaaagacactaaaacatagatttttcatacaagaataatgtaatataaataaaaggttatttatttattatgtattataataaaaatataatcaaagatatatttaattttagagaccgtatcattgtctaaaacgtctacaactatggaatagtttctactgtaatactcctgtatctacaactatcaacaaatatataattttgttgaaataacttttaggattaactaagaaggtggcccgcacgatgcgtgggcatttattttgttgaaagataagattatagtttatttagaaattgtctcataggtaacaaacttaggatcgaacaatatccttttaaaatgattcgggtgttctattttcttaacatatctcaaaaaacattcatcaactcttgaatagaagatggattaagttagtacaactcttgcatcaaataaatattaaactaccgctagcttaattatcaagcatatcacttgtatacataccatggaaatatggctacaagcgaaaattgtgagatcaaggaactcaaaatgatcaatgatcttatgaaggcatatgacaaacaaattaagggtaaattaaaagttggattatccccctctatataagttcaacaatttcatattttctccatagttctgaataactttaaaaggttttggtgcatacaaattacctacaccatcgctttgcttggtattgcaaaatatcaacattgtttgaagctaatttctttagttttggcaagtttgattattttcttgaaacaatatttgtttaaaataagaccataattatataaatttaattagtatggggtagtttacttataaattttgaagtgttttgtagcaaaatttcatgtagtctagttatatcaataatatagttttgttcaataaattgaatattatttacagcaccagaattaataaaaatttatcaaaccatccatgactacttaaaaatttttggtttgtctaatttgtttatttcaaattcaaataatcacatattctccttctaaccggtgtgtttgtcattattcataataaaaaacacatcgatgttgtcactcaatcacatataaatgtaaaatatttgtcattattctcggaccgctcattcctcggtggtattcttcactcatccatcatcttaagatagttgtatacaacatattttgtctaattatttagtttacataaggggtgacaccacgctcctcctccctcatgcatgggacacagtgtccaaaatgttttttttccaaagcaagttcttaattaacccatgtaatttattagaatattacatgtgtaatatatgtgtatgtgacacatggtaatttttgtcctagcttcgccctgcttatatactataaaaagagataaattatattcaacccgcagtgcttgattcttcttctttctacattgcatcttcacgatttattttcatgttattaaaaaaaccaatcgttgtccattgataatttcatacgtcttcactttagcaaagcagtagcgctacaacatcatgatcaccttagctaccttaggtatacgatgctttgtcatacgtgtagaaggtaaagatgtcacatgtgttgtatagagagacaaagaggacttccgaggctgttttttttaacaaaagatagatctcatggtctaaataatatgtccaccggtttaactaaaaatcaacaaacaaatatttttattaggaaatagtctaaaataattgttacataatatcatataatggtgtaaactctatttttaaatattgtagatccaatttattaacatctgattgtaacgagttatatgctgatattcaattttttattaggaaatagtctaaaataattggtacataatatcatataatggtgtaaactctatttttaaatattgtagatccaatttattaacatctgattgtaacgagttatatgctgatattcaatgtttgtaaagcaactattatttatagtttattatcatgaataataataattattagtgtctcaactaaatacatggaaaatggaaagggaaaaagaggaaggttacatacctcctgggtggaaggaaaggtgtatacatagggggtggagaggtggaactgttgtttaatctaacggcttataatattggacccaccaatttaagtggaaataaacggatatatgttttgttttttttctcaaattttataggatttgttggcaacttgcgagagttttgaggaagtttaatcgaaatacatcgtatgatttatttgaggcacttatataaggataatattaactggagaacatctaccacattttctccctaaattttttcgtcggctttgcttttataattttgtaacctagtagttagctttatactatatcgtagttaagtaatacatagaagcaattatttatactgttattcatcaactgtaaagaatggtaggcttattttctttaataaaacatgtctactaaattaagtgttaaagtaaaattaggacttttttaattggatataggttattgttttctattaatggatgaattgcgtggacatgaaaatccactaaatgcattggtttatatagtctaatatgattggtgcagttcgagatgtggcacaggaatacaagaattgagaattttttatggtggattaattgttttttggattttaatatttgtacgttaaaattcagcaggtatcagtgagatggagtaacctgtcagttttgtatttttcttcagaactgatgaattaaacattggtgctaattacatctaaatagtaaaaagtacgtttagttctaataacaatgattaaaagaagcaatattaaacacatacgtgataattgctgatcttcgttctttctatcccataatgttttctaatctgtaaactcaaagtagcagtccgagaaacactttttttttgctttgacctatttcattattgtatcgtgtgataaaaaaaaattgagactatttttcagtacacagtacttattatcatgttccataactttgaaatttttaaaaatgtatcttactttttggcctaaagtggtttgccaattgctttgggattaaggcatgtattgtgttgccctgaagaaaatagtatttacataatagaacaatatattaaatgatatgtttgcaacaatcatacctctgcatctagtagaatcatccgcgtataccatagaactcatcagccattataggattaaccgcttcccatatcctaatcactcttactttaattatccacctatcatttttcttgttaacgcagtaatcaaattgcaaggtgccatgttatctgcaaatgcgtatatgcaatataatgtatacatttatgttatttaatagatgcaatatagtgtagccctaattaattaatacatgatagcactattgtgttcttctgtaggtacacgattaccttcttttgtcaaagatgaccagcctgaattgactaatgtcacaaaggtgtcgcacacgtcttatgctaagatgagtcgccagagccgtgtattgtagagattaaaatgccatctggtcgtggtgttcctaaaggaggtaaataatatgagattctacttaggagtaactaatcttgccggcctcatcgatttaaaatttgctaatctgctgaccggtgtgcatatgtatatgtagagataatctgagattacgttgacgtaagtagggtaactaatcttgcctactttattgattcaaagtaggaaactaaccttgagataaatgcgctccatgttatgatcacggtaaatacatgaactgcacgtgtgggtcctcaactcctatgcgtgggttcttattgtgccatgtcatgttgagagcgttttgagaaagccatgtggcagttcaagagtgtttgtaggaagtttaatggacttttagtatataataatagatagaagataatagatagatagacagatagatttaatacatgttatccccatatttctaaagtagtaaatattttaaaagttatttgtagttagagttttaaaagtttgacatcggtcttgtttaaagcaataattatttttaactggagtgagtacataacaaattcttcctgaattatctaaaagaaacaaattcttcctgaagttagtagtgtcattaggcttttatttgcattgaccggctggaagctgcttccattatattaaaaattattagaatttcttttactgatatttcgtattggacgtgacaacttcatcaatattttaccaaagctaactcagagcatccccagcagatagtctgtcatgtccttcatccacgaaatagcgtatggtgggagaaaatctagctccagcggatacactatccgggcatgcagggatagcgcatcccagagagttctcatgacacgaacacgcaactgccgctcccagccggattgagccatgaagagtgaaggagtgaaggtagagaggagagaggatgcgctggtggccaccttcgatggccactccaaccgtcggctacttgcacccatgctgctcccgtcatcggccacttgcgcccgccccttgcaccgcccgcacatcctcctccgtcccggctacttgtgccacccctccgttcaacagctcgtgccgcttctccgcctgcgccgccttgccatccactccgcccctttggcccacattggcccactaaccccacacccccccggccactcgcgccactgtttggcccatgccaacccgccgccctgacggtcggtcctcgtcctatcgacagtggacatacaagagagattgaaagagaaaggcgaggaaatatttttagagcggggaaaggtgaggaagttaatataaatgtatggtagttgaaagatattagtaaaatataggatattggtatatggaagatgtaatataaatgatacgttggaatgaaaagtaacatagagtaggaatcgttttggatgatcatctaaatgataatatggaggatgaaatttggatgagctgctgagatgttctaaaaccttgatattctgttggtgccaaaccaactgatgtcaatacagtactaaaacagacatatattggtaacacagatagacacccatgatttccttcgacctagctttttgcatgatgggagtttctagaaaaagtggctggttgatggtgtagtttatctgttcatgggcgatattgcactgattctgttgtcttgcaacaagcaaagaatatgttcagagtaagcctttcttcgtaccacaccataaatatatgcaataagggttgtgttttttctaacacttagctctatttaagttgaaatcgagagttaattacagaatagttataatgtattgtgttatgtcgtatttggattttatactatttgttgctctatttaagttggaatcgagagttaattacagaataattataatgtactgtgttatgtcatatttggattttgtactgtttgtttgtataggtaaaagaaatcattatgttataaatgtgagcacaatattaacgaatatcaatagaactcttacagagacaagggtgctataagggagtttaagaccctctttttttccctgattctatagttggatttttgtttgcacgctttccaagtttctaaatggtgtcatttttaaacaaccttttaactttctagaagtcaattcattcatttataccctcgaatagctatcacataaataagataattcatcaattttagcagttctaaaccctgagtagtatatattttttcatgctagtcatggtgatcattaaattagggatcaacggttaatcagagtcgtaagatgaatatgtacgaactactatcaacaactgtagattggtgtcaaaattaattgctactaattaaacatctaatggcttgctagccacataattaatttctctctacatgtatataaacatgcacgaagctagaacaaatattaccatatgccccatacatatatattaagcggttaatattctaattacatgtgttaagtcctttaaaatttcttaaaatgctctcaagctatcacgtggtgctctaataaattagaggaaatattagaaattctaaggaaaaaaaagcaaagtatccattacttgattttcggttaaatcggtacgcccaatattataaaccgctatattaaattaatcttagagcaaactaaatactacaaggtccgacctctcatccgctggcataggtaagcacctacgtacgtgggtacgtacgctttccgtcccttttttcatttttccctttctttttttccatgcatacacttccctccctttcctactatatcatgcgtcttcacgagacaatttatcacaataattttgagtatcttgctctcgcatttttcatttgtggccatataacacggtatgtatatgaatggcctgtatgatatctaactagcaatagtttattatttacttgagaaaaaatgattcaaaagtcgtaagtatttaatccatctcctactcaaagtttgtgaatggtttttaaagatatattaagaaaaatagaacccttaaattatcataaaatgacattatccgaactttagtttgcccttaatctatgagacaaaatttttgaacaacaataatcttacctttcaataatataagtacccgcgcatacgcgcgggccaccttcctagttataaaaaaattaaaaagataagtcacgcataaaatattaatcatgctttatcatctaacaacaatgaaaatactaattataaaaaaaattcatataagacagacagtcaaacgttggcacgaaaacccatttttttgggacggagggagtagagctgaagtcaacgaagtatctgtcatcggaaaatctgcagatgtgatgttttttgatgaatattagagcaccattgcttcttggtcttacgaacaagcttcgttgtcgatatattgttcttgacgagagccgtaggaagatcgatgatgttacactgaagaccggaaacatgatggatctgaatcggagaagagtgaacactggctacatcgtatctggagaatcgacctcttgagcctatctttgtcgaaactttgaagcaccaagtcctctatcctgcgtaccactgtcaatgggctatacccgagtatggtatttggagagtaatatatatatatatatgcaaaactgtagtaaaaggagacaggagacatatatttttatacaggttcggacccgtaccgacggataataatcatatttctattggccagagctgatgttatctttatatatcaatctcacatagacaatagataagaaaacctaatctaggctctgtcagtgcagcggcgtaaagctcgattaggtggtcgacagctccctagaacaggaacgcggcaaaatttgtaaaattatttcccattatcggttcaacgtttattgccagatcagttcctcttagaagatgagatactgtagttcagctctgttttgaccatcctatatatgagaccattcttgagaaaattatggaccgcagtgttgcttaggctgagttcttttcccgactcacctttcttttattccgcgcgtgtgcttttcaaactgctaaacggtgtatttttttgcaaaaagtttctatacaaaagtttcttaaaaaatcatattgatcattttttgaaaaaaaagctaatacttaattaatcacgtattaatgaactgctctgttttccaaattagctaatacttaattaatcacgtgttaatggactgctctgttttccgtgagcaggagatgggttccaacccatagcaacgatcgcagtattgtttagtaattaatctatgtcgattatctgtgttgtcaaatggacaactgcgtcacgtcgaaaggcgtgcttctctcgacagtggttggaagtaaaaacaattgtattgcttagtaaaattttttggatccccccattacatagcattaggtggctatttatagccctattacagattccccctttagtgtttaggtcttacagggaatttacatggttacccttgtgatagggacattattgagggcacactgtatcctttacatctatggcctcctattgggccatatggcttggcccatctgcttagcgaaaccttccgggagtacaacggcccgctgggccactttacggtgaggttcggcacttggcgaagtccgcgcccttatgctgaggctttcgccttatcgcctttgcccgtacagccttctgacgaagtccttgtctggcgaagcccgagtgtccgagccatggccttcgccatgagactttcgcctgtacggttcccttctcgattttcgccgcttgcctctggtctaagcttgtcgctcaagtcctcggtttcggcaggtcgggccgaaggcccttcgtggtatacctccaacaagcctctcacgggcaagggtgagtagggagcttcggccgagaccgtgtaagtcgtatggtataccacgaggcgccccctttcggctgatgctcctaccgaaacctatgttgtgttcctgcaaagtaaaaaacttgctctcgtgttaacgaaaagtttttgaggaaaatttccttcctgtgttcgccgatgaggggcgaagaggttaggctgctctttatattattatgaatagtaatggccccatgggccttaccattcttggtttcggccttttactgtttggcctcggtccgacgggaatttaccgtttcgtttacccctagacacgtgtcaggttctgattggtcggtagccgaactgtcacgcgacggggttatataataccccccgggttaccacttccccccctcttttcatttttaccgctgtcacgctccacgctctctgcctttgcttgcgctctagcgtttcgccacctccgtgctctcgcgcttgctcctttggactttcttgttctctttttcacctttcgattcctttttcgctacggattcgatggctcctcgcaaacccaccaaggctgggtcaaccggcaaagaccccggtagcctcggcgaagggtggtcttgctaccttggcaagtcccttgtcaaggagtctaacctagccgagttcgtcctctccggtgctcttgcagagggctaggcgacttgcgggggtgaagccgttgtcccttcgcctggcgacaggcgaatggttgtctttgccgccttcctcatcgttggacttcgcctttcgtgcaatgattttcttccgtccgtactggagatatacgaggtcaagcttccccagctcaatccatcggcgttcccgaagttggccgtcttcgcatggatgtgccgaacgtgcgggtttacccctaccgccgagttattcgtcatcttgttcacggcgtgcgcgacaaccaaggacgtgaacacgctggctgggccaaggaagacgattttcggttgtgtgaacttcaagcttcgaccggagcgttcggacgcctggccggtgcctgcgtcgatggcgaagtgggatcgcaactggatgtagaagtggttctacatcgacaacccataccccgccgaggacgacaaggcgaactggctctgtttttagcgccttgctgtctccatcgtcgctaaaccgaatatggaggtcgacggtacactcgagtcccagcttatccttcttcgcaaggttgcgcggcggccaagtacccgcgacctctgcgaggagttttgcctacttcagatctccccccttgcccgcgactggggggggggtctccgttaacgaggacgaagaggtgctcgggcttccccgccttgttcttcccgtcggcaccgaacatgagtttctatttcgcttcttcgacatcgttctgtcatgaagacatgtttcgactcgcttcgatttatccagttcgcacattggaggatgctgaggcggaggcgtcgaaaatggttgaaggtttaaccaccgccgaattcggttgcctgcttcaacgtcaagccgacgggagggcaaatcgcgttcacgccggcgaactggcctgttggtcgattccttccagggttgctgacgacgatgtatggacgtcaaggaagcacaagcgagccgttgcgaaaggccgccaggtgcgaacccagcatgtcaccaaggacgcggccgacaccgatgccgatgaggaggacaatgacgaaagggaggccgggtctgacgaagatggcggatcgcgcggttatacccccagtccaacctggctgaatgctgggacgggttctcatgcttcgcccacgggtcctcaggacgtcgccggcgcgaacgtgctcctggagatctccagctccgtggtgaaaccgggagtgattgacaggaagaagaataagggttggtgaaagtcgccgacggcttttctgacagcgaggtgtctttcgattggacgcttacttcgccggcgccacgacgtgttgccacccggaggagacaactgtcgccacctcccattggtgacgccgaagcgccgatgggtggcagtgcttcggccccagccgtggctctggttggggcgattgagtcagtggaagtgaacacttctggggccaggagagtcgaaacggtcccttcgacgagccatcagcgggaggggaaggcaccggcggttgagatgacagtgtctgacatgacactcaccgccccacacttcgtttccacggatttcgcctcccggccggagatcgcccccttcgttggcttgtgaggtagtgattgttgtcgacgtcgtggccagttgggtgaaggcggcggtcgaaggcgcccccagggtttgggacgacaaggtcgcgtctctgacttgaagggccttcgccgctactgccgctttcgccgcttccgcatcagtcgaagatataggtgccgaaggcaggagagagggtggcaccaccggatgcggcgccgctccggcttcgccctccgaggccgaaggctctgctccctcttcggctaccatctccccttcgctcccgccttccttccgcttgacaactctctccttgacgatcttcttcggtggtattagtggtttcgcttggaggtccccacggacggcgccagctgcgtcacgtcgaaaggcgtggttctctcaacagtggttagaagtaaaaacaattgtattgcttagtaaaaatttttggatcccccattacatggccttagggggctatttatagccctattacaggttccccctttagggtttaggtcttacaggggaatttacatggttacccttttgatagggacattattgggggcacactgtgtcctttacatgtatgggctcctattgggctatatggcttggcccatctgcttagggaaaccttctgggagtacaacggcccactgggccactttacggtgaggttcggcacttggcgaagtccgcgcccttatgccgaggctttcgccttatcgccttcgcccgtacaactttctaacgaagtccttgtctggcgaagcccgagtgttcgagccatggccttcgccatgagactttcacccgtacggttcccttctcgattttcgccgcttgcatctggtttaagcttgtcgcttaagtcctcggtttcggcaggtccgaccgaaggcccttcgtggtatacctccaacaatctggattcacacatctatactaactagcaaaatgcccgtgcttcgctacggtgtattaaaactgaaaatatttgtttttaaccgaattttttttacactgctttggtacttttgctcgctagaaaaagtctcaaatgatagagggaaatatagctcataataaattattattcaatagtgcgttgctacggagtaatttcaattaaaatcacaagaaataattttaggatttaatttgtgatatgagtccttttagagtaaggcattcttgatataaatttgccaataaacaacatgttgaaaacaatatatttcaacatcaactaaggttttatcgcaattaaaaaaagactaacttcctcttgttgggtaattgtattttgtcaggtaatttttatttttagtttttctatgaaaattagattggagatatattttgagagagacaaagtggacttgttgcttaaaaaaaaagactaaccataccaaatgtggcccaacaactcaatcgcacgctgttagtgcttcatgtgctgcgtgcggcccagtagtgctgcagcgcagagatggaggccagctcgatgcgggattgatccgagccactcgttttgatggatggttcggatcggtttagaatccattaaaacggccggtaccaaaaccctaaccctatttcagtttttcctctcctaactcccgatcctctcaggctgaaatggtgatgacgcaccacgatggatgaaatctgattgttatgtttaaggcccccttctaaactccaactctaaacttcaacttttttgtttttcgttaacacgtttccaaactactaaacggtgtattttttgaaaaatattatataaaagttttttaaaaaattcaaaggaacccatttttcaaatttataataattaataattaattaatcatgtattaattgcttgctcttccttttttttaaaaaattgcccatacgagcgtgacggtggacacgagcggagagcgagagagcggcgcgcctcgttacttccgcccgcccttatctcgttacttccgcccgcctcttttttcttttctccgcccgcccctatccccttctcatccggcgattccttccccctcccctcaccttctacgcacgccgtccccctccccctcccatggctccttcccagcaccctcttcctccgtcccctccccctccatgactccttcccagcaccctcttcctctgtcccctccccctccatggctccttccccatggccagcagcaccctcttcctctccgtctcctgtgtggtggtagcggtgccctcccctctgccggatccagtgggaggggaggcggcggcggcccggtttcccggagggacggtaggggagacggtggcggtggggcagcaccctcccctccgccggatccagtgggaggggaggcggtggtgagatggtggtggcccggcgtccggatccagcgggaggggaggggaggcggtggcagcccggcgtcccagcagcggcggcgccctcccctcctgatgtgcactagggttcccgatcttccgaaaggttctgagaaacaacgatttggacggagtcgcgacacaaatcgatccggcttcttgaacacgcacgctcttgagccccacaatcgcagcaccacgtctcctctagttatcacccatgttgaaacgcggatgacctcgccgagaaggctaatccctgtttaccaatcaaagaacacaaacaagaacgagatagaaaaacaaccaaaattgcagatgaatgattaagctcacgagttggggtcttacaaactgatctagcggcgaaactgttctcgacagattaatctaagcaaaacccaaaaacctaaagatggcggcgggtactgatatatagagtttagggtcgtgcaaacccctcttgacgcaaccctaatgggttccaacacgatacacgggccaaaggcccaaatacggtgacgcagcaccgggacagattctggacgtcaacttgttcggtcaattcccgttgactcggaaagaattttgacgtgggaccaaaaccattggaaaggctatcttcttagctttccatcaatataaagaacgctccaatccgagcacgtatgcgcagcggcggagctagaacaaaacgaagggggttccactcgcttgttttactctggtttgaatcaaatttagcttgatacgggtgcctaagtttaaaataacggggtatatatatggtgaaaatagataaagtataggtaaaaagttttttgaaccgggttcctgggcacccccctaactatactagctccgcccctgcgtatgcgacctgggcgcccgttttagtgcagattggtcctgaactccgaattgcaccagacgtcgacttggtttgggcctccaccttgacttgaacatccccgatgatcctccatggctgtaagtccttctcctagtgtctccttgtcccctccattgttccaaagcacaatataatcattaggtagcaatctattctcgaattcatacaaagaagaacataggaacgagctcacctctaaatttaattgtcgcgcacgagctcttgttatcggtccttgaatgaccgttggaggattgttgtgtgtatccgaggtagtgatgtccgcatcatcctccccctcttgaattgaagtcgtcctcgactcaagctcatcctcttctcccaagtgtggcttcaaatctgaaatgttaaacgtgggactgaccccaaactcgggaggcaactcaagtttatatgcattatcattaatcttctcaactattttaaaaggaccatcagcacgaggcatcaacttagactttatcaattccggaaatctatcctttcgctagtgcaaccaaactaaatcacccggttcaagcttaacctcttgcctacctttactaccagcaattctatacttttcagtcatcttttcaatgttgaacttggttgactcatgcattgacaaaataaattcagcgtgtgccttatcatcattatgaaccctctcactagtaggtaaaggcaaaatatcaattgaagcacaagggttgaaaccatacactacctgaaaaggacttaccttggtagtagaatgtattgtccgattgtatgcaaactccacatgaggcaaacattcttcccacatcttcaaatttttctttaaaatagccctcaacatggtacccaaagtgcagttgactacctccgtttgtccatctgtttgtggttgacatgttgtagaaaacaatagctttgtacccaacttgttccatagcgtgcgccagaaatgacttaagaattttgcatcacgatctgaaacaatagtaaaaggcataccatgcaagcgaacaatctcatggaaaaacagatcagcaatatgaacagcatcatcacttttatgatatggtatgaaatgtgccatcttagaaaaacgatccaccaccacaaaaatactatccctccccctcttagttctaggcaatcccaaaacaaagtccatagaaatatctgccaaaggaatagaaggtacaggaagaggcatatacaaaccatgtggattcaaacgagacttagggtgtgtttggttgggctgtagcttttgtaaaagcagttgtgggctttggcttttgtaaaagtagctttggaaaagcagctacgaggaagtcaaaagcctgtttggttgattaactgtggcttttggaaaaacttgtctcacttacgactggacctcgcctgtcagcctcacacagctcgttcagttcttcttcctcacggtccatttcggcggcgacggggaagagcatacgcgcgcggcagagttgctgccgtcctctcctccgcgcgccccaaccctaggcaagccggcgacgggcggggacgaggagggtggcgctggaggaggacgggatgcggcctgttggggacgagcaacgttggcgtcgggcggggacgagcagggcggcgccggacgaggacgaggctgctccgcgtcaatgaggtgctccacgtcgtcgaggagtttagcggcgtcgccatggacatccaggaggagtacggcggcgtcttggcgaggagaaggaggagcagcagcggaggcggctcgtcgaggagttaggcggcgtcttggcgagaagaaggagcagcggcggccagtcggggacgagcagcgtcggcgccggacgaggacgaggctgcgcggcgtcgggcggggtcgatgtcggacggggagaaggggcggtgtcgagcgaggaggagcaggggcgacgccggcgttggactgggagggtggtgccggtgtcgggcgaggagggcggtggccggccggtcggagggcaaatgcgctgctgcatccccgggcggggagggtggtgtcggcgtcgggcggggagggcggcggccggccagtcggagggcagatgcgccgctccatccccattgccgtgcgcgtgtgaagactgaaaacgagaggagacgagaatagatcgaaccgtttttctcataatggcagaggtgggtaattttttcccccaaaagcagatgaaagcagggggtagaggtgcttttgatttgtactacaccaaaagctggctttgggcaaaagtagttgtggcttttgggccttttggttagcttttggcttttgcaaaagcaaaagcaggttgaaaagcccaaccaaacacacccttagctttctgacaagtggtgcaacgtgccacgaacctctcaacatcctttcgcatccttggccaaaagaaatgcatggccaaaacatctttcgtcttcttagctccaaaatgtccgatcaaccctcctccatgcgcttcctgtatcaacaaaagacgaacggaaccaactggaatgcatagacggttagctctataaacaaatccaccattgatcacaaatttgttccaagtacgtccctctttgcaatttatcatcacttcattaaaatcaggatcaagcgcatattgttttttaattgattcaagtccaaaaatccgacaatcaagttgggacaagaaagtatagcggctagacaaagcatctgcaatcacattatctttccctttcttgtgtttgataacataagaaaaagattcaataaattcaacccattttgcatgtctatgattcaaattattttgagagcaaagatatttaagcgatttgtgatcggagtgaataacaaattctttaggccacaaataatgacgccacgtctctaaggaacgtacaagagcatacaattccttatcatacgtggaataattcaaaacaggaccatgcaacttctcgctaaagtatgcaacaggcttaccatcttgcatcaacacacctccaatgccaactccactagcatcacattctaactcaaaagtcttaccaaagtttggaagttgtagcaatggtgcgtgtgtaagcttgtccttcaaagtgtcaaatgactgctcctgtgtctttccccaatggaagaccacccctttcttcgtcaactcgttcaatggtgcagcaaaaatactgaaatctttgacgaaacggcggtagaatcctgcaagaccaagaaagctcctcagctgtgtgatggtttggggaaccggccaactctttatggcttcaattttcgactcatccacctcaattccctgtggagtaactacatatccaagaaaagagactcgttccgtgcaaaagatgcagttttcaaggttagcaaacaaacgtgcatcgtgtagagcattaaaaacagcacgtaaatgatccatgtgttcatcgaaagacttgctataaatcaatatgtcatcaaagtacactaccacaaatcgtccaataaaaggccttaaaacctcattcattaagcgcatgaatgtactaggtgcattagtcaaaccaaaaggcattactaaccactcatacaaaccaaatttagttttaaaagctgttttccattcatctccaagtttcattctaatttggtgatagccactacgcaagtcaatctttgtgaaaattatagagccacacaattcatcaagcatgtcgtctgacctaggaataggatgacgatatcggatagtaatattattaatggctctataatcaacacacattcgccaagaaccatctttcttaggaaccaaaattacaggaactacacagggactaaggctttgacgtacataccagcggtccaaaaggtcttgaacttgccgctgaatttccttagtctcctctgggttggttcgataagcagcacggtttggcaatgatgctcctggaatcaaatcaatttgatgctctatccctctcatgggtggcaatcctaggggtatctcagctggaaagacatcctcatactcctgcaaaaggttagtaacaacaggaggcatcgaactagcaatatcatctaaagaaaccaaggcttgtttgcatatcaagaaataacacatatcatcatctgaaatttcagcaatttcacatttcgttgcaatcataacaccacccttcaacttaattccctcaaccttagaactaggtgaaagcttatcctttttaggtggaaaaacagatttagccacttgctgattttcagattcatcaagtttcaaactagcagctcgctctttatcagcttctacaatttcagcaggggtcaaaggtagcaaagtaattttcttcccattatgcacaaaagtgtatttattactcctaccatggtgtgtagcatcattatcatgttcccaaggacggcccaacaaaagtgaacaagcttgcataggaaccacatcgcaatcaacagaatctgcatatgagccaatggaaaacgaaaccctacaaacctgtgttacctttgctcttccggaatcgtttaaccactaaatatggtaagggtgtggatgtgtacgtgtagtcaagccaagcttcttgacaaaatcataactcaccaagttgttgcagctacctccatcaatgatcacacgtgcacgacggttgttgatgacgaaaaaaatctgaaacaaattatggcgttgcaacctgtcatgctgctgtacctgcgtgctgagcacccgctgcacaatgatggttctgtagtccgttgtgtcatcacgaccaaagatttcgccatcctcatcctcaacttcttcttcctcctcttcctcttccatgtcagaggtggtgatgtagccatcttctgtagcaacataggcccgttgactagggcaatctttctgcacatgcccaaacccttggcaacggtggcactgaatgcgtcctgtcgaggcgacatatgaggcactcttggcgggtacctgcgtggaacctttacctgactctgctggtcgtggtggtggaaatggttttggtgccgcagaagctccggatgcagctggtcgcttgcccgctggctgggaggacgcccgaaaagagacggccttgggcaatcccgcagatggcgtcgtgcgcggagtgtatgtgcttgccttgctcttgccctgatggtcgcgcccctgtaattccttctctgcaggcatagcaaaccgaaacaactggttgacagagttaaattccttacaatcaacaatgttatgaatttcctccctcaaaccagaataaaaacgacaaatagcatcctcgaccccctccactatgccacagcgtctcacacccttttgtagctcaccatagtaatcctgtacagatttatccccttgttccaaacgcatcagtttcttgcgtaaatctctatgataagatggaggaacaaacctatcgcgcatagctaccttaagttcttcccaagtagtaggtaggaccccctcatcagataacccagcccaccacataatagcaaaatccttgaactcactactggcttgtctaactctatgttgttcgggtacaaggtgggcattatacttttgttctactgtcatctcccaatcaaggtatttctcagcatcataatatcccgaaaaagatggtatttttaacttaaccttagcataaggatcatcgagcacacgattattattattaccttgttggtggcgagtgccacccatacctatgcggtttgtgcgtaggcgacgtcatagccgtccttgccttgtagccggtgcgtcaatatagccactggaatcatacaccgtgtcttcaggatgagcatcgtcgtcaccactcaccacttcctcattggaaggtgtctccaacgcggcgacccgatcagttagcgtggatatccgcttgtccaacctctccatgtggttcaagaagccgattttagtgaaggcatcttggacagactttgcaacggcctccgtgatgtccttttgagtattttgttggagagttcgtagttgctcttggctgacacagtcagcaaaatcctagggactcttctcaccttcgttacctgacattgaaacaccaaaacagaaacaaaacggtgaaggttatccctaataatctactacgcaggtgtagtggtgcctctgaacgattctcagcaatatggagttcctaaccaagctcttataaggttcttaccagcaaagcaaaggatacctggaaggcgtagtcagcgattgcagggatcaagaacctgtgatgtccagaagtaatatgtggagctcggaaggccaaatatatgtatatgagtggtacacaatccaatgacagatagtaatgctgaataaaaatcccaagttacttgcccttagttgctagtctactcgtgtcctagacagtagtggtaacaattatagctcaagaaaaaaacactagtaagcagcaaaggacttgcaggcaagcttcggtgagtttcagcaaaaactacaaaaccgaactagcagataagcttaacggagcgcgtcgtgagctcaatgcactagtggaaatcaacttttctttttttttcttttatttttttgatatatttttctttttctagaacacgaaaataggcacacctccaagttacagctcaatcggagtaggtatctggcctatggatttttctgaaaccactataaataaggtgcaggaacttgtgagctcgaacagacaattttgcaaaccaaatttcagaattttggatttgccaaagccgccgaaggtggggagaaacggatgtaaaatttttttctcttatccgaaaagttaaattttgctctgatgccacttgatatgcactagggttcccgatcttccgaaaagttctgataaacaacgatttggacagagtcgcgacacaaatcgatccggcttcttgaacacgcacgctcttgagccccgcaatcgcagcaccacgtctcatctggttatcatccgtgtcgaaacgcggatgacctcgccgaaaaggctaatccctgtttgccaatcgaagagcacaaacaagaacgagatagaaaaacaaccaaaattgcagttgaatgattaagctcacgagttgcggtcttacaaaccgatctagcggcgaaactgttctcgacagattaatctaagcaaaacccaaaaacctaaagatggcggcgggtactcatatatagagtttagggtcgtgcaaacccctctcgacgcaaccctaatgggttccaacacgatacacgggccaaaggcccaaatactgtgacgcagcacctggacagattctggacgtcaaattgtttggtcaattcccgttgattcggaaagaatttgtatgtgggaccaaaaccattggaaaggttatcttcttagctttccatcgatataaagaacatcccaatccaagcacgtatgcgacctggacgcccgttttagtgcagactggtcctggactccgaattgcacctgacgtcgacttggtttgggcctccaccttaacttggacgtccccgatgatactctatggctgtaagtccttctccaagtgtctccttgtcccctccattgttcctaatcacaatataatcattaggtagcaatctattctcgaattcatacaaagaagaacataggaacgagctcacctctaaatttaattgtcgcgcacgagctcttgttatcggtccttgaatgaccgttggaggattgttgtgtgtatccgaggtagtgatgtccgcatcacctccgccggatccagcgggaggcggctgcggttcggcagcggcggcggcaccctccccttccggtttggtttttttatttgtgttcttgtagtagtgttttgtctaggatttggataaaatttgtgtgtatatgtttcagttttccctctcctattcaatttgtatgatggaattccggatgggattttggttgtgtgtatatgtttcagttttccctgtccgattcaatttgtatgatggaattccggatgggattttgagggcggacgatggggggggggggcacggacgaggtgacgattggaaaaatacaaatcttttaattagttaagattagatataaaaggtacattttgtttcttttctgcatgcacctaacaaagtgtacccataaaaatttgctaactgttcgatgctctcatctaactatcgatgttgcgagttagattaacacaaggattagtgcttgaatcagcacttggattaactcggacaagggactgatccgggtcgggctcaatagtttcgagcgccataggcgaactcggcgctataggcccttaaagctaaattacttttgcttgtaatatactccctccatccctaatgtttgacgccgccgttgacttttttaaacatgtttgaccgttcgtcttattaaaaaaattaagtaattattattatttttctatcatttgattcattgttaaatatatttttatgtatacatatagttttacacatttcacaaaaatttttgaataagacgaatggtcaaacatgtttaaaaaagtcaacggcgtcaaacctttaggaaaggaagggagaaggctacggcttggacgtccgagaaaactcaaaagatcagacgccctacctgctgtaattctgagcagatagcaaaccatgcgctatgcaccatctctttcctactgtatacatgtacactctttagcaatttttgaaatgatttttctcctaacctatctatccgatctatgatctaattatatcattgtattcattgtaattaaatctttataacaagatctcacatgagtatattacgttgaaaaaaacatattgaacatttttatactataaatgaaataattgagttataagtactgaaacaacatacctatttactgaaacatcaaaagaacactattgcaacatttgcaaataaactagtgaaacatttgaaaaaacttattgaagcacctagataataggatgtgcagcatttaataatccatttcaacataaaactttaaatgtgcaacaaagtcgaattaaaaattgagacatttgtttctcacgcgtgaaacattcgattttaacggttgaaacatttgtatttttttatcgaaatatagtcatatggtcttgttaagaagatttaattgttatgaatacaatggtataatcagattacggaccggataaatagtttaagagaaaaggaaattttaatgtttcaaatggttattggttgttggctttggatgaaaaaataactattctattgtgtgagtcctttacacatacgtaacaaaaaaaaagtttgctgatgtatgcttctattgagtactactccatttctacttagttaaatgtgaggatcccgtccgatatattcttccgggtcggacatctgaaataaagcatttccggaaaggagagagtatattttataaagcacatgtcctataaagtgacacaaataaatatttttaacattataaatacaaatcaagcagttgcaaattgtaatataaagcagttgcaaattgtagtatagtaatttattactgataaataatatcaacattataattgagaataaaagaaacaccgtagaacaaagtagtacgaatgaggtgcacaaattttcttagaaccaatgaaaggaagtagcatgaactttttctcttttcttttctgagcaccgaacaaatgcatttttttgtgtaccttgtaagtttgtaacacctaaaataataaaattgcgaagtaaactaaagagcaagaacaaagaaaatcatgcaaataagaaaaatccttaattcgtaacctaattttcttagaaccaataaagaaaagaaataagaaggctaactgttgtgtcgtgccgctggctgtgcatatgctccactgctggttgctttgctttgctatgagatgggatcagtcgatcgccaggcggcaggcctcgtcggcgtcgacgtcgcgtcgcggtcagggagcggagccgagaggagaaaacggcgcagcagcagatagaagacgaagcgacgcgttgtgccatggattgaatcaccgcatcaccttctggcctcagtatatctgtcgtttggttcaagtaaaccctcagtatatctgtacgtctgcagaggattctcgaaggaactcccattaatttagactggatgcttttcaataaagttttaatcataaaaggttgtgtaaattcaaactaagaagtaacctagcatgattattttactttggtaaaacatgaaaactacttcgggtaactaaaaagtaaatttggttgagaagcatgggttgtgcaaacccaacagatttgctccgtagctgcacaagccatggcggatagggcactgagacttggtgtgttggtggtggtcatcacgtacgcggaccaactgcgagagattctcgtcttgtttcatctcgggaacatggcatggatgtggtaagaagtgagctgctgctgaatgcagtgtcgagagctctgatatcgctagttcagaatgattgcatggcaacttctctcttccccatgcctcttattccgagtagaactttatatgcaactcatatgatatgtttgtgcacaacaccaagagctagcatggaacaagattggctagctagtcgagaatgtatatataatctctgcagctaaaccgaccggatgatagcgatttataataaccagctaataacaaagtgaacattcacagggttcacctgatagtgtctgttttattagataatatacctgatagtgtctgtatgtataatatatctacgtgaaatcgttgtgaatggcacttgtgctcacttcagaccaatctgccagtatatataaacacacgatttctaggccactattaaaaaagatttttctatacgagggctccaatatataggttgtagacggaccgtaactaatcgcgtctgcaaaaatcgccttccattttcgcatgcggctccttaaggctgcctgcacggaagaggggggggggggttggggtttctggagagagaaggcacatggtggctaggaggagatgggaggcgcggcagagtggcgacagtcgcagaccacctaggctttttgtggcagcgagctcggcgagcagcggcagggattgcgcggacggatcgaagcgccacggcgggtgtcggtgagggatggagaggatgcacgacatggcaatggatggatggatgcgtgtggcggcggaaagagggcgtcggttttgagaatttgtggcggctgcggtgatttgggcgtgagggcggaggcagggagcgcggcggggatgtgcgatggattgaacacgatagagatgccagataccgccttatccgtgatttcaccgcatgatgaaatcgtgcggtagagatgggtggacggtagtacagattataccatatttgcaaatagtcggtagggattcaataagatgatttgacctataggattggatgggtgcaactccgtctttttatcttagtatagatatatatgtctttctctctacaatcattatgcttttatttatcttctaattaacaagtgtatgtgtatgtggtatgcttttttttcttttttgataaaacgacggcaggagctctgccggaatttcattagaggatagaaaaagttcaggaggtacagggggacacaaagaggagcaaaaggagaacagggaaaaaaacagactcatagatcaaagaacattagaacattgtaaaaactaattaagggggttgaaaggctgagcgtcgaaggtctaggtcctcctttacaatcctcacgatgaaatcctcagaggatgagatgttttggaaaatccttctgtttctttccgtccagaagttccaccaagtggtgagaagagttcctttaactttagattgtaaggatttggggtgtagctgatctaggtcgatccaccaagctgcaatgtcatctggaggttgggttccttggatattttgccattgacatatcgagctccaaactttcctgaagaaagaacacccattgaaaagatggttggtgtcttcaaaggcgatctccacacaaactgcaaatccaattgcaaggccaatggcggcgcaggaggttgcggcgcaggaggttttgagccgtgagagttttctgaagaaggattagccacccgaaaaaacgcatctttagttcagctggactcctccaaaccgaactgaaatcaatcggggagaaagagccttggaacttgaaaagattggcgctttttgatgagtaggaacccgattcattcagattccactttatgtcatcagtggtatgttgctgaagctgaacgttttgaagcatacctccaagctgaacgacttcattgatttcctctatcgacgttatattccggaaagagagaagccaagaattatttgtaagctccgttttgaccgatctctgcttgcgcttagctaggttgaaacacatgggtgcaatatcttttggacatgaactttgcagccacttgtcctgccaaaaagctgttttttcaccgttgccaagagagattgttgtggcagcttgaaaaagtctcatgtcacagttatcacagggtatgtccattccaatccatggcttattttcctctttccatttgaaccataaccatcgaagtcgcagagcgcgagggaatttctccaactccagtatcccaaggccgcctaaaaatttcggtttgcaaactgtactccaatttactaagctactccctgggtttgttttgctaggatcctcacctttccataaaaatgacctatggaaacgatctattctcttgattacccatttgggggcttgaagggcagatagatgaaaggtcggcattgcacttaaaactgattgcaccaggattctcctaccttcagatgtgaagtatcgacctttccaacctgggagacgcgatccaatcttttcaatgagcggtaagaagtccactttcctgagttttcgaaaatgcaaacgtaaaccaaaatagcggcaaggaaagttttttgaagttcctgggaactaagagatgacctgagccaagaccatgttatcacatcgaatggggtaaatttctgtcttattgagatttgtatggaggcctgatgctttggcaaagatgttgagaactaatttgacagtgtcaatctcttgaggactgggtttgacgaacaaagcgacatcatcagcgtagagcgagcatcgaaacatgctaaaacgccctccaattggagtgagctacgaggcctcttccgttgcttggaaaagtttatgaaggggctcgatagcaaggataaaaagcaaaggagataggggatctccttgccggagtctgatgaggacataactagctcggatataaccatgactaccttatgtattaatcaaataaaggtgcatatgttctacattagatttacttgttatatatttgaacaaacgttgctacacaatgagttttgtgtgttttcgtttgcagagatacttgcttgggcgaaggaaaagaaaccgagcataactaatgcatggatgattaaagaagttgattggggaccaaactaagaccttctccaagtctacttctacctcaccacgtcacttttggaccatagaagacaagacataaagttgtacacgttttggattcggattcgggcctcctgacagcatcaacttcaaacggacctagccgctgatatagaaggaatttcggggcccatgagtacttgttggaaagcttatggagtctactttcagatggttttggtcccatgtcaaaattcctgccgagctgccgggaatctgcaaaacaagccatgtatctcatccagtccgaatctgacttgggttttgggccttataattgtgttgtgggcttagcccaagggggtgtgcgccctagggcaaccctaggacgtccctaatcacatttattcagtagccgtcatcgtttagagtcgggttttgcttagattaatctgtcaagaacagtttcgccgctagatcagtttgtggaaccccaaattcgtgtgcttaatcattcatatgcaatttggctgcaatctatcttgttcttgcttgtgttcttcgattcacatgcagggattagccttctcagcgaggtcaaccgggtttcagcacggttgataaccagaggatacgtggtgctgcgattgcggggctcaagagcgtacgtgttcaagaagccggatcaatttgtgtcgctactccgcccaaatcgaatgtttatcaatacatatcggaagatcgggacctaactccctcatcagagtcctcgtgcgtgcggtaatgaagcacctggggatccatttagaagaatttgggaagaggaggttgcaaggaggtttgatacccagtttctccatctagtaccaaaaccatacctctggaggacttctaacaggtaaggccaacccactgtatcgaacgcttttgtgatgtgcacctttaggaaaagcgcttctttgtgatttctatgcagaatatgcactaaattctgcacgaagaggaaattgtcgtgaattgcccttttcctgacgaaagcactttggttttgagagactaattcatttagtcggggagcaagcctatttgcaagcaatttagtccagccgctccttcttttttttgggaggaggcagatgtaagctgtgttcaactttttaagttgatttgtatttagggccatgaacgattttgcagctagcagcagatcttctttgattatttcccaagcatgtttgaaaaaagctccaatgtaaccatccggtcctggggccttttctgacggcacggagaacacaggatgtttgagttcctcttctgtaatatcatcctcttgatcatctaggtcgaaagaagggaaatttagggtagcccaattgagacaggattgcctttgtgatggagtgccaagtctgtctgagaagaaacgaaaaagagtgtcagccttttcctgagccgaaactgctatgccattttgagtctggagagtttgaatgaaattctttcgccttcgggagttttctttgatatggaaaaattttgaattaacatcgccttcctttagccatgttagtcttgatcgttgacgaatttgaatcttgtttaggacagccaaacctaggattctagcttttaggttgctgcgaagaacacattcatcatccgataagggccttgtttcctgtgcaacatccagttgaaaaacaacctcatttgccactgctaactgaagcttgatgtctccaacattttgccgattccatctcttgaggtctcgagctagccgttttagtttgatgtacaggatggcaagcggatttgcagctaggagagggcggttccaagaatcttcaacaacttctaaaaaccctggaatttttaaccagaaagcttcaaatctggaatttgggggtttacccctcatttcatttcctattaaaaagagtgccgcatgatccgaggtcgacgaagagagaggttgcaaagaggcgtttgaaaacatgatatcccagtcaggtatgacaaaggcacggtcaatttttgtttgagttgggttttggcccgctcctgcccaggtgaagcgccggcctgggagatgaagttcttttacctcaatcttgtcaattagccctttgaaacgctgcatcattctcctatttaggcgatcattatttttgtcagaaactttataaattagattgaagtctccaattagaagccaagccggcttcataaacgaggacatggcttcaatttctgctaggaaggctattttgtcagcttccaattgagggctgtataccaccgttattgaccattggaggccctcctcaaacattgtgattgttgctgacagagaaaattgtccctgtacagcttctgacaaagaaaaaaggtttgcattgcaggcaagaataatcccacctctagttccactggccggcaggaaagcataagattggacaaagttttgacctaggatacttaagatgtttctgtcagtaactgttgctaatttggtttcttgcaaacacacaatagaagcaccaactttatgaacaaaggctttaactacatcttgtttggcctgggcatttagccctctcacattccagttgaacaggtgtacattgtgttgagacataatgaaaacaagaagacaactagcattgacattatgggcagcgcgcagtgtacaaaccacaccgaaacacaaccagccatgctgggagaaacacaggtgcgacaattgtacacaactgtggcagctactgccaccaaaagaacttgacagccaaacaactggaactgctgaagtggaggacgaccgctggtacttgtggtcattgctgcgaggtgatacatagccacactcatcacctcatcatgtcttcttggaggaggggacatcacattggcaccaccgccgccttcttcttggcagtcttcaggtgaatgccttcgcatccacccttctcgaccaaggttgtgataatcttcatcgaggcaggggatataggcttcttgaaatgctgcacataaagtttttcgatgttttcatcaaaacgagtttgatcgtttaaaaagccaaagttttttgcaagaatttcttgtgcgaaatgttcaatcttggtcccgaatctgcgcttgcgtgctaggcgttcactatgcctttgaggggagtgaagggtcaccttattgcggcaagggcgacgggagctcacatcaggagtaggaaggatcgccggctggatgggagttgagaggcttgccgcgaactcctggaggttcttggcagcgcctaggaccccgtcagcagcgccagaacccagctgggtactggaagggatgaagacgggggaggcgatccttggcgatgaggtgtctggtgagtacagagaatgctggattgtggcctcatggagcatggggtcaagatgcttctccagcaactccagcacagcgacctgtccctgcgaaaaaatcaccggttcaggctgtacaaccaaggatgaggatggagaaaaaagagtggccaaggcatttgccccctcatcagggctgccgctgcggcgtggaattgcgctcttgcaaggcgaagggacttgtggagacgactgaatgcggggggatcttgtacctcttctagacagccgggggcggtcgtactgcacttggcgagcgagaacggtaggagcagctgctgccagcggagggcgctcgaacatgctggcgtccgcacgtgtcttggttgtaaacttgttgatctcttccacagacacggctacgactttacgaccgtccacagacacggctccaaagggaacggctcctacgctacccctgggagcgctgctctctgtcttcgtcttcatcatctggacctcttttgggatcaggctcccttctacaaggaaggggaaactcccgaaaacggacaccatcagtctctgcgccgtactgccagtcgtacgcgcgggccaccttgctgtgaaggtcttctagggtgtcgatgtgaacgaggatgtcgtaggtccacccttcctttggctcgtcaggcggagggttgtggtgaggttcaaggtctagaagagaaatgtctgtggggagcccttcttcatcagcattagtgatagagaaagtggaggaacgcgggatgaactttggtgcgtcagtccaaatccaaatgtcgaaggtgcggttgtagttctggcggcgagagtactcttcgacatagttgatggagcactttcttccaatgatcttggctgccgtttcttctgttcgagcatgcattgggatcccctcaatgcacactcttgctctgtatctgaagcgcgccggaacgccgtgaaggccttcctcccacgggcagaagagataaaccctccccgacttggtggcaagccggggctgcctcaggatggcatctctatcattctggctggaacaggtgatgaagaagtcttcggggtggaacttcgtaatttgaatgtctgagcgtctgatgcggaaggccgaatgaacatcatctgcaaacacattgggatccacattggagccctgatggccaacctgccaggcaacaatagagcgagcagagaatttctgcctcagtcgctcaatctcccccgtggccgaaataaccacaggctcttgagagggacgagcagagaggtcatccatggaggaaggggaggaaagagcagatcgcgggagcaacttaggggggaaacgaattggggcgagaggagggaaagattcaacggaggtttgggggagcggctgcgaggtagctgtggatttaaaggattttctctttaggcacgaggaagcacaatgaccaatgcccatacagaaccagcagcgaaggggctctctgcattcaataactcgatgatctgaccgaagacaacgaaagcatttaccttccatatgcttgaggaacctcgctcggcttaactgcaattgaaattggttggtgctatcgggagagtgagcagggctcctcctccatcgatttgctttgacttcttgccactctgaaccagagacatcaaggctacctctcggatgctgcactgcagaaaggatttgagctggcatctgaaccttgcgtccactcttgaggatacgaagatctttgggagctgctccttgggaacccacatctggatccgtcaggttgactgggttaaggcgctcagtgacggaagagcagggttgcgctgcagggaagttaaggcggccggcgagggaccggattttgggcggagacagctcctgttgggacttggaactagcagctaggggtatgggagcaggagcggccaggacctcagagtaaaggcggagtgctccaagcggcgctgtggctggcagatcttggagcgtggaggatttgctgggatcttgaggacgcagtgtgacgaaccttgagtccaatcgaggggaaagacaaatcgaagctgcagtagaggaatcaatgccggagatttgaatggtttctggtggatctgggtgggtggagaaaggggattttggcgagggggtttgggctgagagaggagggttgtggcggggaaccgggatggggaaggtttcgagggttggggatgctagcgaggcttggaagacgccgacgagatgctccggcgaggagcgaaatcgcctatggcgggggtgggtgtcggggctgagggaaggggacggagccatggggtttggtctaaaatgaaaaccatgtggtatgctttggatattcgtgtttacgctacattccaatattagttgtgtcacgtccttatggtcttgcttcatgcatatcagataaatttatgcaccaaagcaagtgttttataagttcaagcactatattgcagttaaatggcaagtccatgtaatgctaatgcaatttactccctaagtaaatatacattaagagttagctagttaaaaaacatcaattagtagttctagtcgtgtatgcagtactgtagtgtctacatgctcttttcccatcactagtttgctttgtctttggattgtggtttgagttgggttctccgaaaaagcgcagtggactgatagctggtttccccagcaaaaactatgcatgcaacatattgctttccataaaaaagcagggctgccctggcatttttaagtacagccatccatggcacacacctgattgtcccttgacaagagaggattctcataggaacttaattgatagcaagtggatatgtttatttcctaataatatatgaagtatattcttatacaaatatgaaacttttaatgaagaaagattgtacaaattaatcaaactaagaaatatcctatagctacatttactaattcacaatccacgaaaacttcgagtaattcaattatttgttattatttgcactacatgtttgctttcactgttttaaaaaaataggtgatcattcacccttctgattgactccatcttaattttatagcctctctttcagtctcttatgctttcgcagccttgccaacaatttccctaccggacaacatcagggaaccctggtcatcttggataatcaccccgaatgtaaatgcactttgtaactgcaggtaataccacgagagattaaagtgagtagttctcagcttattccattctactctcttcgtcccacaaaaaaccaatctaggattggatgggacattttccactacaacgaatctggacaggagcgtgtccagattcgttggactagggaatgtctcatccaatactagattagttttttatgggacgaaaagagtagattggaacatggcatccatagcagacaaaccgctggattccaaaaaatcaatgtaacaaaatagagaaaagaaatcacaggaaatggttgcactgtgggagtttaatcagtctcatgtgggcaatttggaagagacatagaaacagagattgctaattaagaatgatcttctatcaaaccaagctgatctaattcattacatttgttcttggatttcttcatggtcaatattgcagagctcacaggaaaaaaaaaagagaacagaatccaccactggaagtatggcttgaagaggagatggagaagtttgcagggaggaagagaatgaaatatacgctgtattttgctccaatttgttggccctgctacgtactggtggttctacctggatggtgattctggcatctaatggctaggtgcagcgttgttgctggggacttgaaattgaacaacaaagagaaccttgcaggtaggttaagcagtacaggattccagagggaaaacttcacacgaacttctttcttcctgatgtcactcattctgaacaagtttacgcaagtgatcttggggaatctcaaaagcatgactaaaagattaattggcttgttaagaaataatatagcggtaatatatctagctagaaagctatgcatagtaatttttttattgatatacatatgttagatgagaaagacgaggtggaataacgagagaataggtgtctcatgtgttcaacttataatagttgaatgcatgatcgaacaggtgtataattaatacggccgaaatgagtagagtgctgcaaggattgcagcatacaaatgtgtgcatttatgtgcaacaattttcatttggagctgaatttcttgaaactcttgcgcggcactcgggactcgggaggtaagcatgtttttgagaaaaaaaaaacaggtcgaatgaaaatgtggtctttcttattatcatagaaaagaatactagctcttcaataccccctcatggaaagtactgttagatagtcccgtgatttctcttgataaactaatgtgcataaaagatgaaaaatatattaatagtagtatttttggcatggcaaatctaccaacaccattttcacaaatcgctctaatcatttgagctacggctgataagcaaaaaaataaatgaacgaaaagaaaattattggtaaagcttttattctgtatttttgaggtttataaacgccatggtacgtagaaaaacgactacataaaaaaacctgctaaaatcaacacagaaatgatgtttctaagtttattttttttgctacggatgacaagctaacaaatacagtacttggtctatattttctaggcttacatgttcttcttaaggcactagaagcagtccatctattcgtccgaaacaatcaagtattacatgtgtatctcggcattcgagcttctgaatatatgatgagacatatattgcatttttctggttttggatatgtatcacggcatgctggcttgaggaggctgtcgtgtgattctccagagaaactagcattgacatgctccctgattccactcattcctagcaagttaacaattcaaaatagggaggaaaagcagatgcatgttagaacagacaaaagattatatgaggaaaaatgaggggtgggatatttaattacagagcatcagtagtatagggtacacaaaagtagtatggtacttgacccaatctaagctaaagagccctgataggaaattatttcggtcacaaattaaattatttttggatcaagtaatttttcttcagattgaaccaaaatatgttcaaatttcaacgttttgattaccacgatatagaacttgcctcttgtagtaatatcattagaataggattatatggaaaagggtttactaaggtcaatggttcagtgtattgatatccatggtgagttacatgaagtaaatccattgtgacccaaaattaaattaaatatccattgtgagtaacttaaagtaaaaaaaaaaaacatgcaggacatcccaatatcattgtttgcagaggattctccaaggaactccatatgttcaaatttagcctggatgcgtgtcaagataattttaatcataaaaggttgtgtgaattcaaactaagaattaaccaggcatgattattcacttactttcacaatacatgaaaactactccgagtaactaaaaaaaaagaaaaatggtcgaaaaacatgggtttgggcaaacccagtatatttcctctgttttctgccaaagccagaaatgaacatatgacaactgaacttgagatggatgctactgatcgagacgggtggtggtcatcacgtacggttacactgatcagccagacacatttccgtcttgtttcatctcaggaacatggtatggatgtggtcaggagtgagctgcagaatgtaggtgctctgtgctccgtattttttttttcttttttgccgtgggaaaggaatttcatttctggacacatgacaaattacaatcgttcaggatatctggattagacctgacacaaaattaaaaacaaagccataccagaagccaaataaataaatcttgacttctagctgtcctaagctagttcatgactaatcccgatttggtcccgctgagtcttcactatcttcacggtctggattctcctttcgcctgaacgaagcaactttgcttatttgataagacagggaagctctgagccatccacgtctatctcattaatcaggtgcctaatagcagccaggggcgacgctagagtcacttatcggggtcagtagaccccgacgattttttgcaaacatcttgtaccagcactaatttaccagctacgaccccagtcaaggaaactactagaccccggtggtccggtgatattgttctggtcaagctcaattagcaactaaacaatactaacaagtagtaaatagaaaattagctagcacttattatacaacagcccaatatacgtatgagatttgagcccagaaggctttgtattcctgctaaacaagtccacaaattgccttgttgtgctgctctgtattcctgctgcagtgcagtctggctcgaagcgcttcgcccaatcttcgccgattggcaagggtaacccactaaccccatcacaatttcttaattattatcatcacaaattggttgtaggctggtttctcaagtccaaaattttaggaaggtagggttctgaaatatgaaatttctccaaatttctgttacataaacataaatttattctttctagaaaagtggaaggtaagaaattagtgattttgatcatctacagcagcgtgggtattttgttttacatattaatcattccattttttaataaattaataggcaagcaaagtataatggagtgtgattcttgagaagaaaaatacccacttactagttcatgtggtactaattctcctttatcattggagataaccttctcggtaataaaagttgtgtagacaatactgcacgcaatcgtatcggtaataaatatatggattactccttgcgttttaaaatatactacagttccaaatgatgacgacgtggttgttcgttttcacaagatgaaggatcgtaactgtacacatgagaagtttgtaacatgtaaaacataaccactttactaaaaaaactttattttatcatattatatggtcgatagttttgttctaggattatcttaagattattataagctatagtcagttagtggtggccccgataactatttttcctggcttcgcccctgatagcagcacattctgtgatcggatttggctggtgcagaatgaagatttggcaatgtctctcttccccatgccactcattccgagtagaacttcgtattcaagtgatataatgttggtggaaaacgccaagagctagcaaatcaagaatgtatatatataatctgcagctaatcctaccggtcaagaagaactgaacattcatatattcacccgagggagtctgtatgtatatatctaggtgaaatcgtcatgaatggcgcttctcttcacttcagaccaatcttccagtatatatacacacagacgattgcttggtgtattataattacacaagaacccatacacatataagaaaacacaaataaacttttatctgtaatagcactgctcagacagattgtacaaatttgtaggtgagaaatatgaaagtcaatagttaagaggcacctaacccaactaacaggcaaaaagtcaggtgaatattacatggcccagcagctatatatgtgagagcgcgatagacttatggggggtggtggcagagaggttcgggtaacacttacagccaaaaactcgaaggtgtgtatagaatgggtgagttccatagagggcaaaaaacggggtgtggtgatgaaggattttggtgggaataccggttattgaaatgcgtgccagggtggagggcctcaaccaaaatgaagggagtagggtggcatgaaacaacaaagagcgaacttcgttgttgagagaacatagcgtgcgctcggccttagcattctgaggggaggtgtgagggcacgacattcgtagagagacgccgttggtgatcggaaaaaggtgcgaccgttggatttgtcaaactcacgaccgttgtcacactgaatgctccgaatgctagctgcaaatagagtcttcacaaaggcaaaaaaaccgtgataaattggcaaaggtgtcgggtttaaaacaaagcggaaaggtccatacataatgtgagaaatcatctaaaatgaccaaatagtatttaaaaccagacacactaggtataggggatgtccacaaatcacaatgaagaagctcaaagctggtcgtagccctagtaaaactgctagtaaaaggaagatgagtgtgactcctaagttggcaagcatgacataatgggtagcactcttcggaggaggaatgacggacgcctgagctaagcgagagagagcttcatgaccaagatgtccaagtcggtgatgccagaggttggtgtcgatggtggaagcaacaaaaggctggacggaggtggttgagggtagagagtccgccaatagggggtacaggtcactggaactattgcacctagcgatctcgatcctggtttggtaatccttcacagagaggcaaaaagattcaaggcaaatagaacaccaattatcacgagcaaaccggcgtgcatatattatgtcttcaataatggaaagagacaagagaatatcgttaagaacaaaggagcgatgcgagtaatgcaagtaagttgtgccagcggaggtaatgggaataagtgatccgttgccagcaacaatgtgtgaaggaaaattgggggcggggcggggggggagcatgagacgcactaaggataccggtattagaagtcatgtgggaagatgcacctgaatccatgtaccactcgttggttgtcaggggcatcaacgtggaggtgctgaaggagctcgcgagtgcctgcgggtcccactgggaggggccagcccaagcatgtggagatggcgtagccgtcggggagggagcggcgctagcccggcgtgctgaggagctccatgggccgcggtgttggcgacatagacaggcggcccaacgactcccgcgaaaggaggccggccgaatatgcctggaccgtgggcctggcctggccacatttgtgttgtgccgacccacgggttgtagggcgtcggccactgatgggcaaacacgaggggggtggactggtccggctaggtgacgtgctgtctgccgccacctctgctattgccgccgttgccaccgccgcgtttgcgacgacgattgtgggagttgccaccggagccgccgccgccttgggagttgttgccggtgcgggcgctggtggtggtgttgcctgaggttgcagtggccacaacaaaggcagtggtagaatcggtggccggccggtgtccctttgtgatctcctccaacaacagctgcgacctggcttggatgaagctagggaagggatgctgcataggaagaagaaattgcatgaccatatttagtgctaaggccattgatgagcatgcggtcggactgcggttcgccgaggtcagcgaggttgtccgccatagtattgagccgacgacaatactcgaaaatggagatatcgccttgcgtgaatccatggaactcggtggagaggttgatggcacgaagctcacaattttcaagaatttggaactccaaatcatgccaaatggagcgggtggtggcagtgggcgacatcacctcctgaagcaggtcgtgggagatggtgcgccagccgaggacgacacagtccatctgtgcccaatcggcatgattaggaagaggagcgtcatacaagacgtggtccgtcaaggcatatttgccaagaaccacgaggaagagaccgcggcagcgtgcatagttaccggtggcgaggtccaatgtcacggggatgagggccttgacattgagcatggcaaccgcttgagcgtggagggcggcatgggtgtcggcatccagaggaggtgccgaagccggggcgcggcgccagaaggtgggggtgcggcgggtgcaccagacgcgccggaggccgggatggcgagctaggcaaaaagcgccagtagttttggtggcaaggcaccgcagggcgtggtcgggagcggcggtgtggaccacgacgacgagtggatctcctcggcaggagaagcagaggctggccgcgggaggtgcttaacgagggcatcgcagacggcgaaggatgccttagtggccactgattcggcaactgactgcgtcgaggagtcgtcgatctgaagacccagcgacggttgatagttggcacgcacagcatcggcgacgatgttcgcgatggtagtgatgaggtcgtagtgcgaggaagaagacgacgtcgacatggcgacgaggcgctgcgcacagagaggagagggtttagggtagagagcggaagcggtagaacaaggaatttgataccatgagagtgcgatagactcgcaattgattggattgatatcggtgcggagtacatataggcgcgaggctttcgttatccacttaactggattatagaaacaaaacatgtacaagataatatttttctaacaatatgtaccctatgacccagcaacatgactcggagttcatctggtagcgtgctattcatcacggtaagaaagcaatgtatgatatagctagttactccgtgggaattggtatattttcctaaaaaaaaggtgatcaaatcaaatcagcatcggtcaaaccattttgtgatatctcactttcatacatgctcgttggtgtttgggacatataactgttttggaatcaatgccgtttgcccttaatctgtttttctatgatatatgttttatgtctgcaggacactatccccactactggggaaagcctctttgctaatggtttgcaacccttttagtcccgggttgcaaaccaggaccccgaatccggaattaaagataaatatctttagttccggttgaaataatcaggactaaagatacactaaagtttttttttctttagttgttatcaaccgggactaaagacgctaccatctttagtccatctttagtctggacaaaagttttttttcttttttttagtattttttgcttgcttgcatgttgatttccccaaatcaaagattcacagataatatcacaggttcacatcacagatcaaatacatcataaattctcaaaaataaatatattacaaaccacatattcacataccatcatccattcatccaagaacacattaatcatcaacatcacccatgagatctcatccacgaacacaatcatgaaatcaaaatcacaaattatgtacacaatcgcctcatgaacaaaatcacaaatccatgagtagcaacatctgctccgccatcaccacgaccgcctgccccttcgcctcatcctcttcgccactcctcttgttccgagccgccgcggcccggatccagccggattcgcccgcggccgctgctggagatgccgccaccaaatccgctgcaggagggagcgagggggagaggagggggagaggaggagggggcgagcgttgccggtgagggaggcggggggagaggatgagggggcggagggagccgccaccggcgacggaggcgaagggagcagagggagaggagggggctagggaggcgagaggggagaggaggagggggcaaagggagctgcctacgagggtgaggagatatggcggagggaggggacgggcgagagcgagagagagggagggagtttcacgtgtgcgcctgaggagataaggactagggaggggtaacatgcggctgcatttttcttttcaatctttcgtcctggttggtataaacaaaccgggactaaagtgttaatctttagtcttggttgctagcaccaaccaggactaaagataatgggccctgacacggcctgacgactttttaaaccggtactaaaaatgatccttagtcctagttcctatttgaaagtttttgcaccacctagcaaagattagttttccagtagtgtcctgtcaaaagttcactagatagaacctccctgatgttatgtgaaccttttcgttggtttttcaaaagccttataccatgatattctgataaatgaaatgagcaaaggaccatgagccacacgttgaaacttgaagttgaacagttcataaggataaaaaagcaagtgtaatacatatttacgcacaggaacacttcgtaatattaaaagagtacctagtgttaaaataacacagtacaaaatgtaaattcaacatatataaatggtattagtcacttctcaggtacatatattcaggtaaaatatatgtacctgataaattcaacatatataaatggtattagtcactcgtatttaatattcggattttacagttaatatatacccgccaaggataaaaattattaaagagagtaccagacaagaggtagttgtgtggttctatttgacattcagtgtattattcgagaattggtttggaaagccttgctagtaatgcactcaaatcgacattgagattgggacatagccacccaacgattagaccgaccgagggattggaagatctggaactttcctttggccaactacaagcagttgatcaatttcaccatttctttcattcccttttctttttttcttgagtttatgcacgagttgatgccattgctttatttaaaatcagaagcaccaatcatgcatgtaggtatactgttagagtggtggactagcagagatttattaggcatggctcgtatgtatttctcctaaattataagatcttgtccggttagtcaaacaaggcctaagatggaaaaatcaccaacttctatatggaagtgttcagagacgagaacactaatcggagccatcctttcgctcattcgcggaataagcgaaacgacatatttataaacgaaaagcaatttgtgaataaaacttttatatacatgttcttagcgatctaaaaacaaaaacataagcatttaagattgaaatttaagattgaaaatttaagattgaaaatttaaattttagctaataagcataagcagcgaaaagatgagccccatagcactgactgcgtcgacgtttcccatgcgcatggctcgttggccaagaattgcttgtggaatttgtgctgccaaaaacaaaagatgacaatgtcatcttgtggggagaaaaacttgaggaaattacgtgccgaaagcgttcctggtgcttcgcattcccatcaaaatagctcgtaaaatggaattttgtgtttgttttttattaattgggctataaactctatggctgaatagaaatgatatggtttttgacaaatcaccatcaaagtcttatgtggagatatttttcagggcaacgcattggcaccagccatgttgggctccactagtccactacaatggtgtaatgacaatataaagctaataaatgatggatgccgtaaggttaagtcaatggtcatgcagattttctccaattttgggtggagattcacaaataggattcaacggttgtgggatacaaaatcataaaaaatatgatgtgaatgatttacaatggggataattttattttaatatttgaggtttaaagttctttttaattcccgttgcaacgcacaagcattcagctattcaaataaaatcaatagagatcaaccactgcacagttatgcgtgttttcttattataaacatttctattaatctttcaatatatagaacctagacatgagggatggatttcgttgcgcttaaaaaaataaaaaatctgtcaaattataccacttcttgcacaccgcagagcaattctctggcttctatggctagagttagactctctgtttggattgattattgggacagtgaaattgaccatttgattgtactccaaacctaacttattgtttactttaagagaaagaacggcgttttatccttttccatgtcatcactcaggagaccacatgatgtgatcgcagcatgttagataggatgactggatgagttggttactaaaagcaaatgcctcactaattaaagagtcatctttccactactatgctgccaacatgatttggtccataggcaggcatagtacgaatctttcaccttttgaaagtggggagagtcctggtgccttttgataatcagtatcaatggttggatcaaagatggacgtaggagattcatcttttcagagataaactttcagctttcgatctgatccatcggttccttaggtctagcggctgagatgatggagcagtggcaagttgctgaaccaatattggtaccattgcacatattagtaaggcgaagacttgaccacattgtagcatcatcctttttgggtccttagctcagaagcaaggatagctttccatgattccatcactcattaatagctaggtacaaggagaagatggcaaactagagggatcaggagtagcaccagatcacatagaaggtgaggttccatggggaacatcctcaagtgcttcatcagttgcttcgacggagaagacgaagatggtggtagtggccatggtcgcttccccaacagctatcctccggtctcaagtctccattaccagcctctgcatttggatgaccttcaagtgccattatcgcctccaccaccatcaactaggcagcagcagccgccaccgcgaccggcgctctcaagactccattaccagcctctacgtttggctgaccttcaagtgccattatcacctccaccaccatcaactaggcagcagcagctgccaccgcgaccggcacgtcctcttggttaccatcatggagtcctctggccgacgatagagatcaccccatgcgatgacttcctcaacttagaattcacaactaaggtaatttaattataactcgttataacataaatgtttatcaatatacactacggtttggcacctaagaactctgatacttcaaattttgagaaacctatagtaaaacaacctaacatgtggcccattacacatacaaattttcgctgtaccaactgaactaattaaccatgtgttgctaattacagggttgtcacccgatgactttggagtgcatagttttatttagcaagtcataaagtttgacacataaatttttatttataactaaaaattatattcctcaaaataaatagctatcgtagtattctaaaccaatatactagtggaattttcattttatttaattactattgaacgactaaaaggttttcatagtaatgcagtaaaagaagctttaaattgccacttttacctgtgcataaaaggaataaaacgattgtgttgaacctactggtgaagtcataggcagtgtttggcaaatgtctaatggaaattatttcccacccatctttaaatcctaaccattcattctcccctatccatttaatcctaacccttcattcatttcccaatcccaatcccacccctcatttcccattatccaaacacacccatacagtatacgtcacttcagccttttaaaagttttgccctttttattccatacctttgagaattttcttctccccctttgtgaaccttatcttcttattttttttcttttcttttgggatatatttggttagggtatccacaatgtgaccaaaaagtagtccttataactctatatgggtacctttaccattgtgagaggtggcattaggaatagccatatgataagctacccatagctataaagaccacctgtatagattaaaatatactatctctctccttttgcttctttcatgtgagagaactatagcatttggaagtactttttttagtgtgggtcccatcttaatgtcaattgctatctatacacattgtgaaaataggaataacaaaagaccatttatgtgggtcccacctatatggactagttgatccatatacattgttgatgccctggttgaagatggtacggaaggggctgtacttttttcttcttttcatattttcttcttttcataatttttcatacttttttcttctttgtactatgtgccggtacctatgtgtcggtaccttcatagaaggaagatatcggaagataatatcataaattatattaccttttggcaatcttttcaaatgcatattttcgcaagatagggtatttccagcccttaattactcagggaagaaattgtgaaaacaacatagctctttgtttgcatagtggtaaaacatgccccaaagatatgtgatatctatatgttcaacaaatatcaaatgcacatcccactgtcattaagatacatgttggacaataacagaggatacatgagtggtgagtatcagaccaattaatgttaaatttcagaacatatgaacaaagtgtatcaagaattgcctaaggccgtgtttttttgcttattcaccggactatttttttaatgtttcaaaaatacgtttttttctaaaaacatttttcttctatattatttataccaattatttaagctatatggtaaatttacttttaaaaatatttaatttatcactatcaagcacataatgcgcagcaataatccacttaatagaccaactcaatttgggcttaagtaattaacagatcatctagtaaaagaaattatgaggtacgacttttttatgttgttgaagatacttcattttaaatatgatactgttgatttttggacacagcgtttattaaaaaactattctctctgtttcatattataagtccttttaacttttttcaaagtcatttatagagaaacgtaacaatattttcgacacaaaataaacatactattataatataatcaatattagatttaatgaaactattttgatgttgtaaatgctactatatctatcaatttcatcaaacttagtgtagtttgacttagaaaaagtcaaaacggcttgtaatatgaaacaaaggcagaatgtaaatattgtagttactttatttaccattaaaggtattataacaataactttgcatatttgcactaaaattatgaataaggtggctgacatatccaaatgtaatcatcgtcatgtattgagaaatagagggagtaaaactttatccataacttcttattataactttttgttataaaagttagaactactatagcacacccagtacattatataccttatacaacagaccagaacaaagtgagagtgatatatttacttgatatgtgtattcatgtactgggtacgtaaattaatctgctagtagggcgtgtgatacgttataccatgcccactgcttgtgttttagaaggacctttatgaaaatttatataatctaatagatttatgatattatgaaagtatttttcatgacaaattatacattccaattttaatcttttcaaactatgtaatttattatttatttatagtaccttttttaaaaaattaaaaaaaagtcaaatgcaacattcttgaccagacagcgtatttgttctaacaaagggcatcgataagaaatcaatcccaaacacatatactcagtctccaatttgactgagttcaaccatttcttccatatcaagtataaagttgattgatctacccacacatacaaaagaattgccaaaaaaacacataaaattaggtatctgttcaactattcaatgacagcatgcacacaagcgcacatgccccgcgagttggttactttctcttgaattgcagtaagtttaaataatacaaacactaaattattgagtataaaatctctatcttggggcatttgtaacacaattctaggttttataatttggttgatggaagcccagtttcatttcaaaacaagattactttttgtctatgtgatatctttgcctatagtatttctatatagcatatacttatagaaaatattggcaggtttgtgaagggccccagcatcacagtacaccatccaggaagacggaccttaataggtaggcatcagatcctaacatctttttttgtttgattattttttcaaaagctgaaacattggtgacacatacatatatagtaatacgtatctgagttgttttctaattgtttgagaaacaagccatccaacaatatttgttttgtagatctaaggccctattctaacttcataaatatacatatttttcctcgttttccgttagcccgtttttcaaactgctaaataacatattatatgcgaaaactttctatacagaaattgctttaaaatattggataaatccattatcaagtttgtaataattattaaaacttaattaatcgcgcgttaatagttttctcattttgtgtaccgcttttaagtatatctcaccaagctacatagccgatgaggcagcctttcagtggtggttgttgcccctctcttttttttttgacgtgaaacagcaggaggagaggctcctactgcgctctatatatatatatatatatatatatatgacactcatatggggcaccatggtgcccgggcaccatggtatctaatgtacanaatcactcaaattttcaaaattttcaaattgggagtatatacctagttataataattcaattcatatctatacctatcaacaaaacaactcaaaattaactttatttcacaatccatgaatacctacctaactaattatatgtatggatgctatatatctagaatcaaaatctaacaaaaacaagttcaaattcagtacaaacatgctttgaactagttaggggagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatatatatatatatatatatatatatatatattaa

SEQ ID NO: 67395 - DNA, 517 bp, Oryza sativa
cacacccccccttctcctctcagatccgcgtcgcggcggccccaaatcccacacgcgcacagcgcagcaccaacgccggaaggagacagcgcccctcgcccccgccaccccaaccctacgagagggagggagccagccagccagccagccaggcatggccacctccacttccactggccaccgcgccgccgacctcgtcctcccctcctaccccgaggcacgctctctttctaaaccctagctgttcctggccagatgcccagatctgtggcggaattgaccgggtttcttgggttgtcttctccttctctttgctgcagatgatcgtggaggcgatcgcgtcgctggcggaggagaacgggtctagccaggccgccatcgcgcgccgcatcgaggcggcccgcggcggcggcggcctcctcccgccgtcgcaccccgcgctcgtcgcggcgcacctctcccggatgtcagccgccggggagctcgtcgccgtcgcgggtgggaagtacgcgctccg

SEQ ID NO: 67396 - DNA, 539 bp, Oryza sativa
gtcgtcggagtacgtcgggtatatatcgcgtgatacctggcacgtgatacctacctgataggtatcacttgacacctggtaggtgtcacctgatacatcgcaagtatcaccttctatgtggtaagaatcacatgatacctgataggtatcacctgatacctcgcaagtatcacctgaaacgtggtaaaatcgcctgatatctgatagttatcacccgataccgaacctgatgttaggtatcatcccgttcgaaaacgagatttcattatatagcatccctcttacatctacttcctccgtccaaaaaaaaaagctaacctaggagaggacctggatagacctttatccagatttgttgtactagaaagggcacatcggcagagggagtatagtagtagtatctcgctgtagctcgcattaataaaggagattcttacgaccgtataaaagagaatttgttggtacatttgggataaacgacacaatcgccggggactcaaaagttgctgacatttgggatgaaccttcatatatatgac

SEQ ID NO: 67397 - DNA, 727 bp, Oryza sativa
ggagacaagaagaagaaggaagagaaaggtgcagcttaactgatggctaactgaatcttcttcacttcccatctgaattttcatcgaattcatcagctcggatgattggtttaatttaattcgttttcaagacaaaagttattttcagatgcaaggattaattaattaagctagcttgcctctttcaatatttgaaagttcatattgtttcagtattaacatgtgagtggtttttgcgtggaaatattgatatgatgctgctgcagttctgcccaccgtgctggacgtcaccgttgagacgccggactacacgcagctgacgctcaaggtgagcgccggggcgcgtattatctccgtcttctcgcatggatattttcgcgtaattaattaattaatatggaccacccagtattctgaccagtgaccactgtaactgaatatgtactgttccttctattcgatggccttaattgtgcttgcatgttaaacgacaaaattaagtaaattcttctctagctttcacttgcaacactttcatcttgttttttttaaaaaaaaagaaaaaaaaactttgtttaaagcgaaagtgcctaccacttttctcttagaaactcctatatttatttttttcaattgcacagaaaacgtgttttacttgggctaattagcaatggcgagcgaccgagcatagccgcacttaacaaagctggcaagaatgaccccactc

SEQ ID NO: 67398 - DNA, 698 bp, Oryza sativa
gtagctagataagagtttgccaatagttgttcaaaatctcatgctaatttgactatatattcattagattagactgcaactcatatatatgaaaactacagttaattaatttatcatagcacgcacgtaaccatcaatatggccaatgtcataaaaaaatgcaatatgacactcatttgcacctgtataattctccaagcgttctgcaattgggtgttggtgtgcaggtaagggtttgtagtgggaagccggtgaccatcgtggcctccaaagctggattctatccagcagggaagcgagcgctcatcagccactcccttgttgggctgttgcagcagacgagccgggcgtttgatggagtacgtgtgaccttggagattttgtgatttgattattaatgaatggtatctcattgatgtggaaatatgtgtgcgattttgtaggcttacaaggctcttatgaaggcttttgttgagcataataaggtgaggtcttgctaatgcttgatttcttgattattttcagacatgcctgaatatgtgactatttaaaaattattaatttcaaagctaaactttaggttagagatcattttctaggtttattggtcaatgcatttgaagagacataccctattttccacggaaacaattgaattcgtggaatggaaataagctaatgcattttgtttcactaaa

SEQ ID NO: 67399 - DNA, 16466 bp, Oryza sativa
ccatggcgagacgtacaccggacgaacgaacgaacggtacgctcgctctcgcaggtggtgaacggatgcgttggggcccgagtggtggggtggtggggttaagaaggcgtgggcggccaatcggatgcgcgcaggggggaggggcacgtgggagggcggggcggggtacgtgggcgaccgcgcggggacgcggccgacacgtaggcggagcggagtcgcgggccgcgcgctccggtggattccagccagcagcgcgaggcgtatggtggggtgaggtgaggcgaggtcgcgtactcgcgttgcgctgcatgcggcgtccgcccccctcgggcgcatcgtcccccgtggcgcgttccgccgcggtcactggctggctggcgtgccccgcgtgacggcgtgaggcctcattggcagaaggccgtgtggcgcttttgcgctcgcctccaccaaccggctcgcttgtactctagcaccacggtaagtttagcgtataggcggacaccgggacacaccactttacctttttttttttttgtttttcactaccagatcgaatgatcaatctgcgtcaaaactgctttttggtcataccttgccgtgcatgcatgcatgtacactccgactccggtggtgtactcatgctttcgagattacttctcagctgaggtacatattgtttcagccagcacaaaaccgcctaaaagttgatatatccgcacgtggttttgctggtcatgtatggtctacgagactatacatgcatgtacatacaaaatctcggagggaaaccagacgatgcaatgtaaaccacgacgacaaacgctttgctatctttccgatgaattaaaagctggtgacgacggtctccagcacgtggcacacatcaagaccgggcgaacgcttgcttacgtcgctcgtcgggactagatgcatgcaccatccgtttcctatagccaaagccggagtttcttcgcctggacgaggagcaaaatttatcaaagttcatatcgaaaaaaatttacagaagacggtgcccgatgaagtgagaagctttttacaccggtgaaatttcccaaacccaaacataaatcgactggatatgtaaaacactgtggatctaactcttctgttccaaaaagtacgcggctcgacggtaaatgctctactgtgacgacctgtccgcccaataaaaaataaactagtagtagaaaaactttacgcatacatgcagctgcggtacacgaaacagcaggcaaagcgtcacacgtggagcatgcatgtcgcgtgtcctactggagcccaaccacgggccggctagctacccggccgaatgcagcagcacgaatttaaaccggccagccggagcagcagcagggcaaatgcttctctcttcgatctccctgctcgagaaacaaacttttggaccgacgctacagctccgtttcttactctctctttttttttataagaacccacccttttgcatgcacggcatgtgctgcgtgccgtggcgagcgggtagcaacgccgcgcgacgagtggccgccctgccattggcgggcgcgcgggtgcaggcgccgctccgtctcgctcccgcttggcgagtgggtgggcgcgggtcagggtctcagggaacggacgaaaaggaaggctttcaattcgcaagcgcgtacgtcgcgaggcgaggcgcggccgcgcgagcgcgacgctacgccgtacgctagttgcttgcaccttgcagagttcagttggtgcggtgcgcgctgcggtacagcgcgcgacgcccggccgcgcgctgccgtcgtccgtcgatcgttcagtgcggcagtgcaacgcgcgaggtcgcgagctttgctcctcgtgtgcgcatatgcaatgcaccggtggccgtggcagacacgggagagaaattccgccctgattttgcacgtacgcactctcacggtctcgcgtaatccttagacatcttttttggaaaatgccccgcgtcgggcgctacccgcgcctccgtgccgtccttaccacgcgccccaccacatgtgccgttgcaataataactcacgttttagaataggtgtcgaatataccagtcttatttggttatagttagacttggagttgtaaataggtgttaggggtagagttacagtcagactctataacccgacatctctcttaaatagagaggggagcaccacaatgtaaccatggcgactacaatgtagcgtagacacgcagggagatgatggcagtgtggccatggactcgtagcggctatgagctatattgattggggaggagcgcccataaccagagccccggggatgtagcttcggctgaacctcgttaacaaatatcgtgtgttcctgtgtcgtcatctggcgtgtcttgggtgatcaacgacgggggagattgttgggtttagtcccacatcggtaattgatgatgggggagcacaacttaaaaggtggggtggttctcacccatcagactaatcttttgggttgtataggcctaggacctaaagttgtgactccggttgggcctgtgttggagtaggcccaatgtgaccctgggtggcccatgattggtggcccgggctgcgcactctaacaatatgaaaatgttctattaagagaatccgtttcattttgtgtttgaatgaaaatgttctattaagagaatccgtttcattttgtgttccatcaaacactgtttcaggaagtacactcgtgttgtttcactatgtatagattaaatgttgcagtgaattgaaacatcattccattattttgctgaaacattgtttttttatatggtgaaacagtttcaaaaaccgttgtgtcatacgttgtcgcaaaatgtttcatgaggtgatttggttgtgtttcagctttttaaacgattgaaacatttttgatctacttagtgaaacaattttgatctactcggtggaatagcgtcggacacccgatttgtaggtggtcccctctttttcatgcacaacttttgtatacaatggtcattttcaagacacattagtgagtcagcatttttacggggaatataataactttcatctctttataaagcttattataaaatttatgtaaaataaatggcttagtaaggaaacacacagatgttagggtggtgagcgtgtgagtgggtgtaatggtgcgtctgctctctactattataaaaattaaaattaaagatgtttttatcggtattttggtacgtcatccgtgtatgagtcggtttttaagttcgttcacttttgaaaatcatattcgtatttgagatggtttgtaagtttgttcacttttggaaaatacaaaagagtcatataaaaaatctctttaaaaataccacatgctaacttgagacgatcagattcctaactgtagctcatgattttcttatatatatatatatatgtatatatatacacacatgtacatatatacacacatatacatatatacatatatatatatatacatatatacacatatacatatatacatatatacatatatatatatatatacatatatacacatatacatatatacatatatacatatataaatatatatatatacatatatatatatatatatccaagtgaattctcacggtgaatttcaccttaactaaattatataacaataataagattaaaataatcttcacacgttgtaacgtatgggtattttttgtagtcaaaataaaaggtcgtagtactccgtataattattctgcttttcagcgtgtgtagtggtgtgctatgtctttgccatgtaatcaaaagtttattttgaagtgagcgtagcaactggttaaataacttgtgggggaatcaatatattcggttcaagttatagacttgaggtgctcgcatttacggctaattattctttcagtaatagacggcacactcatcaacaccgaaacatcattgatgactttgccgatcttgagatgtgacaattcagtctttttgaggtgttcatagtgatagggtgtacgcgtatatttatagggaggtgtgtgtatgttagagtttgtatcgaatatgtgtacgtagtcgattacaatgtaggactaggagtttgtaataggtgtaggtaaagttagagttggactctatcctaagctctcttttaaatagagagatacatctgttataaaccgcattacaacttagtatatgtgagagggagcggctgccgatgacatcaaatcaagggtccttataactctaatatgttataattatgtttgatctgggaggagcattcgtaatcaacgcccttaggttgtaggcttcgattaaatctcgttaacaaatatcgtacctcagtgtcattatcgtgtttggatctcctatgatgttttttacatgttcggttatcgatgtgatttctaggccggttctataacagtgtgcgcaagttgttagcatttgcatttaccatacttgtaaagaaaaaaagaacttttgtagtccaaaaaaactatttttatattttagaaaaggtctgagtaggaactgggaacgggtaagcctaatggacgggtgatcgccttgggcgattagcacgcccgtccctcccctaacacgcacacatctccccctttctccacttcctaccacactataaatttcaaaccatttaaaaatataaaagaaatctaatacacttgaaaacatattcatgtgaataaactttatagttataagtatatataaagaaatttcgtaaagactttatgtatagaaatattatatataaaaatatatttgaatctagattcgaattcgaattcgaaccgggtatataaacttttaacttataaactttgggtatacaaactttagatgtataaactatgtataaacctgatgtgtaccaactttaggtatataaacttactaaaacataaaagtaatgcggtgcgcgattacagtggggagggggctgcgcgttagcttttccgactgggaaccgcatgttttgccctgcaactttttgaagagaaatagttgggccgatccggcccggccagtttttccgtgggccactttttccgtccgcggggtgacccaatatgagcatcaggtccatcatgttattttagtcaacttttaagaccttttcagagctcagctcgagctgagaagttgagagatttggaggtggagcccaatccgcagcgccgccgcacgcaggtctgcagcagctgcaactacgtgcgcgccaatccgcttcccaaaaccaaccacctactactcgccgcaagggccgcagcggcggtcccctctcctctccaatccctagggttcgattccgatggcctcgccgtcgtcggtcgcctccgctcgcgccgccgccgaaggagcggcgacggtggctgctcggggtggcgccgagcccgcccgggccctgcggctgcctccggcgaacggggcgcggcgcggtgtccggtgctgctgcggggccgcgaatcccggcggcggtagcggtggcggtggcggcgcggtcgcgcgggaggagttcgtcgggttcttcagggaggcgtggccgtacatccggggccacagggggagcaccttcgtggtcgtcatctccagcgaggtcgtgtcagggccgcacttcgacggcattctgcaggtattgggatggtttgcttctgttatttgatttcgagtactagtattttggatgcacacggtgatttttcccggatgaacagtgcttgcaacttaggtacaggaagatgcaggcggtgattttcttctcctttttttgtgtgtttcatatacggcataaatttaatttattatgtagagagagagagagagagagagagagagagagagagagagagagagagagagattgtaggtttttctagtggtcagcctatatttgttcatgtccttgattaatagggattggaactgagttgtcagaatgaaaattaaccaattttgtgtgaggtaggactaataggagactggtctccttgattcccatggaatgtgagtctgattcattgaccctaaatgaagttagcactattatggaaaacagagatcaaatcttcagcggcctcttaaaatgattgcgatcctttgagtcttaactcgtcgcagtaactccacagaatttttcttatcttgttatcattatggagttagaactgaattataatttatcatatgcaggatatttcacttcttcatggtttggggattcaatttgttcttgtgtcctggaacacatgtccaaattgataagctcttgtcagaaagaggtcagtgcaaaccatccttgctaggttctcttcgccatccattcttgtgctcactcctgaaacatagagttttttagggtttaaaaatcctgtaaaaattcctaagcattttattagaaacaaatggctgagctaatacttcaaaaaatggctttagctttacctcctgactctaggaaatagcccctgtatttattggacatatttatgctaaggctatgccattgaaaaagttttgaatttgattcttaagccttatgtgtggacatcttatcaaaagtatacaaagcaacatataggaaaactattcagtgcatacacaaaacatttttttttaaaaaaaactcaagagaattatttagtttctatagcttatggctgtcctggatgtcatgaaacctggtcgaactcttctgctcagttgtgatgagattgtgttagtgaattgcatactgtgtgatttttgaatggggactagcttgactgcagttgtgatttatattagtaatttgatgaagcacattcactgaaaaatgaaacttcatcagtccttttagctgtgatgataatatgtggaatggctattatgtttatcttgccttttgctaacttgagtatgtttgattcttcttgcaagttacaactatttttttagtatttcctactgcatatgttcatcttataaattttcatctagggaggatggctaagtatgttggccagtaccgagttactgattctgattcattagaggctgcaatggaggcagctggaagaatacgattaactattgaggccaagctttctcctggtcctccaatgttgaatcttcgtagacatggtgttattggacgttggcatggtcttgtggataatgttgcaagtggcaacttccttggtgctaaggtaatatttgttactaactaagccccttcggcttccaagtatctggccttaatctggttcttttgcttatcttgtgaagactatgctcagggcaacttttatacttgtaactctccatgaataaaaaccacttttctcctttaaaaggcacataattatacatttttgttttcatcagcctgcctttaattgacttgttcacctcttacagacttgtttaccctgttatgtaaaacactcctcctaagataatgtatgcagaatgatgcaaattaggcaataagcattggagggttttagttgagatgaccattgacatctggacaacgtagtagttactaaagttgttactgactaacagtaatacaacctttgagctactgagtcgcttttgaggcattcccttcaagtggttcgatttattcccagtcgccctatcatgtaacttcctaacctctttgttaagaactggtttttaatgttttacgaaaagtacccttcaactgccatataaacagaagaaaacactattggctggaaagttgtccatttgggtgaagttcaaattatcatttttgtacactgaagtaagagttaagaacaccatggacaactctaggatcaatagtcatggccttgttggttgaatacaattttagtactataggaacattgtatgtgtgtgctcagtgcctttttccattcgaatgtgcatgtggattatttttgtttatttttccaagtcttttttgtgattatgtccatcacttatgctgaacttcagttcgtgaaggtcctgcagaactaaatttatgtaactctcttcctttggcagagaaaagaagtagttagtggtattgattatgggttcaccggcgaggttaagaaaattgatgtttcacgaataaaagaaaggcttgatagtgatagcatagttgttgtgagcaatatgggatactcgagctcaggagaagtgctaaactgcaagtatgtttttttctctatccatgacctttgtagtgactatatgcacacacatttttactcttttacttttatgagaatatatgtaaatgtcctgtctatattcaaagattctgaagtactattgccccatctactctttctatatactgcagctagcctactaaactaaatttgttctatcttctttggctgcattcagcacttatgaagtagctactgcgtgtgctttagccattgaggcggataagctgatctgcattgtagatggccagatatttgatgagcatggacgtgtcattcctttcatgtctcttgaggaagcagatatgttgatcagaaagcgtgctaagcaaagtgatatcgcagcaaattatgtcaaggttgtggacgaggagggtatcagtcatttgcatgaggatgtcaaaccatttttgaacggaagcggtcctcttggtgcatatgctgcttctttccataatggcttgggtttcaacaatggaaatggtattttatctggtgagcaaggatttgctattggtggtgaagagcggttaagtagatcaaatgcctatctttctgagttggcagcagcagcatttgtatgccatgtaagtgcttctcttctttcaagtcatgttggaccaaaaaggagccccttatctcatttttcattatttactgtgttactttaggcttgctgaggagagaggatagtacaatagtgtaacctttcaagtttgaggacagtttctatttttattcttgaatatgaaatttgtttcttgtatgctagggtggtgttcaaagagttcatatcatagatggaacagttgatggatcactgctattagaattgtttacaagagatggtacaggaacaatgatagctaggtatgttgaacttctgttatcagtttttgatcaaatattacagtttccatgcacaagcaaaatctccgacgcctgttttatccttatgtgcacttagatgcatctcctgaacagttaattgcttgtaacatcatccctaattcctacagaagtcatttgtgcacaaaatcaaaggcctttcctaacttttcgtcatagtatatgcgagttctgaagttgtacccttggctgcgatggcctgcatcttttcatcatagtaatgctacaaatatcctcagcatgatatatatatttttataaggaactaaatacatttaagaatttagcttctacaagttaacgttgagatgtctatttatacagtaatacttggttttcagggatgtgtatgaaggaacaaggatagctagagaggaggatcttcttgggataagaaaaattcttcgaccactagaagaatctggtgttttggtgaagagaactgataaggaggtgtgctaaaatcctatctaatgatctttacagcgtatgctttcgttgaatccggttgtgtgcttcaatttagctctaatttatgctttatattcaatttagcttcttgaagcactggagtcgttctatgttgttgaaagggatggttcaatcattggatgtgctgctctgttcccatttcccgaagataaatctggagaagttgctgcgattgctgtatctgaagaatgccgaggaagaggtcaaggggacaagttgcttggtacgctcattgctttatgtcatccctgtttggtttccttaagttagccatcaaattgtagttggttcaaacttcaaaaaccaatacttcacaaagaaattttacagtccttgagaggtactaggaggtaccaaaaatttttagtacaaatttggtacctcctagtactggaggttccgagaggtatcaaattttacactagaaaatgtggtacctcttagtgcttcatcaaggactgcaaaatcactctcacgaaaaacaatcaaacagtatttatcttcatttgaaatagacggatttatcttcaacaaaatccaatgtcttgtcataagatgcaaaactgaaaaagcttgatgcgtttaacattatttccctgagatgcatttaacattatttcggtagcttaatgcaaccacactcccaccatcctttccctgaacatgcacacatcatgtgccagtgcatatcccttcgtccacctacttattttgtcacatgcacatgtaagcctaaaaactataagagggaagaaactacctgcaaagagggaattcatgctgtagtcttgtaactactagtctactaccaaactatctgattgttactaagccaggaaacatgaatgtggattttctgcgcatcattgttccagttaacaactcctcatttgtatttgaagagcttttatgcacctgtattgatttattatggaaagtctattgtgcatcttgttttactcaagattatgatgatgcttcagactatattgagaaggcagcaatgtcccttggtctggagaaattattcttgctcacgacacggacagctgattggtatgcaactttatccttctcttggtccattatatgggttgtttcatatgcatgatttaatgactaaatagcctatcattgtgctctgtttcgaataacaaggagtattaatacttagctaataaaatattcatagaggacgatgtaacagtctgtgttgtgcaatatgtatgtcactctgtgctgggagtataatttctttcttgaatctagctgatgatctaatatgttttcatatggcttagttaggacctgtacatactaaaaatatcaaggtacttcaagtacagtaaacacatggagaaaaatgacaaattactggagctatgttcagatattacaagattattttattttgtgaggattttaggctagattataatatctaagccttctatatatctctagcgcttaatttgaaactgatgcaggtttgtgcggcgtggcttcttggagtgttcgattgaatccattcctgagcaaaggagaaaacgcatcaatttatcacgaggatcaaagtattatataaagcagcttcagccaaagcacgccagtgttactcccaacaatattactgccagatgatataacgcatatggaattggtgcagttcaacactatatcagctctgagcctctgacgccaccaaattttgaaggtatgttgtactaaattaggatttcagggagagaaacataggaactgttagtgatgtcgatttttgaaatgttgtgttaatttatttacatggttgcaaaggaaatttgttgcacaatagaatcagagtagatcatacctggagaaattctatataagtaggctgaaagcttgaaaaggaacttctgataagtgggagtaaccggcaaaaagagaatattttacgtcaggttccctatttatgtgatgctgataacgacctcacacgcacgccaatagcgtgcacctggaggcattctactaccatagttttagaccaggcaagaccgtttgatggcaatacatttcgggtttggtcttccatgaaagtttggtaatcacatggcaggggccccagggctggcagcatacacggatcaaaatccacttaccagtcagttagactagcgactggttcatcacaaaaccggtaacctgattttgtacactctttgcacgcgccaagatgattttggcttctagacacggtttgtatgtggatatattaaatgtaaagcagcaaccgtcagagcttttatcataagctgattccagaagatgcacccaaaagaagcacaaggttggcgttgcatctcgatgatgaatgtttatgtggatgtttgattgcttacaaccaacttgggctggctcacgcggattcccttataagaaaagctgaaattgatggattatctggtttttagtcagcctattcaagaatataaacaaatgaattaattaactaatgtaaagaagctttagaaaactatttcaagaaaaatatcatattgaaaattttcgtacgaaatgttccgttaataaaaatctgaaatctagaatcatatcagggtcgaactaacgcaaaatgtaggactggcagaatcataacagggtcaatgcaggactgggatttgggttatctgggcgaggttcatttaaccagctaacagccgaacaacactaatggcgatgcctagtaacgtgtaaaacgtgacgtcgcaatctgattttgggttatctgtcttgtgccttttactgtataaaaagacgacgtgtgcctggcgcaatgatacagcctcaagacctggaaaagtatccagacaacgcaatctggaaaagaatttatcagaaaatatctaaaagcatgtcgccacacgaatttcacttcagctagtcgcgaggccttgatgttatatatgatcgtaattacaataattaaggaaaaaaattactgggcaagctgttcgttcgaacaagaaacgtaagattccttcaaaaagaaacgcaccagtcaaagtcagtgcccagtgagacccggcggcttatgaggtgatcagggtattttcaaagcaacgcaagtgttaccccgcagcaatggtaaagaaatcaaatggcagacataacaagaacgaattcaacttgcactccgcaacccgggttgaattccaccagcaagattggaatcaacagtagtacacaactatatagttttagccatccatcaaacactgatcaaataaatcaggttcagagaggttcataaacaaggcgaataacaggtaataatgccgaacacgaaatctagcagcattttctcatagcagttcggtttgatcagctccatgaaacaaatctcttcagctctcttgcacccgtcgcctctatcctcagaagcaggcgtccaggagacagcagcagcagagggcagccaagctgttacaacacatcattagaatcatgacaccaaaattgaaactgataaaggcagcaggtaagtatagtattgccatttgaacaaaggcatatgctcaatctaaaataagtccctaaatatgtccagccgtccattgacaaactgcattattcaaattgcaactaggttagcaacacaattagtgatggaacacccgccaagactaatcataatcatctcggggggaagaagagaaccgttctttggtattagcgcgtcaacgaaaatataatatctctctataaaaaaccaagaaagatatacttactacggagtatagtagtattatcctaggtgacctctccccaaaggaatctgtgaaaagcacatttttattctcctacaggcttttgaacttatctttcctctagccaaaactccagcaaccaaccaaaattcacaaggaaacaacaaatggtaagcaccaagggaatgtgactgcatcacagccgtccatccaagatcagacggccatcactggtgcaaggagaagacagccagaccccctcgtggcatgcaagtgcaacctcgtcgtcgccttgcttggaaggaccgacacgtcaacgaaacccacgtttcaaggggtggtagttcacgcgtctattcagggccccaccacagcgaacgtgcgccgccgccgccgccgccgccgcggcggacgcgccggccaccgcacccgtcggcgtggacagatctgagaccagcgtccggtaattactactactactccctaaccgcctaaatagcactaaaattttgatctaatcaaacaatctagtactacttcaaattcaaaatctactagtagtgcacaagagcaacgaagaagatgctgaattgttgattaaaaaaaaagaggcgagacgagacgaagtgctcaccatccctccatgaaggaagggccgctgctgtgctgctgctgctggggcggcggctgcgcgtacggcggagggtagccctgctgcggggggtacccagccggtgggtagccctgcgccggcgggtagccggccggtgggtaccccggcggcgggtagccgtccttccccgggtaacctgaacaaacacaagatccagacacggccaagattcagtcaaaccatccacaagaaaccacacaagcacacacataattttttttaaaaaaaagccgaggaggaagaagaagaagaacacggggagccggagatttcgaaccttgctgcggcgggacgccgacgggaggttgctggccgtagtagctcatcttttcttcttcttcttcttcctcgggtatccggcgatcgaataaactgattgaatacgatcaccttgcggagacgggggcggctttatagataggccgtgtgggcgaatcgtgacgggttattattgctttgttccgggaatatattttcgctttttaggcaaccgcgtcccgaacgtggcccggggtggtgggcgatatggtaatttcctcgagccttcggcctggaccccaactctgattatattacggtggatggctttccaacaccaacggtgcttttggttgtagggagtttttaggagatattgggagtttagagggataagcctattaagtgttttgtttggttgggagacatgggaatttttgtgggatgaggatgaggaattgaggaaggaactccctccttttcaatatctggataggggtaggtaattgggagggaattcctcctttaatttgtctaagcaaatctcagccatccgtttttattaatgacctaatctccaactaaactccctatcaatttccattacctctaccaaacaagatattgggattaaaaatcaaattcccatattaatctcatcatcaattccctcatgtaaactcccaatccccttccctcgagttaacaaacaagccgcaacaggttaagttagaagatattgtttcaaaatactaaacggtttcataaaaaactttctatagagaagttgttttaaaatatcaaatatatatatttattatgtgttaattaggttttacttagaaaaatatatgtgcgttgcaacaggcaaatgctatcttaatattatacggtttaaataagatgaaattcactgtgggaatttacttggattttttttagaaaatcatgagcttcaattagaagtccgactttcatctcagttagcatgtaaggtttttttaaagaaacttcttatacgacttcttttgtattttcaaaagcaaacaaacttaaaatccgactcatacatggatttctatttccaaaagcgaatgaacttaaaaacagactcaaatacggatgatgtacaaaaataccggtaaaaacatcttcaatttttataatagtatagatttattacaaagttgacaaatatattcatccatatttgatattttaaaacaacttctacatagaaagtttccgtatgaaatgcaccgtttaatagtttgaaaaacgtactatgaaaatcgagttaaaaactaagtctttttgactgggaatactgtcaaggctttgcctagcagtttaaattttatagaaaaataaaatatttacaaagttacagataatacacaaaagagaagaaaaggcaacaaagctataaagtgtgcaaccaattagaaacatattgtttcagggaatccttcattctgtgcacagatgcagaagagtttatttcacaaaaagggatttccaggattgaaatgaaggttaatattttgaaagataagtccattgctatgcttctaaatgtgccatgacgccataaagaaaatctcaagaaaacctctttgactaaacccgagccttgccaggacaaccatctgaaaaaaatttcaggttttggttccaatgaattcccaaatactgtcaacatctagcactaaaagcgcaagtgaaaaaatgataaagtcttgtttccctctaatcaacattaataagaaaagaacatgaaacggagtgtttttgagaaaaataatgtaactagtgttggaaatttggtcataattcggcatattttattccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatg

SEQ ID NO: 67400 - DNA, 22156 bp, Oryza sativa
aagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaagagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactatcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatcagtttgagtcactatacccttctaggtacttttggaatacccggaatagtgaattccatagctcatagtaccctttagatagcgcattactctttccagagcctgccaatgatcatctcccggatttgaaaccaacccggctcagcttgcttacagcaaatgagatgtcaggcctcgttgcgttagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgttcacacaaagcctgcagatgtaagcgtggtgtcaaacttctcatgccattgcttaggtgcttgcttgaggccatacaaggatttcaatagtttacacaccattccctcctgaccttctagtacatacccgtctggttgatccatatagatctcctcctccagctctccgtttatgaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacaacttcccaagtaccattagacataatcgagtccatttcactgcgtactgcttccttccagtagtcagcgtcaggagatgaatatgcctcttctatggttcttggggtgtcatccactaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatgtagcatctctggactcaagaattgtaccaacatgcatgtcgggtactccagagtttaatattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgtaaaaggatgcaaactcattggaaaaatactccccacctctatcagacctcaaccgtttgattttcctttcaagttggttttctacctcagctttatagattttaaagaaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttcttacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttaccgtaccccgatgttcctccgccctcgctaatgatcatgttggcagacttcttgtctttgcgctcaggacagtccttgggccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatattgtagtcatagaactgctccataacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaggcatgtggtttcagtgtagcagcaaagccaactaccgaaaatgacctatcaggtttttggattggtggaaattggtcataattcggcatattttattccaaaataacaagataataaacatgatatttacaataggatttgatccagtgatagtggtgaatgtaatcaacatgagcatgcttaacgttgaataagcatcaccaatcacataatgacacaatgttgacattgcgatgaacattaccagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactggtcgggatgggattaccgtagcagcaacagcttttgaaaatggatgaaagtgtgtcttcttcttctcgcgggagatcaaatccattcccattttataagaggaatggaagatgaagagtaagagtcatggaataggaagaggaatggagcaactaattgtcatcaactagccatgaaccatcctctactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaactagaaatttttaagaaaacttcttttagaaaaacacaaccatgtccctattaacatattcgaaatactggtccggtatattttaagattgatcacatgtgtcttgctatcgaggagtatgtcgcttatcactaaaagaataattatctgtaaatgtgggtgggtacccatatcaagtttgagttggtttcatgtaaaaaaaaaggtctggacttggtttcatcccaagtaataacctaaccaattgacatatgctcatttcgcttttaagaaaatattttaaatcttatttttggaattgtaatggtaacggatgctttattggtcatgtgctattatctggttaatattgccgatgagtcattggctgatcggccgaaccgcccagtccaacggggcaggctgcgacgacagaaataaataaaaagaaaaagaaaagattaggactgtagcagccaaagaaacgtgaggacaggggcaatttatgcgggtttgtttgcaggctgattaatgatagttatttatgtcaaacaaattgacgaagttaggctggtcaccaattgatatatagtagtacttgtgattgcgccctgacacgacacgacgaatagtatgggagacagggtagctgtttaattagctgtccgcctatgcaaaattcatttttagataatatctacaaaattcatgaatttgccaggacagttgacgtggcctgggggcttgattgtgaatttgtgatgagtagggccgtaggggaactaatcgtgacccatgaggacaaccaaagccagaacaagggttggtcggggattaagccaggtttaaaaatttgaccggaaacgcaggtctttcagtttaaaaaaggagaggtctcgaagaaatgtttaaaatgctcagcaagagcttgggtcttggtcagaggttgagagccagagagagcctgcctcagttcaaccataccgggttggcctaccccgcgcttattatggccatgttgccgaagcgcgtattttctgctctgttccttagccgcgtcgcctttcgatcttcgtctgctaataacgtctcaactaccagccgcagcggcacagcacaactgcaggtcagttggacgtccgtcatcgacccgtgcagcgcacgtacctgcgactaaaatttctggtgtgctgaaggctaacctacgcgaagggaagcaggaaagaacggaaaaaaaatttggtggagaccggatgtaaccggcctcttctacagccccgcttcggatggatgccacgtggatgacatagggatcaaacggttagctcggtccggctcccggcgttgcgtgatgaggacacacgcggcttggctccacgagcagccgtgtctttcaagctctccgtcggctcaattcgacgaacatcatatcgcatctccttttgcctggtgagcagcgacccgcgtcttcctccggcactgcaggggtcgtccttttcctcctccggcgccgcagacgtccctgagactgacatatatgggactgggagcaccatggccgatgtgccgtgctccaccaccgacatcgcttctgatgtgctcttcgtgcttgtgttttttttggagatcttgtttggttggagggagtttttaggagggattgggagtttagaggatgatgctattaactgttttgtttggttgggagatgagaattttggtgagatggggatggggaattgaggaatgaactccctccttttcaatacctgggtaggggcaggtaattgggagggaattcctcctttacttcgcctaaacaaatcgccatccgttttcattaatgacctaatctccaactaaactccctctcaattttcaccacctctaccaaacaagagtctggcatgaaaaatcaaattcgcatcttaatctcactatcaattctctcgtgtaaactcccaatccccttgccaaacaagccaggctagagcttgaaccgtttagagtcgagggtcaggtgctgtcgccggccgcttctccatggcatgagaagaaaattaacatgcaaaattgaagtgccgtaggattaggaaccagaaaacaatatacaatattcatatcagggagaagaactggaggcagggtcatcgtcgatcgaagcggtaatcgatgaagtattgcgtttcgtccgtggcggccgccagaaattggaagacgggtacagtcgcagccagcatccaaacgcgccgcgggatcaattgcctggcgctgcggctcgccggcggcggccgcctggaacaggaacagaaagacggtcgtcgatgtagccgatatccaggcgaggagacacgatctgcgttgaatcgagccgtcggcgaggctgaaagccgcgtctgcgcctggagccaagccatttgcatcctcgtcacgcagcgccgggagccgggccgagctaaccgttcaatccctaggtcatccacgtggcatccatccggagcgggctgcaggtgaggccgattacacccggtctccaccaaattttttttcgaaagaactcgatcgtcagcttgtctactcccatgtgaatctctatccctattggtccacctactaatccactcagctcttcatctctcagcggtgtgtgacgcaataatcaattaagtaaattacgtttagcgtcaccttttattaccaaactttattttggatcacatgttaacccatcttaattttcactttggactagcttattttgtctttgttttactccattttggactatctaaaatcttttctcaagcatataacgactttgcatattggctcctgtaaaccaacaatcttcccgacatacacgtagtatatttttacaagattagagggtagatgtacttagagatgtgacttctataagattagagggtagatgcacttagaaatgtgacttctatgtaggatgttttttgcaagattagaggatagactattctagtattctttgcatatttagagggtagatacagctacacatacattactctttacaagattagagatagatgtagctagagaaatgatttgaggtgatccaatgtacaacgaagtaatcttacctagttcgaagtgaaaatattaactggaggatagtaaaaaaaacaaaattttggtaaaaaggtgggccaaagtttaactaactttaatcagtttccaccaaatgttgtcccctttggacattgacaacacaacataactttatctagtgctctcgaccaccatatagactcaagcactaagggcaaaccccctatgttccgagccacctaaaccatggctcgaggcctagtggttaaaactcgttttattttacctggaacatatgtaaattcaccatgtattttatagatggccaaaaacattgtgtgatcagtctaaatgtttttatagctaaatgttggattcgtccttgcaagcactattgatacattggttctacaacactaaggtgttttagataataacatgaaattttacaattaagcccatgcttttatttttttactcaaaacttcaaacaattaataagcattatccgaccatcaaatatcagtcacccatccacaatttcttctctttctcttattcttttttgtaccctatctccccatgcgagtaatgacaaggcgtgaccctcaagagcggtgcagatcagggcagcatggagaaaatctgatcgactaggcgctccgctcttcagcggcagcgggccaatgaacttttcaacgatggcacaaatcagggtgacggagcatccatgatggtaggcccctcctctccctcccctagttatcacagccttcctctcacccttttctcccttgtcgccccacacgtttaccctgatgagccatcacgtgcctaaggatcctacttggtgagccgaaaccacttgccacgcatgagaattgtgcatgcccttatgattttgaaaatgaatctcttttctttctatttttccaaatatcttctttgcgatttttggtgttggtatgatcgacttatgaacccatcacatcaatacatcaacatggtgttcatccccatggtgtcttggcttttcccttaacataatttcattcgtcaccattcatcaaggttgactttaagcttactacatattaatagaccaaataaccatattgggggtgggaatagatttgatgtgacctaacttgtattaaggctgagtttgaggagaaggggattgggaagatacgcaaaacgagatgagctattagcatataattaattgagtattaactattttaaattttaaaaatggattaatatgattttttcaagcaacttttctatagaattttttttacaaaaaacacaccgtttagtagtttgggaagcgtgcgcgaaaaaaaagaaacaaacaaactcctattgtcatgctgccgaatgcagcctagtcgacacaagcacatatgtatgtgactacactttgtaacttcaaaactattttttttgaacgactcgcacgagatggtgcgaagttctattgatagagcagaaaaaaattacaagattacaaccctggaaggtcgtaatcaggaaaaaggaaaaaaaatactaccacccacaccgacagcgccaacacataggtccggaagaaggctagcaccggaccggccgccactaagcgtgactgaccgccgctaggccgacaaaggaacacatacgagaatgcccaaaagacgcccttacaaccaacacaaagcccaactctatctagagtgtgcttgcaccagtcgttcgagtggtttcgacaagggatgcctaaacgacgtctccaaggagagaagcgacagaaaaccgccgccgccgtccgtcagggactcaaaagagccaagactgggttttcgcccggcaaacacccttgagggatgagacgacacgacaacgccctttggagggggaacattgttgtcggtccggccaggccgggctgggttttcacccgccgctcatcacctgcaagttcatggctgacgcaccgatgctctaccactgctcaacctctgctgacatgtggaaccactgcaccggcgcccccgtcggccagcattcgtgcgccgaagaccacgccacaccccccggccactcctactcacaccgtggtcgcctcatttaccgccggccgcgcctcatcgcgccgtgccggcctcctccaccaccagacgcgcctctcgcgctagtccagtctcccgccatcgaccgcgcctctcgctcacatataagaacgacgtcaattttctcatcacaattcaaccatacaaatatgttctcgaaattcaacgggtgatggaccggtagctatagcagtttatgacaacgaccaatatttatatatatgcttcgcttttctccttgtagtagtaccttcaacgcaattctatgcataccttgggtgtgtttagttcacgccaaaattggaagtttggttgaaattggaacgatgtgacggaaaagttggaagtttgtgtgtgtaggaaagttttgatgtgatggaaaagttggaagtttgaagaaaaagtttaaaactaaactcggctcttctcttttgttttaggataagatttgataaagttctgatcattgataacttttattttgtttttaaactaaacatttgagaagttatcaataatcagaattttaaaattctgataagtcttatcctaaatatgactggatggagcaatttttttagtccttttgtaactgctacatttattgcaatacatgagcattttgctagtaaaaatgcgtaaattacaaatgacgaaaaaaaaagtgacctgccggaagtgacaacagaaagggatgttggctacacggtcgcgatcccatagtacagtttacttggctggcagtatcgcagtccgttcgtcaaccggtgaatggcagcgacacgctaggcaagtcactgctctgcttgatcaggctcgctccctcttttgggttggccacggtagcgcgtacgcggcgcccaagctgtcggggtctctcaggtgagccaagccgccggcgattctacggatgccgctgtcacggtgcggtgtgtgtgtgtgacgcgacccgcgccggcgggcgccccccaaaactgaaaggccggaaacgaggtgagggaagagcctcatgctacgttccctctgacgatcgctaacatgtgaccgagccacgtctttttaccttcacgttaattcgttaaagaatctcaatccacggggtgttggtgggcttcacggcatcggggtactgggttgatttctgtgagatggttatacagcgcagtaagtctacttctagtccctcaatatatgtccaatcttattcatatccttgaatcgtggtaccggatatctagacacttaaaatattaaaacaggtataacttgcctccctcggcatttttggaaggtggtcaccgatacaacgctttgaattgtccagcccgttgagtcatcctgtaggatccacccgccagtgacccactgaccatgctcttccttcctttacccctcctaggtctggacgatagggcatccatccatggcatgctgcaagtgaggtggcggcgagttctttcagtccacctactttgcttgctcttgctcggtttcccctttcctttgaagatttgtgctcttctagtcttccctgatggagggcgtcgtcctcatcggagcggcgaagtgaaggctgcagcggccagcgctgtacctgcttgctatcaccggccatcatctggctactgtcaccacacatgtaaggagcatcgccgggcggcctagccaaggccccggaagcaataccaactgacaatggaggtcggcgacaggacgacagcgatgcccgcaattctttgcaattttgtgccatcgtccatgtcacgccacacaattcgtgcaagtcccacaaaaattgagaagaacaaaaaaagtatcccaattcgagccatcgatcatctcgtatgcacacgtgcgtcaaccgcgtcaggagatggaaaggcgtcggcgacgctggaagagcaccttggcatcggcgatggccttggtgcacgagctactggacgcccggctcgactgcgagatgcgtccggaacagtgagttgagggtgcgggggaagctccggaggaggcggttcaccgggctgacgcgcaccagctcacgcttcatgctcacgtggttcttcaccaagtcggtgagccgtatccgcatccgcaccacctccaacttcacctccgagttctcccaccacaccaacgtttagttgtcctgcggcaacatcgcgtcgcttcctatcccgttccacgaccacatcccaccgcctccggaggcgaaattgcttgaagtagagcacatgtgcggccatctgcatgggcagccgctcgttccgtgccgcgtgcaaatcccgtgccgttgccctgatgacgggtcggccccacaagattacttggcgggttggaccatgtcaaagtgccacgccagcgaaactgcgttctaaaacagttaaggaagacaaattacaccggttttaatagattaggagccaaggtatccggtattacggtttagtgataggaatcaaattagagtcaaagtgaacttgcatagcaatgtgtgggctgctaggcagatcgggcacagacagaacactgcccaagaaatgttctaacgaatttcaggcaacacgtgcgaaacaaaccatgattctaagtagcttatgaaagtatggcttgtcttctaaaagtacagtttctctaaaaacttcctacatcagcatccattagataaaactttttccaaattacttgtcagggaatgtatcctatgcacacaagttcttatctataatctatccaaccatccagttagaacacaccctaataatccatagtactcgagagtttgagactatgaggtactactgagtttgtcggttcagagattctggtaccccaaggcttaatcttctggcgtaacaatgtgaaggataaacaagtgggtgattttgtgatgcattctgtattcagaagagaccatgccaagtgccaagaacgtgaagctaccaactaagtcccaggaatgttccgtcacaacaagtgagtataaaagtcacttcggttaagatcaagcatggcgaccaagagcatgatcccgaagccaagagagtagaacgggattaaattcaccttttacggtctcgcacaatgcagagaagatcatggcgcggcacacgtgggtcatctccttgctcctcacctccgccgtggctggtgcgtcgcggcagccgcccgcgaccgcaagccaaggaccgacatggaccggccttgccggagagcaagaaatggaaggagcagccaccgcttcatccgcagcgccggtggcttcgctgttccccggcctcccgccattgccgccgctgccagcgctccccgctctgccgccgcttccaccgctgcccgccttaccgccgctgccaccgttgccgccattgccgccgctcccttcacccgggacgacgacgacgcggccgcggccaccatcgccaccgccgacggagtgcctgacgtcgctcgtggagctgctgccgtgcgtcgactacctcaccaacgacgccaccgcgccgccgggcgcctgctgcgacggattcaggtcgctcgttggcagcgcgctcatctgcctctgccacggcatcaatggcgacatgagcaggatgatctccaggcccatcgatccggtccgcatggtgctccttcccgccatgtgcagcaccatgctgccgccgcagtcgcttttcatatgctacagtaagccaacgcttttaattatatgtttttttttattttgccaaaaatgattttgaagtcacaagtgatttgatgttataaaagacataaatcacaagtcataaaattataacttttatggatttataatgttataaaagacattgacttgtgatttgattttcgcagcggaaacagtgccaccattggtgccatagttctacggtgcatatgctactgtcttcagtaacgcgttcggcgttcggccataccgtgcaaattactttacaattcttgtcttctgaacattcgatttcgaaattttgtttttcagactgagaccgatcgatgtaaaagcagatgggatataaagtttcatcaagattaactgctgattttcttaaaaaaaagaaagaattaattgttgattacttccttcgtctcaaatgtaagcatttttaaggtagtcacagatattaaaaaaactagttgataccccgcacgttgctgcgggatatatagatatataactttgaagaattatggctccagcaaaggttttaatattttgcaattcaagatatgagctttcttaacgaaacaggcatagctgcaggccttagcaagcatgcagatgaagttaattactttgacaaaaacgaactgcaccagaaaagtctgaacagaaacttgcaaatgtaagctaccaggggccaggcaaagtaccgattgtagctaacatattgcatttaacccaaaagattagtacagtttgttgacaaaaggaaatgaaattctataagagcatttgaattgtcgtgtctcattaattacctggcatataaatcatcacgtttactcataatcactagccaattaagtcgtacattcgtacgactatgacttgcacttttatatgtaacggtaacggtaagtatcattcatgggagtaccaaaaaatatcgtaaattttttgagtcaaaaactttgatatgtaactataatataattgaagtactataattacattgtaagtacactgtaattatattagtaactacgatataacttatataaaacttgtattcaactatgatttggttagacgtgacatatgtgaaaatttagttgtaacaattttttttcttcatacaaaagtttcgaggcgatccgatggtgacaaatctgaaaatttcaggggcaaaaaatttgtggaagttttctagcaaatccgatcatttatatatgttaaaatttaattaggtaattagatttataataattgggactatgacttgcatttttaaatgcgtatcgtttgtaataattatatatgttagaatttaattaggtaattacagctattggaactactatatttaagttttgccaaagagtgagatttacaggtattatatactaaactacacatagaacatataggctgtgataatattaggagttagagtaccatgttgttagcggaagatatttaaatgttgttaggtgggcaaagaatacgatgatttattttgagttattatagtgctctttttactattactccctccatttcataatataagttataaccacttttcttagatgtttcataatataagacatacatgcaagcatgcaattaactatgacattttcttcattaaattattattttttaaatcctccactctcatgttgtctaatcatattggatgcatgcattagtatttattatgatgatccaaactacaagatgataataattatttcttgttctttgggttaagggtggttgtgtcttatattttggaatgaagggagtatttagtagtagtagcttttattttaattaagtttaactgtgttgtttctttatttctcttacgtgacggtaccccatgaatggatttttattacttttgtcttttctgtttcatctctccgatggaagtctcctgactcttcctacgatcttcattattaatccaaccgttcacaccaaatccaaaggtttatgctatataagtatacctggctcaatgatggaagaaataaacattcttcgttcattaaaagagatatacatgaaattcgacttattcttttattttgggctatatccgtgatgccctatatattgtactagacacgtgggcttttaatattggcgggcccttcggagtattgccatggtggattcacgagtcttccagttaacttccgaagtcccttgaccatgctttttactttggttattttgagaaccaacggctgttgtttaatatctggctatatccaacagttctaattttgcccatgacgtggcacatctaggtgatgaacaactttagttttttcattactttagattagctaaaaggaaatattcccggtaaagaaaatcaagcttatgagattcgtgaaagtctaattaatagctaacataaggtatctgaaaatgtataagaatcgtatactatttattgctctatgctgctagctggtaaggatctttcaattgcagtgttattttgaaaaaaaaaagaagatactgttacattgtcctaatgatgaaagaaattataatgcggtaagaaataagtaaaagaaaagtgcaccttcaaaatctccatatcattcgcatgggagaagaaaactgaattctctcttaatttataggaatcataagttcgtgatcaaaactgaatatatatgaaggcagaaatttgtgatcaaaatttacctcatcaattagggtaagatcatgtatgtggcataaggaaaaacatagtgatatcatcaggttatattttttttgagtgggaaaagcaggagctctgcctatttcataatagaaggagagaaacataccttaccctatttgaagaatgtctataaagtttcgctatttgatgtaaagggagaaaaaaaagagtacagtatagacatcagctttaccaaaagctgataaatttgggatcgagccaatgaactcaacataggagaatgaggggagagaaaatgtacctcatccaaagactgatgggagtaggaaaggtaaacaccaggaagacaccaatcgactgatgtcaggagctgcaaatgaaatcatgttgacggggacaaattagctatgaaccctgcataaatgccccgtatagatcccattcccagccaagatcaaccaatgttttccaaatctaaagaccaaatcaatgccctgataatccatatgagccaccagatgaattggacgggaacttgatgaaaatcgtcagccctaataatccacatgagtactgataatatatcgtggtgagcgccgcgccgggattgaaagcctgtatgctcgcagagcatcgggaggggctcgtgctgaaagaggaagcatcaatatttagcatgaagaagaggaatggaatgggtgcaagaatgatgaaacgcatctggagaataaatggaattaactatacctaattgccctagccgacggctcggtggcagttgattagtcaatttgaggcttgccgttatgtgagtgagggttggtggagaatttgatggaggtctgcctcctcaagtcgctggatgctggagcgtggaggtcgcacgtagtgcactgctccctgcgagcgttcagattagatcgaacggctgagaattaaatggtgacgtggcttaaccacagatcagttttgggtcttacctatatagaaagaagggatagggaaagatgattggatgatggttgtaattggtagagaagataaagtaggtgaagatgatggttatgattgattgagaagaaagcataagtgggaaaatagctttattttgggatatcatggtgacgtggcttaaccacatatcagttttgggtcttacctatatagaaagaagggatagggaaagatgattggaagatggttgtaattggtagagaagataaagtaggtgaagatgatggttatgattgattgagaagaaagcataagtgggaaaatagctttattttgggatatcaccgagtactccatccgtcccagaatataataacttaaaaccggatgtgacgatttctagtactacgaatctgtatctgtagtactatgacacatctcatccggttctaagttgctatattctgagacggagagagtagtgactagcctccggcattcactttccaaagcaccattaacttgcaagttactatgctaaaaatagctgcatttaaaaccagatgtgatgatttctagtactatgaatctgtatctgtagtactagtgactagcctccggcattcactttcgaaagcaccattaacttgcaagttactatgctaaaaatggctgcattttatgatggatgcagtagtaaattatctttcgctgttgagtaccgagttgtttgtatatgtaaattgtaaagggtcttttatacaagtcacgtatagttctgtagtgctgctaatttcgcggcgtggaagacaaggcctggacatcagacacaacgatattgcacttgttggttgaagcatacgctgtgttctttgattctgcacatgagtatttctcaagttctcgtgaataaatcattcaaggaactgaccaggcagtatagaaacgccggtaagttcccaaaagacaaggggcagataaaatatgtaaacatatcacatcttcatagcaccatcaatatgatttgcctgaatccaagtaacatatagcaatatgtagaagtatattattacacaagaaccttctaacaaatcacccagcaacaccatccagccaccggccaccgcgttaatatactcgcggtgaatccatccatgcgaaagcctctcggggtgggataaatacagtagtccacgagagaccactaggcagacgcattgaccaaaagcctccgcgaggtatacagaaggacactaaagtgcagatatctcctttatgacctgctctttgtctgcctcgaactgttcatcctctgataaaccataacactgctattagctcatgtgcaaatgatatagaggcatatcaaatcccattgatgaacagctacagtgggaaagcttaatagatatgatttgtaccagctcaagagctgaaaaatgaaaaatgaattgaacatgcagtcttgagaacagaagaaaagcaagcaagtgtaaaaattgaggtaacaggtgttaaaataggtagtaaagcacctttgtcaatcttgaatccggcaaaaaatcggagaagcttgcttcggtttgtgactagtatgtttacaacctcagttggcttgtttttatttgccgcaaataactgcagtatgtagcaaatgtaataatcatacctgagttcaaataaacatcacctgctttactgggaataaatctgcagagtattaatactaaccttgaacacatgaaatgcttcaatttgaatatttttgcttgaatcctgaaaattcaagagatgaatccatgataatatgaatttctcagaaagaaaaatgctgatagtctgaaatgccttgatttgaataatcttggggccattatttcaagaggataagtattggtttttttctgtaaaatgtaatggcgattctacataggtcacacagcttagaaggttgactggctttgaggctcaagattgagttcaatgcaaattttggtttgaaacctatgaatcatcagaactggatcatgtgttgacagctccagaaacagagaaataaacatggttgcaatacatttgttgtgattaatgtattgctaggaatatcaataaatccgtgtggctgtgacagcattcttcaacatccctttagcgcacagttttttaatgtgtgacactgacaaatgtagactatcagctgggttttcatcttaacagctatctttaccgaaaactatggtccaaagaaattttaatgtataatcataatcatcatcataagctgcagaatacaaggatttgatgggacatgggaatggtgatttggtgatattttctaatgtttgcaggtacgtcaaatcatgaaagcctaaagttgcccgttgcattccttaaaattaataaaggtcaaagtggaagtgaaacttactctcaagagattcatgagaatcataagattatcttttgaactaacataacgcatcatgactgtagagttggatctatcaagcagcatgtctcccaagaactgaagggggaaaagtaaatattaacttcagaaaattagaaaacatagtgtacagtgtactcacagcatcaaaataaaacagtacttttacaaggaaaagatctttggacaccaaaagtgtatatgcatgtgtgagttgtcaaacagcaattaatagtagtgaatcaagcatgataagctatgcaaatcacttttcatgttccaagagaaggcagatccaaatcacttttcatgttccaagagaaggcagatccgtacatgcagacatatcacagataaacccacatgtaacagaatagcaataccttgatagcctgcctttttgttatgtagttggttgatgatagcaacctagtgttgaattctgaaaagaactgcagaagaaagaaagatgataaagacatgagactacaatagcagaaaagatgttacaatttaaaccatacactaactgaattataagtggcatacaaagcaggatacaacagtgtttgtacatcgacatggattaacaatgatgatgccaagtaaaaatactcacccagtcataattctttgacagaaattctgccacggtagctttatgccttgtcagaagttcctgttttgagtaaatcaatatgatcacacaagaagacacgtatgaaaaaggaacaaggggatgaaaaatattagccaagaaagcaagtgtgctcctgcacttcactaaaaatccaaggcatcaaataatttcctcgcagcaacaagttgtgaatattgcagcctgaatcaagttttaatggaaaaaaaattgccacatttttatcaacgtgacttttggaaaagaaaagtaaaatatagtgataccagcggccagtggacatagagatgttatatgtaacctatgtaacattcttagtataattcaggcatataagttaggaaaagaggaagaaaacccaacaaactttttgcagggcgggcttcagcaaatcaccttaaaggtcgcagaagcatctgatgcaatgtcaaaatttggaagttgtatatagtcaaagaacttcttcatgtggtcagactctaaaacgtacctgtgagtgaacatttaccaagataaataagcaccattccgacaggaatttctaatttctacagtattttatggtttatgtaaaacagaatccttagttgggataatatatgtaatctattatcttacgctttactacttcctccgtttcaagttataagatgttttgactttggtcaaagtcaaactgcttcaagtttaatcgagtttatagaaaaaatagtaatattttttacccaagataaatttattacaaaaatatatttaattattaatttaataaaactaatttgataatgtaaatattactatatttgtctataaatt

SEQ ID NO: 67401 - DNA, 33431 bp, Oryza sativa
ctatgggcctacagcacgtaaactacaataaccattcacatgaatcgggcctctctgttaattatgcattccttcacttaaatgggtacacaatatatcaactgaagaaaagaatcttgaatcaatatttggatacagcgcatgaaattccagtgtaaaaaataataattcgagatatgaagggttatgtgcaggtttccacaaaataaatttcaaatttaaggccctctttgtttaggcttaggcttttaagccaattttttggcttgtatgttttataagcctgtggctttgaagcctgtttaatgatggagtcatacctccaattcacataagcaacaaaaactactccaacctagcatttgtcttaacagtgtaaagagtggcttatggcaacgaaaaagctgcttgtttgtttaggctagacctttcggctcataagctggcttataagactaaacaaagagggcctaaatgtgcttgcatatccacttgataggttcataggcacaaaataaataacaattttaatgtgacacaccactccaatacaaacttagtgcttgcatatccacttgataggctcacagggatgatggattttgctgacatgatgttttctgatgtttgattcataatggttatcaatttcagttcagtaatgtcaccttgcaatactttggtggcgaatacattccctcagcatagagccgtaatgcaaagcaatgtccatattctcatacctggtaagtagtgaaaataacaggcaaaataagcaaagctagtctgaagcaataacggtacataagaaatatttggaatgcaataatcatgtggctactgcaagctaaaaaaggtaaacattaaccatatttgctgtattcccatggcataccgtcaagtcaattgttttacacagttattgtcaaatctaaatatgaacgtgcataattagtgctagctcaaaccattgtgcaaaaggcaggccccacaatcagatggcctgattggtgtactgtatttgttcagttggtgggacctatgggctgaatttgacagggatcagacgatcagccacaggtatacatggtaatgtggggttgaatacatgaatcatttcccttgtgtgcagatcaaagaagctggtcccattaccatgtcctgaatttgggtttgttcaaacgaacacttagtttcgccttttcttccactaccatggtccgagtcccccagtgggcatggtgcgaatgctaaccattcccttcacggtttgattttttttatccccactagaaatggcataaagcaagaactggacataatagttattgcagtagtgttactggaatattggaataacgtcacttgttatatactgactcatattatgtacaatatcaaccataaagaaacccaggggaaatggtttgtaagtactttctgatataccttaactaactaatgaaatactgtaacatacgtgcatccagtttcgtaatttaaagatggaatatccatctagatgtcttcatatggacaactagttttactttaactattattgagcattaaatccagcgcgctaaatatggaacacatggccaatcaagtatacagaggccaaagaaagcgcctgagaggcaatgtggcaccaagccactaagaagcaaaaagagcaagaacagctaaacaaacatgatacggccaaatattttataaaaggaaatgaaataatgttctgtaattgtttacttgcatattagactcacccagaaattaaggtgtccaaaagatctttatttgcttctagatactcagatgcaactatttttgaggagacttgctgcctttgcaagtttgcaacaacttgagttgcatctttcctggtctgcaagatatatccattaaaataagttagccatctaaacagtagcaataagaacagtacatgtatcaccagtaccatcgcaatccaccaaaaacaaaataaagttgcatacctctaagttcaatttcggaagacaaataattagaagccgtaaagtgttctctctgaagaattcttgggtcaattgcacgcaagcctcagtcacaggttcagattcaccattgccataaagaattgacttcaactccctgatatttttgcttaattctgccatctgcataaacatggtcttagctgcccataacatataggaatatatttttcaagttcatatgtattgtttacagaataaattgacccaaaaattcataatagttaataatattgaagtaatcatttgaacatcattatgccagtgcacgtttcatcaataagctttatccataaaggcattattaaatgctaagagaacattccatcaactagcttttacaggcaaacacatagcggtaagtagtgccaaggattaaacagtctacatagtcgaggaggttatgaattttctcagcattatttaatttgagatggcatcttagtaccacggataagagccatagcttaatccttgtagatgaccaccgacacactgagaatcttacactgagttacaactgcaggccaattgattatctatccaattatcataattgcataaacagtcataattaagcagcctatgggtctccgtggaacagagaaatttcctgttcatgctgaaaaagatctgattcatatgaaattaatatcaacttcctatgaactgaaatgcatgttttcgaaaaatgccgtaattgtgtcatatgccaaaaatgtatatcatggagttacatagactaccccttagttttgtacattccggatcacatcgatataattataccatcttaatagtcacaacctcacggggaaaacaaatctgctgccaaaagcaagtagactaaactcatataccagcatatcgcaggctcgcatctattgcatttatgataagttacatcaaattgaaggaacagagcacgaatcatggctaattaggtaaaaaggttccactctcatgagcgatcggggacgaatgtgcgcagcaagggggatggggcagcaaaaaaaacagtaacaactgcgtgttcgatctcaccttctcctcgcgcttggcgtcgccgccgcgtgatccggagtgtaggtcgaggaagatgaggagctcccgcgtctgccgcacgacgtctgccggcgtccgcggcttggacttgaagaggcccttcatcttggcgccgtcgtccgctgccgctagcgccgcggcggcggcggaggcggaggaggctagcggcggcgcccgcggcggcgagggcaggggcgaggcggcgggcctcctccgcccccccgacccgaaggagaagcagccccggaacagcgccactggtcccgccgcggcaaaaccctcccccactgggagaacgagtacccacccctcctcctcctcccccaccgcgacggcccgcggcgacgcggcgagggttcgtggggttcggggtctcgcgagatcgtgacgcgatgcgcgcgcgcgcgcggcggcggcgcggcggtggcggtgggcggtggccgagatccccctctcctactcccctatccacccacccaccggcgcggaaggaggcaagcctagggctagggggcggtgcgtttctcgacgcttctcccctgtctccttccctgctccgcttttctcccaactttttttttctccttcgtttttaactgttatctttctgtgcgtgccaattctgtgatccgctttggattcagcggcctttgcctgaacacgaatcaacgcaatcatcgaccagagaaatatttccacctgtcattgggatcagcaatcaacggcctcgattatccgctgcggtagacatgtcctcctaggccatggccattcacagtgggcttaagtggcattcagcctccacacccaaaaacgaatattccatgccacatcgtcaaaccgtgcagcttgctcaggtccgagtagccaactttggctacgagttcttcacgtctcaagcgggacccacactatgctagaggatagaggggaaaggggcgaggtagtcgacgggctggaggaggaggaggcgagagcggggaaggagaagaggaggctggcgtcgccgtcgttgtcgctgcccggcgccgtcgccgctcgggccgtctcgccaccgagctcctccgccatcaagccctccgccaccaagctactccatcgctggcgcttgccgttcttcggggggaggaggagggtggtgcgcgggcgagcgccaagcctcgccgcccctccggttggcaccgccgccgcttggctgcttggccggtgatgcactcagcgctcgctagtcactacggtggggaaagaagccaggagagagaggggggagagaaaaaggtggtaaaagctggtaatggtgggacccacacgaagcaacttgcactgtaatacatgtagctaacattgttcctggtctaggtggcgcgcgaggctgagcaaataattgtggcgtattgtgaatgcccttagagcaggattaatagtaccacccgcttctggctccaacctcttccacgtcatctccatacgaattaagagacatatgatacaatagctaggctctaatactacacacattacatatctatactttctatatagttggtacccactaaagctaaagcttaacaggcaagcatgccacatcatcacccactagcaattattattctagctcatttaaaatcccatgcaagtatgccacattttcactcactagcaattactattctagcatattttcaaatcatcttccttatattattttctcaacatttcaactatcatcatttcaacaatatttaacatatattcatccgtgaatcccgcagcaaagcgcgcggtatcacctagttattttaatataaatgggcctatctatcatcagtttagggtagcatggatgtagcaaacaggtctccttgcgctgcacctgtggcccagcgtctcggagttcgcgtgcagcctggcgcttatttagtcacccgctagcgttctctcactatccttctctcctccagcacagcatgcgagccaacgtagatacactatcgccgacggatgaatctttattgtacctgctcatccaaaccgtttgaatgctgttcaatctaacgaagcaacaagcatattttggttgcgagattggaactaacgaagactaagtttaacttgacgcacgtcaaacgagaaaattattagtacatgattaattaagttttaattattacaaacttgataaattgatatatttgatattttaaagcaacttgtgttagaaagtttttgcggaacgtatcgtttagtagtttggaaaacatgctaacgaaaatcaaggtaaaatctaaatcttaacgagaaaagcacttttacaggcagctattatgaactctgtctttcagacgaactcaacagatagcaaatgctcaattatacacaacagggcagtaaacacaagttaaattgatgaattgagatttcaaagtacatagaagtagtgaaagggtaaacttgcagtattccactgaaagtatatactccctccgtcccataaaaaacgaatctagaactgaatatgacatattataatataatagatctggacagaggtatgatcagatttgtagtactagaatgtgtcacattcagtactagtttggtttttatggcacgaaggaagtataccccttcggttgtccagcattttcctcttatttttccttttttttagaactagtagcattcgcctccttgcacgggtaatctgagcactgctcccacagtccaacggaatgggaccaatcccatcgtcggtgttctactacagtctaaaaaagcgtgtccagttgctacaccgtactatatgcaagacgagatgaaaaaggaatactattctcgtggctctctcaactggtgcatggtactatgctttcgaggtggctcgtcgtacgggtgagtgttgctcctgtttacaactgcatccccgtgtaccatgaatcgtaaaaatggcttcccttcaaataccataattttaaattatatctgttaaaatgtcaccttcattggtcttcttaccatcggatttggtggtccaacacatcctaacagcccaatctaacaatttaaagggtagtggcaatggtaccaaactttgtcggctctcaaaaacgatcccgatgttgaggaagaagagcgatctcaatgaccttgctagccctcgagcttagttttaacactaatgatggagagatcatctgatctgctaaggcgaatgcgatcgcgaaaggcccatcggagataaggacgagcgatgttagttgaggaagaagtgtcgagctcaagatttggcgagctcctttgctaccattgccgcaatccatttatagtcatgttgatcccatgctaccccaagctctaccacctaccatgctaccccccaccattgttacaagacccttttttatgatggcatgatctcaaattttttcactgccgacaccatcactcctccaaccgatgccggacctcctccgccatcaccaccacaccatgtggacatcccttccctgcctctcctcaagttgatggtggcaagccgagcaaggtgtccctgccctcgctgtctttcccatctctaatagtccacgtcgacagagatgcccccaccttaaccattcgctttgctttgccctcatcatcaacactggctcactgctcggtaccgaccctgcaactttggcggcggctccactttccacgactatacctttaagcccatggcccatggaacttacccctttgcaccatcttactctgtccccaccccccgatacctaactggtctgttttgccactaccatcacctgagatgagctcatcggagcaggaggagaaaatcaggctgcacaaatctccaagtggatgggtgaattcaaaaaaaaaaagcaagatatgtgcttcgattttatgtcaaacggaagttagcaatttcatatttatatttatatagggttgggtttaggcacggtcgcatggcagctccgctcggatggtacgttttgttggtaaaatttgtcggttccttttcgatatttcaatgaccgagaaaattacttcatttattctaagatccaataacttctcgtattcaaaaattgtcataaaatagaacttctccacctactctcttctttcaaccaaatataatcctctacttttaatttctttaactactatctcatcttgacctagcacaaccattcactgtgtagttccacccactttcctgatagatctataatcttataaaacttcttataatttaagacatagagaataataagattaaaataggaaaaatatgcagcggaaaatgtgggataacatatgctaatatgtgtatgcaatggaaaatctatgaatatacaaatataacaatcaaaattatgaataagcatggatgaagggagagagagaaaaaaaaagctgaaacacaagtgttcaagctctaaaaaaaatacaagtgttcattatttttttcttgttctctgtttgtcctctctgccactagtgacaggatcgacggggatgtggaacaacatagagcagccatggttgtgatggatgcggtgaaaaagaagactttgttaaatttgattgtaattttcctttttgatatggtattttctgttttctttaatataagttagaaataagatgtcccaggatatctttgttaaaaaaagttctcaaaaaagtgcaagtgttcattattttatagaaaatgagcatttgcatttcttagatactccctccgtcctaaaaaaagacaaaccctgggtttccgtgtccaactttgactatccgtcttatatgaaatttttttataattcgtattttccttgttgttatatgataaaacatgattaatattttatgcgtgacttatctttttaatattttcaaataagacggacattcaaacgttgggcacggaaaccagggtttatctttttttggaacggagagagtagatgtttgatagaatttacgttggaaagaatgacaaactttccaatctttattctttctgggaaaaaaaacttgctcttcaatttgtagcattgggaatcttttgtaggaatggtgattaaattttcttctttccttttaaaaaaccgtgtaaaattcgtacatttcaagatgaacccaacaatctacagacctacacaaacaggagtgtggattgagaaagaaaggtaggagtattccatgatcacagcatataggttattgatgtgctactttcgacatccacatccatcagtatacctgtatacgcagacatgcatccgacaagatcaatatcgcttattgattgtattcaggactcctattaaaaagccttgaaaccatgagcaagatcgatcgacaaatggcatacgaacaacttcagaattggcaccggtgcactttccacgctgtcccacaccgcccttctaggtagtacaatcagatggtgtgggcagctgcctcttccaatcagatggtgatgacaagcatcaaatgcgagtgtttctatgatcccccaagacagatgaacgtactttttagcgtttaatcgacagataaatacgcctcgatgcttttggatggtagtacaaagacgggtgattttaccgtgttccttcttggcgaatttaaccgtttttgatcgaaatatagctgaaaaggaacgaagaaaccaaaccatttttttcattaagagtactgatatattaaaacagagcagctagtttgctcgtcttgcgagatctgatgacaagcctagaacaagaacagcagcagcaggagcaggaggaggagaacgtgttattcctctgaactagtagtaagtttcagctgagatccgacggctgcaaatgccccatctctttgcttcagaagaaagcacggcttccgtagaatactttgggagatttctccggcccaccggccatcggcttcttcgccgccgccgcggccgccgcgcccgagtcggcgccgctggagtccgcgtcggaagcggcggcgccggcgccggagacggccgcgctcttgtcgctgccgttgtccaggtccagcgggagcttcatcttggcgagggactccgtgaactgctgcatgctcttcatgtacatgtccatgatctccttctggtcgaccttgacctcctgctcgaggttgacgcggatgaccggcggcttatccaccgcgctctcggacatggcgccgggggagttcgccgccgggctggcgctgctctgcacggtgcgggaggactccacctccgcgtcggcggcgtcggaggcggccttctccttctgctccgccgacgagacggcattgccggaggagttggactgcggggtggccgggaccgcggcggcggcgggggactccgtggtggacacgctgctgaccggggtgtcgctccggaaggtgccggccgagtcggcggtgctgttgtccgtcgagaagctctgcacgacgcgcacgccggcgacgtgggtctcggcggtggcgccgtcgccgtcctcctccgaggtcaggaggctctcggagctctgcggctccacggcggagcacggcagcccgatgtactccgacagcatgatctggttctcctccacgagattcagatcggggaactcgatcttctcgtactccttaccgttcgccgcgccgccggcgcggtgctcctccgcgtcggccagggccggcttgggcgtcggcgagatgggcacgacctcaggcacgaccccgatgtaggacagctcgagctgcaggaacccggcgtgggagtggaagatgtcgttggtggagagcgggaactcgcgggcgagcgtgccgccctcggcggcgacgacgtccgggagcggcacgagcgcgaaccccagcagctggtcctgcaggtagttcttgacccggctcagcatccacacctcgcaccggagcgcgccgtcgacgtccccggcgcgcacgcccaggcgcagcgactggtcgaacaccgggttgcgccccccgccgttgatgacctgcgtcgacgccgccggcgccccctcccccggcagcgacagccgcgcgtacacgtcctgcttgtggtagatgcagatgttctggatgtcccgcgcgctctgcacgtgcacgtcgacgtacccgatcagctcgccgccgccggcgccgccgctcccgttcgccgccggcgcagaaaccgccttctcctgctgcgactccatggcaacaaacaccaccaccactcgcctgcaaacaacatccaaaagagataacaacgaatcaaaccaaatccacacaaaattgagccgaatttccccccgactaaagaaatcgaaaccggtgggagagcagctgcatagtcaaaatccgacggtaggtggaagaacagcacaacgctgaactgtcggcagatgcttacaaaaaagaaaaataaaacccagaaactgcagcacacagagtctcctcctcgtcaacgtttctcgaacagatggaatcactaccagttcacagccccaagaactcgattcaaccacacaaccactcaagaactgaagataaataaactcccggaaaagagagggcgatcgatgccgcgtaggtttccatcccaataaagggaaagcgcaagaaagagcacaaatcccagggaatccaagagagcacagaagctacagagcggggaagcaaagcaaatctgaaagcagaaagcacgagaggattcggcggtttcgcctcttaccttgtctgtactggagtactactcgagaactgaagcagcagcagcagcaagcacacaccactggttggaggaatgaggaatcaggcggaggagagagcaggagcaggcagcgtctactggggggctcgaggatataacaccaaagggggattagggtagtagcagcagattttttttttttagtctcaccttgcttttttttttctactcccgtacctaactaagcttgcttttattgccttgtttggctttagcagccacacagccctagcctcaagaaaattaccccgagtataccttcactcattcgttcaaaccactgtatctgtagaagtgtagattatagaattagtacgtgtacaggtagcttaaaaaggggtagaaagggaactggaaaaagggaggatggcctgtagaaaggtcgggaaaaaggggtcgcagaaagtccggggcaatgcagtgagctcagatcaggcgggtgcgctgtttctaggctatattttactcccgttttttttccacggttttgagcgatatggcccgaaaaagtcaagcaaaggcatccatcgactcgcctctgggctctggctgcttgtggcggcagcgcgtgacgggccgcaccaatggggcgcgtccacctgcagcctttggatgagcaggcgggcgtatttttttggttttcctaatcggaaccgtctcgtctcgagtccgcttcgtggccgcggctgcccgcgcctgcccgcgcggtgccggcggggggtgggtgtggcgtgaggggccccgccgcgtccgcacgctcgcgcggagttttcaacggggggatactggccctttccgcggccgccatcatgctccgcttcagtttggtggatcggtgggaagaggatcatctgacttattttttttacgtgattaaattgatacagagtatatgggttttctgaataacgggtttattgacaaggaccccagatagattatccatatcctaactaaattatatcatattaattagtatatcgattaataattagataattactatatattgtatcctaggaaattttgttctaggttcatcactggtcgttgtgtgagagacgtttgtaacccgacttttaaaattggataaaaactcgtggtttgctagctcattcggctcatgtctttcgattcatttgaatttgtcaacaagtttatctgagattttaaattgttaggtatactagcttttatgagccaaacaagctaaggcaagtatcaaactaacaattcaacaaaacattctgacacgaaaaaagttcacatagaactcaaaccttagtgtacgcgtcatcctcgttggtcacatgtagccttctcgagtctcaactcaacacaccccttcattcattttgtcatatcacagcattccgctcggtcatagctctgttagatggatctccctccccttgagcccaacggctcaagggggccttgacccgcgtcctgatcgggggcgcccagcccaatggctggtgggcccccgttacactgcgccatataaaagggggtggaggccgaggcagcacacgatacgaggttcgtcgccgccgccactccaccccacaaacactaaccgatcgagagggagcgcagccagtgacgggaagacgccatcgccgcgccacgcttcatcgtcgggatcgcctacgaccaccgctgccacgacaaccgccgccgtcaagcacaccgtcgccgccgtccacgtcaagccgcgacaacaatgacgatgttcagcgcatcttcctccacgagcacctcaattggtcggtatctaaaccctctcttttcatccacaatgttattcatccacccaatagagccaacccgactagatctatacctaggtgatcctatagacgatctaacaagctctagatagatattgctatgtgtttggttgattgtacgaagtatgaaactagtgatggatattctaatttgtatgttggtttgatgattcaattgtattcaaatatttgtaaacttaaattgatgttgattttaatcacaagcttaacgactcagttataactacaactagcaaatacacttttaacttattaggataaccgagtaaaaaaaaaaagagctggctcgctatccacccgtatccgtcctgcaccgtactgcaggacgtggcaagactcaagagggtacccgtcgcgtgagcggagcggagagacttggcgtgttgggcttgttggtacgcgtgcgtacgtgcgaggcggccgtccgtgcacacgcaggaccggacgaaagggattcggattattgatgctcgtgtgtcccatgcttccgagaagaaacgtggttgacatgtccagtactctagtgtggttgcgatcgatctgcttgaaagcaatctcgtcgtgccgatagcatatgaatcttatccgtctcacttgcaaacagttggtatttttgttagcgttttgctctctttcaacgggagaattaattgaaggtacttgcaatctgttacggaagttccaagttgaaaattcaggtcagagattactggaaagagaactgtcaactaagatttgggcaattccaactacaagatttgtggaggatataaatcaactttctactggtagggttttagtaggccttataggctatagctactggtcaatagactcgatactttcaacttatattacggttagtcttcaaccaagaattaggctcagcatggggttttcacaaaatcaaagctcacgtaaaccacgagatagagatcatgtgtgtgccaccatgtgaaattcgtcggcgtcattcctctgctcaaactcatggactatatatgtgcacctctcactacttctagatgtgatattattgatcactgctttacaccaatcaaacaaaaccagttatttcaaacaaatagatgcttaatagtcgttgcatgcatgcttccagacttccagtcaccaaactgatattgtagtgcagctctagagttaagaaaaaataactttctgagaactttcatggtgtttgtattccaaaaaagggtatatatccaacggttttcaatcacaggtatcatataaaaggtatttaagtattagtataggtacttaagtactaagagtaaaaatataattttactagtagagcaaaaatggtagaattgtctcccaaatcagaatcggtaccgcgtaggtactactatacgagttaacatttccccgaaccaactttacaggttcttatttgcgtattttcccttttgcgtggttttctcttgatttacgttgtgtttaagttaaatcatttagctagcactagcgttacaggttcttgtatgttgcatcattttatctagagctactctgtttttttatgttctctattacatggttttttctagagttacgttatgtttttataacccgtacatgtcaaccagatcttgcctcttgttcaaatgatcaaccatgctagatcttctttcttgaccgtgtctcctcgtaggtgcactgttcaaacactagaagaacatcataggaggagatatcgtttactatcccaaaaaaatccagtcccgtatataaggaatttatgaaatgtataaataactaatcaatataaagcttcggtatatataaaagagcaaattgcactggcggtccttaaacttgtaagcaggttttatttagatccacaaacttacaaagtgtgtatcgaggtccctaaacttagtttattgtatcatccctgtccaaagtctcatttgaccgtggtcttacctacgtggcatgacatgtcgatgacgacatggcacattattattattatttctttttttctcccttcttcctctttcatttctctcttcttcggactctttgacacgggggagctcgaggtggctctagtggaggaagaagataaaataataggaggaaaaagaaaagggggaaggaaaaaaaaatagcatgtcatcgtccacgtggcgtgccacataggtaagaccatggtcaaacgacactttggaccgggatgatacaataaaccaagtttagagatctcgatgtgcgctttgcaagttcgtgtatctaagtgaaaccttatgacaagtttaaagatcgctagtgtattttactctatataaaaaaagatttgagcgcatttattataaaattttactgtatgttttagttttatgtcaaaaagtaggcttgattaaccctagaaggggttttcaggtagattaacctagaaaatatatagaaacattactctagcttttgtcactcgatagagggagtagtaccatgcgaatctctcaagtaatcaaggatcatggcgatggaggaggtgttgatagtattttggagtttttttcagtatccgcataaggacatttccgatttgtgacctccatattgtcttttagctttgtcacaacatatgtttaaggtttggtagaagagggggaattgaataaacaatacacgctgtgttcttacacaagagaccacgatgagtaaacgactgatgagacaagaatatatatagtgtgtgcgagtggatatatatgtcaattagcacattttctttttttttcaggggaaacggtaggagctctaccaattgcaattaaggaggaggagaaaaacatggttttcatcttacaaacagggccacaagcgaaggggtctcaagggactccccgctagacacataagggaggtcacaaaagctttaggaaatgaatagcaacaagcaggagaatgcgttgaagtctcatctaagaattaagggcttcatcaaattctttgcacatgccgatgatggactcgacgacctgaggaaccatgttgtattttgccattgaagatcctctcatttctgccccaagtcatcactggtggagaaagcgtttgtagtcccggttcataaccctcctttagtcctggtttgaaaaccaggactaccaatccaggactaaagatcgctatctttagtcccgggtgaaataactgggactaaagatcgatctttagtctcggttggtaacaccacaccaaccgggactaaagatggctcagccacgtgaccggctgagccatctaccaaccgggactaaagatcgagctgaccttttttttttgcatggccctgttgctgcatggtttatatatataaaccatgcatatatatgtttcaatacatatgtatgcatatattatatatatatacatatatatttatttatttatattatattgtttcaatacatatacatgcataatatatatgtattatacatatatacatatgtatgtatatatacatatacatatatatacatatacatatatatatatatatatatatatatgtgtgtgtgtgtgtgtgtgtgtgtgtatatatatatgtatctatatatatatatgtgtatatgtatatatgtgtatatatgtatatatgtatatatgtatatatatatatatgtatatatatatatgactaaaatatatatttacattaaagaaaatgtgtacatgcatatagaaaaatagacaagtattaattacaatccattatgatgtcctaactagctacgattcgacgtagtagtagtcgttatctcagaagctaaggacctatgaattgtatttccgtcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaacaaatcgatacgtatgaaatgaaattttgaatttatttctacgtacatcgagctctcttgtggtgatgatttggtctgcaaggcagtggcaatactcgcacacgtagtagccgcacaagttagttccctgctttgctttgcgcactataaataaatgacaaacggtgagagatctaattaatatacacttgtatgtatttgaattggagattgaatataaatgtagagcatgtgtactcacaggaaaattgaacttccacctaagtctttctctctatttgccgcggaccaaatgacggaaccgataccaagccctacatggagtttaaagctatgattcgtagtagcaattaattataacaagattcttaattaacataggaacttatgacagtacctgtctataagttcgaaaaccttgtcaaacgtagattcttttttatccattgagtcatatacgttgacggtgcaggcctccaggtcgaagagtaaaaggatccagtggaatctgcaatgtgcgtgggatgcattacatatgaaacacttagcatgttcgtacgggaatgaaatttgttataggaagacagtaaaaactaactctgtgttgtacggtaatagtatgaacgtcttgtaatgctgcgccttcaggagatggacgagattgtcctctgtggcttgcggatactggacgagcattgcgacgtttactttccaagggtcaatgaatccagtatcgaaaaccccccgccgtcgggccctttgaatctccattctacaatgataaaaggaagtatatattatatataatctacttatgtacaaggacctaattaattaaaggaaacgtaataagaaatctaactgaacgatacttacaaaatccagcaactcataatagagacgtcgagggcgtccagctggtacagttcgtagatacccttgaaattgatccagagaatgtcatctccttgcaagaagtccgtgtccctgatcctcgctccgatcatttctctaccggtggcgctcatctccatgtacagttgatggaacttgtacatttgtgtgggtagggactgtagctgctcaggcttgacaagtggtttaccgagttcgtacatgtatttcacttccgccttttcgattggtgcgcctcgtagcaattgatccatagttagcccggtgtcattaataaattcttgtattccaaaatctacaccggtcaccaacgactcgatctcttggtttggttgctctccaagctgagggactggtttggactttccagaagatgctttcttaagtgttcgctcatagtccgatagctttatggcctccttggcaggtgcaaacatacacctgaataagttcctggcactcgagtatataggaatcttattttctagacttcgaggcttcaattgtctcctgacttctgatgccacataagcgtcaagctccttttgcgtgcaatcgtaccccgggtccttattttttgcggcgtcaactttcgccttcttcgttgcccttgtgggggcaggcggtggagcttggggggcccttgacttggaaggtgccggacgaggagcttgcggaggagtcggtgtaggagcctaaggaggagtcggtgcaggagcctgaggtggagacggtgctggagcataaggaggagacggtgcaggagcctaaggaggagatggcggagccggaggagatggtgcatgagacgccgcttgtcgcctagggaggatgatgtatcacttgcgccatagtataatggcgtggcttgtgtctcgtagatgcgtctcaccgtctcctccagggtaatccaactcgaggtcctcgtacgcgccttccaccaactcaacttcgaccttggagtatcctgctggaattggcctacagtggtaagtacctaaagggtctgttggtatggccatgcccgacgccaccttcacgtggtgagaggttatttattagtaatcaacatatataagcagcaacttgcggaatggacaaatctaaaatctataaactacgagtttacctttattgataagttcttgaagggaatatgcagctcacatggtgtccgctgagtgatgtcatcaacagggcatgtggtttcgtcctgggtttgcatggcgtccatgctctatgatcctacctgccccgttgaggcgcagctgctacgattgcctgaagggctcaccattgcaggaagaatggtcggctggggatcatgggaccgatgtgcggccatgcgttcatcaaccttccttgccacctcctcttgcatgctgagctcgtagctcgataccctatactcaagatctgtaatcttcgcatcggtatctctcttgctactcattcgactcctatacgtgtggatgtcctccttgaatccaatcttccaaggaatcacccctttccctcgtgttcgtcctggatgctctagagtctgcagggcgagtgacagctcgtccttctctctgtcgggacggaacgtgccctgagaagaggcttccactgcgtctgttagtcgacgcgcagcctcgcgtatctgatcgctgaagaccagggagccatcaactgggttgagcgttccaccgtgagcatagtaccggaacttcgatcgatccggccatttaacggtggccggttcgatacccctctcaagcaagcttgcctccatctcctcccacttcggcatcgcgacactatagccgcctgacccccagtggtgatggtacttcttcttggcggcattttctttgtttctttccatcatcgcttgcccttgttgacctgtcttatatgcaacgaactcgtcccagtgatcccttagctttgggaatgtgtcgaagttcggtgtctgccccttcaggatatatttctggtacagatctcccttgaagctctgaaactgttctgccattttctttagagtccaccttttcactttgtcctctgtacccgcgggaagggtgaatgtctcgagcattgtggtccacagcatctctttctccgaatctgggacaaagctctcatgatctctgtgtgcccttgttctgcgccagtacactgtactgacaggcacgttatcccgcacacccaaccgctgtgtcgtacgtagttcttggctgcttccgccggggcactaggtcggccgtcttcgtccacttccgttatgatgtgccgaccctctagcttcttcgcggcacctcattgcccgcgtgccctcttttgtccagcggagggttgacttccactagcctcctcctcctagttcccctccacatccctctccacgttcccctcctagttcccctccgcatccctctccacgttcccttcctcgttcaagtactggtttggatcctcgttcccctcttcttcgttccagtactggctgcttccctccgcgattttatcgtacagtatatgttactcatcgcgatcagccatctgttcatacaagaaatagttgctaagtctataggtcatttttgctttaataatcttatatgctaacaatcatatatgctaagtcaaatatgctaagtctaactatcgtatattagagccctacacaatcttatatgctaagtcttattacaaatctaataatcttatattaaaactcaaataatattgtattaaaactctaatagtcaactatgctaagtctaagtgtcgtatattaggaccctagacaataattatatactaagtcttattacacaaatctaataatcttatattaaaactctaataatcttatattaaaactcaaataatattgtattaaaactctaatagtcaactatgctaagtctaagtgtcatatattaggaccctagacaataattatatactaagtctaattacaaatctaataatcttatattaaaactcaaataatcttgtattagaactatgctaactcaaacaatcttatatgcgtcttattacaaatctaataatcttatactatgctaagtctaagtgttgtatattaggaccctaggtaatcatatatgctaagtcgtctaagtgtcgtacattacaaacctagataatcatatatgctaagtctaagtgtcgtatattaaatctaatagtcttacttgcattaaaaatctaacaatcatatatttacatcacttgcctgcgcgaattccttcgagggctagctaccactccggcttgagggacgacgacgacaacgtcttttctgcaacataagatgtattaggataaacgcaaagtaacatatattgtatttcacgttcgcattctcgttaagttcacgtttcgttcacgatcgttcacgttcgcgttctcgataagttcacgtttcgttcacctacgttcattcgttcacgtgcgttcacgttaacgtacgttaagttcatgttcgcgttcttgttaacttcacttttcgttcacgcacgttcgttcgtttacgtacgttcacatacaacgttaagttcacgttcacgttaggttcacgttcgttcacgttcacgttctcgttcacgtacgtttcgttcgttcatgttcgttcacgttcgtttgttcattcacattcacgtacgtttcgttcgttcacgatcattcttcgttcgttcacgtggcggcagcggagcggcggcatggcggcgcggctgcggcttggcgcggcggcggtgcggcggtggtgtgccgcggcggcgtcggggcgtcccggcgtcgtgccgccgcggcggcgtggcgcggcccgacgtcgtggcgcggcttcgtcggcactgccagcgcgacgtcgtggctagtggcggccgcatcgaggtcagagtcggcatcgtcggcgcggcggagtcgtgttcggccgcgacgacgtcggcggcggcgtcggcaacgaggcggccggcggcggtttggggagagagagagatcgaggtcggagagagagagagagggaggcggcggcggctctcaccccagagatgcggcggcggcggaggcagcgatgacgacgcgcgcgaagcaacggcgagatacgacggcggcgtcggtgcggggatgccctagggagtggcggcgaaggagaagccgagagagatcaatcggggaaaaaacttctaagtgttggtggagaagacgagggtgcgcatctggaatatatatacacccctagatctttagtcccggttgttctcaactaccgggagtaaagatatctttactctcggttgttctcatcaacggggactaaagatattttcccgctatttccaaattctttttaaacccggttagggttaagaaacgggactactgataagcgcaatgaatattaatttccattacatatgtgtttctaaaatagaaaataatgcattaaaattatttaaagtcgaaaaattaatgacaattacttcgaaacattattgttgtctatagtaaattaagtggataaaacgtaataagcaaatatatgatttaaaattaataaaaattctaataaccatatatacttagcatatgaatgatattaaattgttaaaaattgtaattaacatatgtatatacatacgacatgcatgatttaaaattaataaaaattctaataatcatatataattagcatatgaatgatattaaattaattgttaaaaactctaattaacatatgtaaatgccacatgcatgatttaaaacttttaaaaattctaattatcgcatataactagcatatgcatgatttaaaattgttaaaaactctaagtatcatatgtaaatgccacatgcatgatttaaaacttttaaaaattctaattatcgcatataactagcatatgcatgatttaaaattgttaaaaactctaagtaacatatgtaaatgccacatgcatgatttaaaacttttaaaaattctaattatcgcatataactagcaattacatgatttaaaattgttaaaacctctaataatcgtacgtaattaacatatgccatacaacaattgatttatacggataatcaatacatccaaaatagtttacatcgtgtacacaataattacggcaatacatcggcggtgacggttgaccgcacgtactttctcctcactattgttccctccttgtgatcgatatgtgagtaaggggtgtcttcatttggtaggaggatgctagggtcaatcgtcaccgtgaaagggggttgcccatccaactgatcataatcctcgtcggtcttgtcctcaactccgacgatttttcttttgcctgggagaaccacgtgacgctttggctcgtcaggccctctgcccttctttcctttgctagacatatccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtccttgatggcaccgtaatacgtgccagttgttccatcgtgtcccatggcatcgatacgaacaacgctattttggttcgtgctctttatgtcttgggttctcgtgtagaatgtgtacccattgatctcatatccctggaatgtcgcgatcaacccagatggtcccctagtcaggaaggccagttattggttgatcgtctcgttacctatgagatgttgtcgtagccacgcggggaaagtatcaatgtgatgccgtgtaatccatgcatcggacttaccgatgtttctagcgcgaactagagccaagtgctcctcgatgtaaggagctaccaatgaagattgttgcagaaccgtgaaatgggttttacggaataaattgttgtctaccgtcattattgctttccttccgagagttccctttccgtatagtctcccttcatggcgtgattcaggtaccccgattgggcgaaggtcttcaataaattctacgcaaaattcgatgacctcctctgttccataccccttggcgatgcttgcctctggacgagcacggttacaaacgtacttcttcagaacgcccatgtacctctcgaaaggaaacatgttgtgtaggtacacaggcccgagaatactgatctctttgacaaggtgacaaagcagatgcgtcattatattgaaaaatgaaggtggaaatatcaactcaaaaccaacaagacattgcaccacatcattctgaagggcttctaatctatccagatcgatgaccttctgcgaaattgcgttcatgaaagcacatagctttgttattgttgcccggacattgtctggaaggataccccttattacaactggtagcagttgtgtcatcaacacgtgacagtcatgagactttaggtcgttaccatcagcatccctttcctcctcgcccgtttgatttccttcaaatcctgcgtactgaccaaagtccggaatattgtcgtcttctacttcatcttcttccatttcaaccccttgctctccgtgggatgtccaacagttatagcttggcatgaaccccgactcaaacaagtggaaatgaatagtcctggatgcagaatactccttctaattcttacacttattgcatggacaacaaataaaaccattatgcctgttagcttcggccactctcaaaaaataatgcacgccgtcaataaactctttggaccgccggtcagcgtacatccattgccgatccatctacatgagatgaaaaaaaatcatacacaaataattattcttacaataatgacagtcatacaataattataaaataattacaaactctttcaacagtcatacaataatgacatatcattattcatacaaaaattataaaatattacaccaaataattcttatttactatttctaaagttttaaactaatattaatgtgttgtacttcttttaattttcattttagttttttttctattatttcatattaactttcactatattttccttctcaactattttataaaaccttatttagcaaataaactaaatttctatatattctttcttccccacacaaattttctctctcatcaacttacaactaaattttggagacaaaatagtgtgcaaaacatagctccaaatgtaatatgacaaaaaaacattggaggatgaagttgctaaccttttagacacctccgatttgtacataatcaccaaaataaatttactagaaattttggcatgacctcccctcttttttgaagaaattttgaagcttgctcaggtagctggaggaggaagaagacatatatatatataggggtgggactttagtcccggttggtgttatgaaccggggctaaagatccccataatctttagtcccggttggtgttaccaaccgggactaaagatcccgggggggcctgacaggccctgacagcatttgaactgatctttagtccggactaaaaatcaaatatgcccgttaccctttttaacagggactaaagatcatctttagccccggtttttattgcaaccgggactattgtggaattcggccgaccgacgaaagatggtttcttcaccagtgcatgtagatgaagagaccatcgaaatcacgcctttgttcttttaccatttctcttctgcaaacctcccaccatcctatcatgtcaattggcacattttcctctttggcgttggagaggttgttaacttgctataacactgttggagatgatacatggtgtggtacatgtaatcgttgttagccatacaagctcgagcttacgtatagagatcataatttttatttggcattgccttgttgaccgtccaacataagcataacacttgcctatagctccatcgtttacttatttgcttatcaactgttgcaaaattttgaattttagaatctagttttaattaaagttgattttaagtttttttttcaatcgtagtttcttttccaatattaactttttaaatagctaaggaattagggaaattttataattcttgagaaaatacctagaggtatcaaattttacactaaaattttggtacctcagggtacctagtacctggatgtatcaaattttacactacaaaatattgcacctcccgtgccttctcaagaatgataaaattaccccaaaggaattatattatgtaaattcttctaatctaatcctctaacaggggctgaatctgactaacagaatctcaaaagtgaaaacctctgattcttgaagctagcccatgtaacctttagcatgttgctcaaggcatgcgtgcgtgtatgtaatggatgaccagaaagaaagtaagggatggcataaagttgtacttgattgctacccacttgaatgtagtagtatcttgcattcttgcttgtagatccaatgatagaagttgcacacttgcactttgacccagatgtgctctgccaatgcagcccatggttttaacttgctctcacactacctgagccagcaatgtttactaaggctgtccttagctccacgctaaaattagaagtttgactaaaattgaaagtttgaagaaaaaaagttaaagtttatgtgtgtagaaaagttttgatgtgatgaaaaagttgaaagtttgaagaaaaagctgggaactaaaccggacctaagcaagaagccaaagcctcaccaaatacccgaaggctacattcctatagtcataagagcaaatacaatagcagactattagctagttataaacatattttaaagagataaaatatgagagagaagtgtagcgggctacagatctgtagccaactgtagcacggactctaagacgtaatgtgtgtatgacaggtgggaccatgtattaatagtatagtaaacaattactgtatgaattggctattaaattgtcaatagatgatttggagctagtagttagctatactattaaatttgctctaagttgcagaaggagagcatgatgcggcaaaacaccgcaaaaacccattgcactttttaagatcatgctaagaatttaatgttaggttcaccataagcttgtcctagtggcatttgttttattgttgttatctccatgagaggatgaaaaacactcaccatcttctaaacactcactatcttcaatgtcaagaatatatatcattatcagatagagctccattcagctggttcctctaggtccttttgcgataagtctgtcattaactcattatcatcttcaccatagttagtcagtcctattatagtttccagaatatttgtcattaccggagatctatttgtattccatctcgatcgtatatttgacctaactagttctctattgatactgtggatgcatattgtatactcccttcattttaaattaatctacatatagtttttttaggttattcctaaatgatctatatttttgtgttaatttattaagtctattcattatttgtgcattggagtaaatggatattgatgcatgtatccatgcacacaagtatttataacccacatgcaatatcttaatttgctatgatgcatgcatccatgcacacaagtatttataacccacatgcaatatcttaatttgctattggctagcaaatagtggagatgatgcatgcattgagtttgttgctagagtaaatatagtatgagagaattattagcttttttttagtcttagtgtacctataaaatatgtaaatcaacttggaatggagggagtatttcacaatatccaatgaatcttcaagtaaaaaaaaatatatttgagtctatagctagtatgcatataagaagatcaaccatgtggagtcacatgtggggcagcgtttgggcctgagccccacacatggcaacaaatttcattgaaaaacactcaattttacatagtctttgaaaataaaattatatatacttcagcccaacgcttgataagatgctgcctcagtgcctccggcctccaataagagctatcatctatatttgaaatgtggcttactattaactatctatttttacgataacaatctatatacaccaatatttttaaatgatgggtttaagaaccgataagcagctcattaccaatgacgtattggctgtcaatgatagccaacaccatacgattaccgtattttgaactaaaaattagattaagcttgtttgtttgctacaatagtaaatatgggcaagattttggaaatgccaatattttgacaacatattacatatatgtctcatagaaaaaaaatggtagaaattaaaccaaacattaccatccaatattttgattcaaaattaaacaaaccagccctctactctttgcaggtaaccagccctctactctatttcttttcttcatccaattttttttttttgattggggcgtgccttccacatggttcatcaccgaaaattacggtgaaaacagttagtaacggagcttgagcatagaccacgtggcatggtcgactgctcagcatataatatagacatactatagtggtatatatatacctccctcatatatatattaagctttcttatgtgatgattagtctaagagaaaaaaaaatggtcgctttcgagtggattgaatgcgtatgctatcctcgcccaaccgttccggtcgtcgcgattgtcacagctggtcgagtgacaacaaatcctgataatgcaatgcaggacgcagtcagtgagtcagtgacgctttggcttgtagcctcgttagtcttttgcttacatggtttggtctctgcactcaacggaagaaaatgtgtcctgcttctaccttatcagattcacagtactaatacatcacattatctattatgacagtattattacagacaccaacgtataaaacaatatatagaaagatataacctatgtaccagtaattgtaatagtattaatattattgtagagtatcctcacccggttgctacctgctagttggttgtataaggggcacgcagatggtccatgtgtacttgtatggaccgaccttaatttgccgatactacaaaataaacttattaactgcttgatcaattaaacgtacgacaaaaaactgaagttactgttcttaaaagaaaaactgaagttagttgaggaatccagctgcgagggctactacagacaagtagaaactgccatctgaagagtgagaacaacaactaaacgaggaggaagcaagcatgcacagcgaccgtattcattcgagaagtcggcgtttaacgcagcattcaacaaagttcgatatgcatgcacggcccgttttaatgcatgcaagaataggtctgacctggacgttggtagttgaccctcttgaaagattttgatcctagaccggggaccgtccgttaattagaggcggctacaagctactgacttattaactatactatggccgagtttagttccaatttttctatcacattaaaattttcttacacacataaattttcaacttttccgtcacataattccaatttcaaccaaactttcaattttagcgtgaactaaacaaacaaacccaggcatgaaccaaacttccaatatagtactgtacaaggacatgaattgaaacaaaagagattatattttagatttcatttcaaatttcagagttcctccatcgattgtctgtttaacagcaagaactttaaggccccctttgattcaaaggaaattcatataaattttagagaattttattcctataggaatttttcctatatagccctttgaatcaaaggaatttatcttatggaatcctatgaaattcctatggaatgtcaaatgccatgcaagttttggaggaattctaacatgaggtagaacctcatggaaactttcctttgaatccttatctctcctctaattcctgcgtttttactgcggtctaatcaaatggttattcctgtgtttttgcaattctctgttttacatttacattcctatcaaaatcctacgtttttcctatttctacattttcccattcctgcgtttcaacggggccctaagttttaagtttgaaattttgtcgaacggaatttcgtaacaggccggttactactggatttcacccgagggtaatagttctggtctctgcctccaatcagggttgacaataaacaccggttactacgttaatcgggtttattgtcagggtacggtaacggtaaccatgcagtgatcccaccaatccaaacagattttaaaaataatttaaattttcatacattttgtctgactttttacagttaggtacagtaaaccctgctcccaacagcagatgagttgccgccccaccactccacagtagccctgatggtacaacgcagctgcattttctcgcggcgcacatggccatgccgttacggcccagcaatcatgcatgcgcatccacggcatccctcgtctccgtgccggaaaaaagacgcactacgctcgcggtcgcggccgccggcctcgcgcgcatatgctgccaatctagcggtggttcgccacgccagcgagggagtcccatgtcccgacccccacgccgtcgccgtacgcgcacggtcgaggattgttttctctcttcaagttcaggtaggaggcggctcccgtgtgtgtcgtttcgttgctctcgccgagtgctgtacagtctgtgaacggagagagagagagagagagagctccatggattcatcagtcgggaggagggcaaaggtacggggggctgtgtcgtgtactggagtactatgtattttacagatcacggctcaatattttacaggtcaccagataacatcagacgcatattctatgccttgcggtcggctgtacatcttaaattactactactatccttataatataccctctccattccatttttattagatgctccataatataagtcatacatgccagcatacaattaactatgacatcttctccattaaattattattatttttaaatcctccactctcatgctatctaattctattggatgcatacattagtatttattaggatgatccaaactacaaaatgataataattatttcttggtctttaggttaatggtggttgtgccttatattttggaatggagggagtactagtaaagaatcgaattggacatatcccatataatttatagtactaagatacgttcaatttgattctaatttactattttttgaatggtctattcaaatttgtagtacaagcatctaatcagatgttagatagttatattttaatacgaaaggagtacgcaactactaatagtatagaaaacgatcaaatttagcacttatctcaaagtgaagctggttgctgattgttttctttctgtaccaggctaccagcacacaggcaataagcccgtatgatagtactacgcttctattgagatatccatgaatttatgtgccctcgctgttgcaagctgttcgtacacagcagagagagacgagaccttgataaaccacaggcgaatttggcttgcttgttgagtttaatggccaggccgcttaattaagacttcattttgatcggtcaaatctctacaggcttaagtactacacattcgtatcgacagcgaaggatgaagcagatcgaatcgacgtcaccgtcacatcctggcatgcactagaactgaaagccacacacagggatatctcccaagagcgagtcatatgaccaaactggatggcgtccatagactgaaaacgcctcagatttttgctactatctggtttgtttcgtcagaaaggtcatattctggtgcaaatgtgcaggctgatggagaaaacttgaaaacttctctctgaacacggggccaatcatttagcaagggtacaggataccgggggggccatggatacaatagctatcctaaaccaggccagctagccaagacaatgacctgagatcgtgcaaagttgcaaggagatggatgaagtctctctagccacacacggttcacgaactatcttgcagcagaacaacagccgttgctatcatgattcagctagaggtttattcatttttggttcatgtgttgctgctctgattgatagaaaccaacggtacacgtagggcagcctccattataataagtgtcgttgttcatgacaactagtagcaagtaaaatggtcggccagatcgtactcgatgctcccacacaaatacctgacaatttagactgatcatgctttgacccacggtagtttctaaactatgtgattacactgtggagtagtatcaaagtagcattgttagatttctaaccaaaagtatacttcactcttgcattgcatactactcaaaaaataacggttaaaatcacactcgtcaaacgtctcgacacaccgtcatgagttacgtttaaaaacagtagtactggctttaacattgatcacattaaagttgtatgctaccaacatggccaacacactgccaggcactattcatgattgatagacagctgagtaaggtgccatagcgcagtagtgctatcctgagtcctgaccataaccaaatttgcaacattatgtgtagctgtatgtaacccagatgctgggagcagcacttccagaggtaggagtaagactgaatgtgacacatcttaatactataaatctagacataatcatccagtactagatagcaatattttggaacggatgaaatatacggttacagaaaaggtgagtattcatagtttgatgcatgctaaccaggtgaaattcaggatttgccagacctaaagttggcatttcaagctttgcttacctcatgtctcacttacacgcgcgggtcctgatcccacaagtcatggacatgtgagttgttgagttgagtatattcatcacaattgagaatatcttgattcaacaggaaaagaaaggaaaccacatggagcaaagagaataatgaaatatttgcaaaataagtcacactagataaattggaacaggggaattcggactccaaaccagaaggaaaaaagacatggttgatgatccatcattctcctataacctttccaagccaagcaagcataccaccctagcatcctgtacacatctaaaattcaacgtcaccttagcagttaccaacaatccaaaccctctgtccccaccccctggatggctggatcctcctctcagttgatgttagttataccaactaaccatccgtcactcgcaaaccacatttgtattcacattaccaaaccaaagccatcaaccgttatttacagatgatcatctctacccctccttacacagctactccattctccaagaacagagcacacgaggttaaataagagcgaagcatactgcgaccacatgattacagcattacctggccaagctcgaagctgccacgggttcaaccctgcagccaccacctccttgccgttgctcgcggagatacccaagcaaagtttcagcctgcaaatcacacagctaaacataagtgtctccaaaatttggaagcagatttcagattcagtaaatctagatagctaactagtgaagcacacattcgggggtgctctttccaatccgactgtacaactaggcagataaagcacgacaggctagactatggtggcaaaatgataattgtcatataaataattaatatacttattgtttactccctccgtcccataatataagggattttg

SEQ ID NO: 67402 - DNA, 632 bp, Oryza sativa
agaaaccaatcaagcgagacgggattaagcggcagctctacgttggccttagcattgcagaactgcaggtcgcttagcttagcgcttaggcaggagatagcgagcgagggaggcagtggagagggaagctagagggtgagaggcgataagaggataagggatatatagctgcttctagctagctagcaaagctgagagttgcagcttctactaactctgaacctcaagcactgttttctctgcagaacggaataggacaaagggtgaaccggtgaagtgtttggtgaattattttagtctaaattaatactacctctgcttttttaatagatgacgtcgttaattttctgccacacgtttgaccatccgtcttattcaaaaatacgtaattataatttattttgttgtgagttattttatccctcaaaatactttaaacatgatttatatcttatacttctgcataatctattatattattaaaacagccttaaatgaaggcaccactttgccgccgtgggggctagaaattcccacattaatcggagaaaaagaaaaggagagtccaaatagaaatacaatttaaaaatagctgaattcggaattaaaaataagtaatattgaaagaaaac

SEQ ID NO: 67403 - DNA, 660 bp, Oryza sativa
aggaagaagataacctatgcaagtcatgttggattgtttagtgacagatagctaatatctgtagtgtatattctctatctgtgattttcccatttcacttctattggttcataaaatatggggacggtcataggtagcaactaggttgcattttagtgctgttgttttcatgtccatgctttcttttcaggcttgtaggttttctgccattattgagcttttccatggccactgcaaacaatccaggtccccttgacttggttccaggtttttcacctgaagacatggacaaccccattcataatggtaattgcctttgcattttccctgtccttttaggttgtcaaaacattgaagtaatgtttgctttcttttctttttcacagctgccttatcctacgtgtcatatgatagatatgtgttagatacctctgaagtgtattttgatgattgcatcccattggagtcttatctgaatattagaccaatggtgacttctgattcgtatcagtttcgttcatttggggaaactaatccaagtgtgacttatctggttgcaacagagtcatgtaagaaagtaatcagaactatgctgaaaggactaaggacaaatgagtcgagaaatttgcgttttttggatttaaacatttcaaacatctt

SEQ ID NO: 67404 - DNA, 708 bp, Oryza sativa
caacggcagcataaaggccagccgtgcaggcggaaacaccagtcggcagcggcgaaggcaggccggtcggtgaagacgtagacgcccaacaacggcggcataataggccagccgtgcaggcggaaacaccagtcggcggcggcggaggcaagccggtcggtgaagacgtatacgcccaacaacggcggcataataggccagccgtgcaggcggaaacgccagtcggcagcggtcgaggcggccggtcggtgaagacgtggatgcccatgaacggtggtgtgaccaaccaaccgtttaggcgaggacaccaatccgcggcgactgaggcaagccggtggtggagtcgtaaaccgccaacaaccacggcttaataagccagccgtgcaggcggaaacaacagtccgcggccgacgaagtggccggtccgtgaagaacttgattgccattaaccggtgtgtgaacaaccaccggttaagcgaagacacaattcggcgggaacgaggcaagcccgtccgtgaagacctaaaccccacacacgcgcggattataaggccagcgtggaagcggaacaccaattggctggcggacaaggcggccggtcgtaaaaacttacaccccacaaccgttggattattaggccaacctggaggggggaaacaccatcttggggttaacaaggcgcccgttgtggaaacacttaaaccccct

SEQ ID NO: 67405 - DNA, 570 bp, Oryza sativa
ttcatttttccatcttgcctgtactgccacatttgtactgatgaacctttattgaaagaaaaacgtgaacagcctgaactaactgaatgttgatagggtgaaatggacgttgtaacaaaatagaagtaaactcacgccactaaatgtacttcgagttgttcagtgctggttgttttgtatatttaatgttactatgcaatctgccttgatttttgttgcatgcagtttgtgagaagcatagtggattgaaagacaacaaccaggaaatttcaatcgggagtgagatacctgagaatgagcagggtgctgtaaaacaagaattgctttgcgtgctgacaaatccgagggggaatgaatttggtattgacaatttagaaggaaatactgagacagttcatcaggctgatctcaataatggatggaattcgatgccagtggaagctggagtgcatgcctctgaaacttcaactgagaacaatgaggagtggattcagccaggtgagctgagccagaaatcgaatctgatgccgatatactctagggagcatgctgatgaagaaattaaagagg

SEQ ID NO: 67406 - DNA, 861 bp, Oryza sativa
tcaaagaatccacaagaggatcttatgggaggtaaaggtaccactaaaaatcaaagtatttatgtggtttcttcacaaaaaagtaatcttgacaaaagataatctcataaagagaaattggaggggaaacaagcaatgttgtttttgtaatacacaagagaccatccaacatcttttctttgactgtcatgttgtacgttttgcttggcgatgtgtcttctttgccttcaacatcccccctccccacaatgcaaaagatatatttggtgactagctaaggggagtgcctagacccacaaaaaaaatgattttatttggagctagtgctttatgttggtcaatttggcgttgccgtaatgatatagtttttaaccataaaaaaatgcctaacatcatgcaggttatcttcatgtgttccaattggctccactcttggtgtatgatgctttcacaggaacaacaggatactatgcgcaatggtgctacacgcttggaaatagtaagagatcgaggcgaagcatatcttgattcccagcccgatgcagtaatcctggaaatcggtgctgatgaactgggagccgttgtcggttatgatgcggtgcgatagtccgtatctgcaaaatatccccttgatgaatttgatggcgttgtcggccttgatttccccgtgggtactgcttcgatctacttagtgaatttgtcgatcgccacgaataggaaccctgttaccgccctgtctcgttggaatggcccgagtatatctagcgcccagcacgagaatggcccaagtagagggatagtctggagcacttgcgccggtagctttgtgtgtttactgtggaattgacaagcttcacatcg

SEQ ID NO: 67407 - DNA, 2505 bp, Oryza sativa
  unsure (1)..(2505): unsure at all n locations
ctcaacaataatcccttttttgcctccctgaacattaccaatagcaagatcagtgatgcatctgtcagctgctgtagctctctgctctgaattggaggattgaagggagaatctgttgttacattgtctgaatttttgtgatccatatgctgaaaggacgtttcatggcggctgtgcttcttcctttgctaatctccaggcaagttcttgtttttctgcaatggaaatggaaagctctgtcctgcctgaggaacataaactaacatgacgaatnncaggttaatctgaatttctgaacaagttcttgttgagttcatgctgtaaaaagaacatctttttgcaagctgaacactccctgaaaatgcaacatttgcacagccactacattcaccctgccttcctaaccaaccatgtaattttttcctgagcaacagaaactaaaggttaataatcctttttatctgatggagaacggtagttaatctgaattcctgaacaagttctggttgatttcatgctgtaaaaaggaaaaaaaaaataactttctgcaagctgaaccactcctgaactgaatgcaatgttgcacagccactacatttcaccctgacttcctgaccaaccaagtaactttccagtagcaaaagacagtgagatgcatagctaaattacttgaatttcagaagagagtagagagggggagaaaaaaagaaaccaaattgctatggcttagaatatagataccttatcctggacccaaccaatccccacaacgcctcgaaaatccccctcctctccaccacaaaccctcgcattccccccggccccaccatatccgccacgtcacctcccgctatatacccaaaccaccatttacacgagctcgcgagatcaagagagcaccaccactcgatcgcagcgagacccaccctcaagctccaagctccaagaaccatggccgccacctcgctgtcgccgccgaccgtggccgggctgcggctggcgccgtcgccgcgcgtgcggtcgccgtctgtggcgttcagggcggcgccggcgaggaggaggtcggtggcggcgagggcggagctgagcccgtcgctggtgatcagcctgagcaccggcgtctccctgttcctggggcggttcgtgttcttcaacttccagcgggagaacgtggcgaagcaggtgccggagcagaacggcaagacgcacttcgacgccggcgacgagcgcgccaaggagttcgccggcctgctccggtccaacgaccccgtcggcttcaacctcgtcgacgtcctcgcctggggctccctcggccacatcgtcgcctactacatcctcgccacctgcagcaacggatacaacccaaacttcttctgatcattctcatcttggatggatgcaatgtaatctgaatggatctctggtgtttctacgtgattatgtatgagatgggtaaaaaagaaaagaaaaaaggttgattaatttggaacagtagtgcaatcgcgtgtgtatattggccgcatgaaatttgtcagtttgatgatctttctctatgctcatgtatcagttactttcagagtttcagacttcgtatgtgtggcactggcacttacccagaaactcacttaccagtgctccatgattcatgaattgcaatcttgaatttgcaaatagagagcaccaggcacagaaaagtttgaaagtcagtatgaaaatatgagactgattttggaacctatttccaatttcaatttatacggtctgcaaagaaatacatttatataggaacttttgacatttacagaatccagataatcgagaagtacattggtgattgaagtacagtaaagataagaagagattactagcaaaattgagttgatgttacagacttgaaaaattatagggtgaccaatgcttagtaaattacaataaggaacttttcaagaatgcctacacaaaggctcattggcgccggattttctaacctcaggtaggtacaaattcagaggaagagggccatagccggacgaggaaggttccgacggcgatgaacagcagaacaaactggacggagcaaaacagcgaagctctgcttgctcttgcctgcagcttcaggatttctgaagtcctagcaagatctttgcactgtgcctctagcttctccaccatctcctctagcatcagtgccctgttctcggtgtgccgtagcttagcttcaagctgtttgtgatcctcaggtagagatttctgaatgtcaaaaatagcagcttgatcctcagtcaggggattccaagcttgcgatgctcttgtcaggatgaagcattgagtctctgcttccatcttctccaggaacagttgatccatatcagattgcagagacagcagctcggtattgcatagaacatgctgctttggttgtttgtggttgagcacatcgagttcaagtatttctgaatccttatcattgatgagggtagaagcttcgtttagcctagcctcgcg

SEQ ID NO: 67408 - DNA, 3832 bp, Oryza sativa
cgctacacttccaatctttcatggtgtattcttctatagttaatttaaccagtattatatatttatcttttggaatttgagagattcccttgtcttgaggttttgtggggattctaggcccccatagacttgatgatagtaccaaacacttgtacttttactccatttcacagggtgtgtggattcccacatctggttcttctacttagtggcttcgaccttcaacacttctgctcggtggtggccatgcgagatgatggtgacgatttgaagattactgaaattcacatggcattatggttctatgtggcaggaattcttgctactatccgttctatcgtttagtttttctttgagaacctccacttctgttttcttgaaggatttttgaactcttgctgtctgtcatgttaaaccagtgatgttttagtcaccatctatattatgttaatggagttttcatggctattattatatccatggaaaattttatcgctgtattagaaattcatacggttcgattacatgctagacctcttggagagtggcctgaaatctttgcaaaagcaaaaaaaatgtggtcagtttttgcatagaggtgtgatcccaaccaggatgtgagataagcttgcatgaggcccatgctgttcgctcttcttcaaccaaagtttgagcataagagtacgcaaaccaaaagtgaaatcgttttttccgaattcgtaatcccgtagcaaaaacgtattcctgggagaaacgtgcttctaggccttgtgggtcatactgggccttcctcttcctcgttggtagatatttctaatatttttatccatctcacacatattccaatataaaaaaatatattcctattttatcgaatcacaatacaactatttcttactttgttatctatttccaatacaattaattttttactttcacaaattttgatgtaataattactttaaaaataaaattatttcagaacaaatgtaaagaattaaaaatgaatttattattggacgaaggtagtatacacttcttgtcttttccctactaaaataattaaaaaaataagatctctttccctttcgaaaccaccgaaacccaccagcggcgaggggagcggacgccgaggcggcggcggggttcgtcgatgcgttcgtaagtggcaaagtttcgcaaaatttcgccttctctggagtgggtgttacttcggcattggtttctgttggttccttggcgacaggatgagatgtggttagggttcttcgtgtggttactgtggattccgggagaattttctgtcttggagtgggggagaattttgtgtgaattttaggttgataaatgaatagtgatggctttccttgagttgaggggtgtttgatcttgaattttcttgattgatcccacctgaattagattcagaagtaggagcatgcttatcctggaaattggctaacagaggagtgacactatgacagggaagaaagcgaaggaatgcaggagtggatgatattgtcagagtagaaaaaaaaagtttttcccccctcttttatgggcaaagatatgttagtaccatgaagcttttgggcagtcataaggaggagaaaggggtaatcttgatatggtggtgattagtttcttcagttccattgttcctctgtgatagttcattatctaaaaaacctctgtgatagttaaaattgacttgaattatattgcttaaatgtattaaatgcatggtttatacgttcctcgattaggtttgttctgaaattttgtgaaattattgctttcaggaagatctggtagatcctaggagcaaaccatggcttctaagaaagccttggcaatgcagccaagcaagaaaatttgcatgaccttgttgccgcaagacattgttgaactgatacttctgaggcttccggtaagcactctgctgaggtgccgtggtgtctgcaagcaatgggatggcattattcgggatcctcagtttgccatggtgcacatccagcgtgcgccgcgtcgccccctatttttctttcaacgagagaatttagtccatctcctctaccctagtgaagcaatcctctttgatgaagcatggtcaccatcaaaatgggttgtacctgtgatcgagcctgatgattttttatgtgcttcatgcaatggacttatttgtttacactcggataaatcaacaatcaagatagccaaccttgcaactggtgaatgtatgcatctagtaaaacctgtcaggaactcaaagactgatcacttctcttattacagctttgggtttcacccagtgacaaaacaatacaaggtaatgcactttcttcgtgacgagcacctccatgttggtactagcttcagcataattcaagtttacacactcggtgatgagaaatggagagatgttagaactccacaggctttaagcttgagatgtgtggaaagatctggagttgtcaatgttggtggggcaatgtattggctgactgaagatgaggaaagtgtttggaaacatgcagttgtgacctttgatctcagtgaagaacttttccagtggttacagctcccagcagttgatcctgcaaactatgtgcttggtgatcctgaccagtggctgattacagaggttgatagcaatgtgtctgtaagctattacgagacagggaagctgcatatctggacaattgacagcaagatagagcaaagctggagtcagaagtacaacattcgcttatcaatgcttgaagttccaggaccacattggatctgcggtgataagattatcttgcatgattttaataagaacctatatttctatgagttgatggggaagaattctgagattgagtcgagcaagttagtgaagcaattgagattcagcccccgcaacaacatgcaatgctttatgtttgtgaagtcgcttgtacggttggatgcattcagaaaggctggtgttgtgcgtaggccaaagcgacaggagggttggaaattgaagaagtgggaagtgtggatggataggctccatcgactagagaatcattgcagaagtatccatgatatgaaaccaagatttatgtatatagctagactttctttacataataggattcacgaatttttcttgatggtttgacaaattcctaactcatagttactcttttctgtaggaaaatgcagataaaatgggcatggagatcaaactagatttgcagcagacaccagatttggtaaacttactgcttctgcatcgaattggaagttgtgcagcttttcatatttctggtaaaaaatagctgtgaatatattgtaattaaaactattgcaattatcttgtgtgtgaatgctgcaggatagttccctgcggctgatcaactggttggagtataggcgggtactagagatattgtgtgttaatctcgacaacatgcatgaagtattaacggtatgtgggtgggctgatgtgtttacttcttagggtctctttgtttaggcttagttttttaagtcagcttttggcttatataatttataagccgatggatttaaagtcctaaatttaaggatgaaattatacctctatctcacataagccaaaaaaaaaaaacttctccaacctagcttttagcttaatagtgtaatactggcttatggctttaaaaaagccaaacgaaaaaactgcttatttttttagacttacactttttagctcataaaaacaaagagggcctaattataactatttgtggtttgtttttgtgtcttgtaaaactgacaaaatttacctatatttaggtcatgaacaacacaactggtg

SEQ ID NO: 67409 - DNA, 15052 bp, Oryza sativa
ttgagtttttgcttgcaacatttgaccactcatcttattcaaaaatttttgaaattattatttattttatttgtgacttactttattatctacagtactttaagcacaacttttcgttttttatatttgcaaaaaaaaaattgaataagacgagtggtcaaacgttgcaagcaaaaactcaaaatcccttatattgtgggacggaggtagtaagaactaagcaatgtttcttaaatcgaaggaccaagctaacagcaaaggtactgcagttttgacttgcagaagagtgaacgtgcatcctcttgtacctcgaaggtttagcaaatccaagactgtacctaagatatgtataattaataaagtgcatatctgcactatgtgaaaagaatctacaagtcaacaactagtgtactgcaaatctgcattgcgtgttagctagcatgatggttttcttaatagaaaccagggctgaattaaacagctttgataataatcaggtagtagaaatctacctaaactcaggtacgtgcacagtgaaccttttcctccgtctaggtttaatgtacttttcagtacttattataatggtaatcagacttcaatcaaactctaacaggtgaattcgttggatactgttcggtacaattatccaaaagcttcagtcacaccaaaagctcaaacccaaaatctacacttgaaaatcgacatactagaaatcttgcaaatcatacccaaatatccaatcccgatatgacattagcaaacaagaggaatgtaaagttgaaaaggttttaccttgtgcttggcacgggcagagccggactgcgagagcgcgacaagcggtgggatggcgccctcacggacaagaagcgcgcggttgcgggggcactcggagcagagctgcagcagcgccaccacggcgaactccctctccctcgccgggccgtcctcgatggtctcgacaagcgccggtatcccgccagcctccaccacggcgtcgcggccctcgacgatgcccgcgaggctggcgaggaccaccattgccttctccgacgtcccgctgccacgctcgccgacgaggtggatgagcggcacgacggcgccggcgctgaccgcgcgctccttgttccggcgcgccgagcagagccggtagagcgtggtgagcgcgtccttcttgccgcgggtggagcccgcggagagcagcgcgacgaggggagggatggcgccgcacgcgccgatggtggcgcggttctcctcgatgcccgagaggctgagcagcgcgcacgcggcgttctgcttggccgacgcggtgcccgtccgcagcgcgtacacgagcggcttgatggcccccgccgccgtgatggccgaccggttccgctcctcgagcgagaggttgagcagcgccgtcaccgcgctctcctgcgccaccgggtcggtgctccgcagcagcggcaccagcgccgggatggcgccggacacgccgatcagctcgcggatgtccgacctgtgcttcgccagcagccttatcctcgccgccgcggtgcgccgcgcgtctggcgcggcgtcgggccccagcgcccgcacgcacgccagcacgaacggctccacgcgctccagcggcgccgcctcgacggacagatccatcgactcaagctcattcagatccacggcgcccacctgcggcgcgtcggatctgggcgtcaccaccgccgccgccgccgccgcgagccgctcgagctcgccggagatatccgagttgaagctcgagtagtcactgaagtcccgcgagagctcgagcatctccgtggccgccgcgttggccgacgacgacttggccaccgccgcggggtgcgcgggccccgcggtggccgccagctcgctgagatggaaatcaatcacggagtccgtcaagttctccatgtccgagtccgcccccgccgcgtcgtacgcggccgccacatgcggcgagcccgggcaggagtccggctgcagcagcgccgaccggatggtccgcatggagtaccccgcgccgcggcgctgcgaccgcgccgccgcgcacggactctgccccggcgacgggatctgggagccggctagcgacaccatggcaggcaagggctaggagacaccgccagttgccgcaaagcgcgagagcgagcgagcgagtgatgatgaggagaggagggttgtgttgtggtgggtggttggttggttgcccgatgcagtgcagtgtagtactcccacgctgcgctacgctacaacccggcgcggcgtatatacacacgtacacgacgcggcagcggcagcatggctcgcgtggcgtcgcaacgaaacggaacgcgacgagaggcgtgcttgcgtgcgtggtggtggtggtgcggtgtgtatctttgtagtcgcttttgcgctcgcgtctcgtcccggggttgacgatacaggtgtcgaggaggctgggatgggttacccgattggtaccaaacctaggcgcaccagttcagcgccaacgtgcgatgacagttggggccaagcgtttctcgtgcagagctgtcagtggatgtgtgtgtgggagatggatgggggagagttgagccgcggaaaggtcagggagccatggcatgggcggccggccaccaacaccatgcaccgggtggttttacttttggtggctgtggaagcaaggaatcccctttctttccgtttgtttgttcctccccgtgccaggtagcagcagcagcagctctcgcgccactccgtgacggaccacggcctctcgcgttgctaccgccactgctgtagtagtacggagtaatgggcatgggtgttgccgccttggcgcggtgcgaggtggagacgtggaggcagcgggagcgtttcggtggggtttttttttcaccgttgggcaggtggcagcgacgtacatttggcagcgcggcgaggagtggggacgggacggtgttcacggtgaggaggtgggcgctttgcacgcgcgcgcgcgcgtggtcaaaaagtcggtggttgatcatggcgcagcgcatcggaggcgtttctttgattctttcaggtgcgcgtgcggtgaaaaaccgagggagtgggagtggggggaggaatttttttgagaattaatattatttttatggaaaatcgcaaaagtagtggtcaaccggggaaaatcgcgaaaataggtctctgtcgaacgggtgcagttcgatagggcacctatcgaacggccatagcgcgactggcgaggagatcggaaggctgccgttcgacaggactcgaacagcccccgttcgacaggcagggctgtcgaacagcccccgttcgataggctgggctgtcgaactgccgcagttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacagaaataactaaaagcttaatacaaatagataagtcaaggacgatcagtgcccttcgcacgcttgctaggtcctcccttcttcctacgcctaatctgctcagtgggatatgtcaaattatcaggggggtgcctatctctagctgtctgctgtggtgtcacgtctggcccctgaccggcctccgtctcctgcgtcggctgtgtgacctgaggtgctgcgtgccagtaatccatccctacttcctcctggggaggatcagtggaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcatgacttgactcccccgatcgatcaacacatgttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcatcgccaaccctttcctcccggccgacgcctcctcggcctcgtctccggcctgctatcccctcccctcgctccctccggcgctcacggcgacgatgtggcgactctcgacggcggctggcgatgtggtcctcaaacaaatcgaacaagcatcgcgggctggggagacggggttttaaaccggcctgtcgaatgcccattgttcgacagggtcggtggagggacctgtcgaacgcccccggttcgacaggcctggcggcgcggggtggtgggccctgtcgaactccctccgttcgacaggcgagcgtgtcgaacgccagccgttcgacagggctctgtcaactgcccgtcgttcgataggtgccctatcgaattgcacccgttcgacagggacctactttcgcgattttccccggttggccactacttttgcgattttccataaaagtaatattaattctcaaaaaaattcagtgggggagtgcgtccacgaacgatggcgacggcgagtgcgggagggggtgacaggtgaatgcttttgttgttaaccacacaatacaggacggtgatttcttttcaatctctttttttttttggctgcgcacacaaatcacgttatgatgttagtctagaccagaaatattgctaggatataagctaagcgtgcatatgagcaatggacatatcagcaaaccatttaggatattggttgattaccgtgtaaaactaggcttcattggcttcccggttcagcactaatctaatacggagtatggtattgcgtgatggggaacaacattacaggttgttaatatatgtacattgtacttacgaaaccttgctgtgcacaacactacaatagcaaaataagcccctctcgttaagcgaacattttggcccctttctaatactaaaacgctttacttctaaacaagattattcttttaaggaaggaacgagacgtcacgcagatttgggttgaactaactactccaattcctcaagcatatgttgagcaaaagctgcaatactgacctcctaggataccctgatacggctgggagcgtatccgtatcggatacgtaaaggaatacggatacgtattcggatacgctccgatacgcccgtacgtatcctctatttttctgattttcagaaaaatgaaataattagggatacttctctgatacgcatggatacaaggtacgatctaatcctaacttctcacgggataccaatcctcgccgcgtccatcttttcctacccaacggcgtcgtcgttctggagcgaggcaaaggtagagccaccactttgcaatgcgggcctactactgctgccgcacgccgccgaggcgccgcatcgtcgccatgccccgtggagccgccgccgccgccgcatgccgcacccccctagcttagcgcacgcagcacacacctctgctcgcggttagggattgcttcattcaagtgaggtaagtatcgtgtattgacggttcagggcatcctggatctcgatttgttggggccggggaaggagaacatcagtttgtgatattggacaccgtaaagtaagactacaaagccataagtgactttttgaagatccagtactactgcatgaggtctggtcaaagctatacaattctaagctttaatgtatctatgtattgctctattagttatctttcaattattggcaatcaattctcccattttctttgaggagtgcattgtttctttttaatttattatgtatatatagacgtatccacgtatccatgtttttcgaaaatagccgtatcccggtatccccgtatcgcgtatccgtatccgtatccgtatcctcatatcggggtaacatagctgacctctctcgctctaagaaggaataagttcaccggatatctctcaacttaacagcgagattttttgaggttccttacctgtaaaaccagaaatgtttacccctaaacttattcaaatcgttcaaaggaggtcccatggcagtatcgactcaatttttgcccggttttactgacgtggcatcctagttaacaaaaaaataaaaataaataaatatgtgggacccacacgtaagtgaaaaaaatatggggtcgacaatcctaatcagcaatctcctttttctccctttttctcttctgtttcgttttttgggggagcggcagcgggtatactgcctcgggaccttttttaaaggggcaattttgtttctaaccctatttgatgtctaatattgattttacccctactttttaggattttcatttttaccctcacttttttgaactgaatgcttgttttgcccctactttggatggtgaagttaatagtgttaagtaattgacaaaatggcatttataccctctcatgtatgttcattaataatgtttttgtccccattttatacatgtagctttagaacttatttttgggagtatatttaaaattagatgacccgcattgactaatataacaatttggacaaattctgaatttgatggaattttgacaaaatttcagcattttgatagaacttaaacaacattttaacaacattttctaaaatgtaattatctgttcctttagatactagtcaatgtgcttcatttaattttaaatatactcacaaaaataaagttataaagctacatgcataaaatggggacaaaaacataattaatgaacatacatgagagggtataaatgtcattttgtcaattacttaacaccgttaacttcacctctaaagtaggggcaaaacaagcgttcagttcaaaaaagtaaaacgaaaaaagtaggggtaaaatcaatattagacatcaaaataggggcagaaacgaaattgtcccttttttaaatggttttacatagtttagggatacacatttctagttctatggttaagggacctcaaagaatgttggtgttaagttgaggtatctccgttgaacttattccctctaagaaaaaccgaacccatttccagacggaatgagctcatctcaggtcccttaacttgtcaacgaatccaattttcgtccttcaactaaaaaaaccatacaacgggtccctcaactgtcaaaaccagtgcagatgaggtccctcggcggttttgagagcggttttggctgacgtggcgtatacgtggcaaatttgacttggtcttcatatgatgtggcattgacgtggcaattatgtggcaaatcaatcccaaaaacaaaaaaaaacttcgtgggacccacatgtctgtctcacacacaaattaacaaaaaaaggtggggcccacgtgggccccacaagtccctcttctcacttcctctctcccctgtttctccctctccctgctagctatggagcgacggctgactccgggcgtgcgcgcctggtctctccacctccggaatatgaacgacgcggcggagctgtccgtggggaccgcgtcggcaacggacacggcgtcgtggtgcttcgcaatggcactgatcaggcttgtgttgtgcacgctccacgctgaggccgtggtccgtggaggtccgcggccggcggctaggcggcgcggcggtgaagccgtgcgaggaggtgtacgtcgtcggggaagacgagatgttgcacaccatcagcctcactcctcccgtcatccctctcccttctctctcttcttccctctcctccctctctctcttcttcgcggggagcgccggaacggacgggctggtgggcagtggagcagcagccggcgacctcggcgaggcggcgccctcgtcgccgccttccctctccggcgatggccttcacgcggcacctggaccagtagccagtaacgacaacgacgacatggttggctcgtgcaactgcctgtggctcaagcgacatccccttgtctgcggcagcatcatcgtgatcaacccggtcaccggcgagtccctccatatcccgtcgccgccgttggcgaccagccgcagccgccacgcgggtatgatcagcttcggctaccattcgacgactggcaagtacaagatcgtccatttcccttccaatggcgggctggtggatgaagtcacgctggggggcaccgcatcgtcgtcgtcccctcccgccatggcggcggcaacggtgatggggtggtgaatatcctcacgctgggagacgacaccaccgccgccggcggcgcgcggtgggggcgtcgccgtggagcctgtgcgtcgcctggggcgttgtcagcgtcaacggcgccacgtactgggtgaccgagggcaagtagatcatgtcgttcgacctcgagcatgagcgcatcgaggccgtcgcattgctgccgacgatgagcaagtgctgcttgccggtgtccatggagaaggaggacgcctgctgccagctgaccacccccgccacaccggcccccgctgcggcacccaccaccccgcgcctaccaccaccacacccgccgccgcgcctaccaccccggctccggccaccgcggcacctcctctcccccggttgaggcttccgtcgccggcgctgttgtccaccgtcttggtccagctgccgcgtgaaggccatcgccgaagagggaaggcggcagcaagggcgccgcctcgctgaggtcgccggctgctgctccgccgcccactcgcccgtccgctccggcgctcccgggaagaagagagagagtgagggcctgtttggcacagctccagctccagcttcaccccttctggagctggagctcagccaaacagtttcggctctaccaaaactgggagtggagctgggtggagctctctcacaaaatgaactagagttgtggagctgggtttaggcagctccacaactccactccagactcaactcctggagttaaatttaggagttggagctgtaccaaacaggccctgagagggaaagggaagaagagagagaagggagagggatgtggggcccacttgggccccaacatttctaattttctttttgtgtaactaacatgtgggcccacgatttttattattttttctgtgatagaattgccacgaaagcgccacatcaatgccacgcgtaacgaagaccgagtcaaattaaccacgtggacgccacgtcagccaaaactgctctctaaaccgccgagggaccttatctttaccagttttgatagatgagggacctactgtatctggttttctggctgaatgacgaaaatcggattcgttgacgagttaagggacctcagatgaacttattcctttccagacttcagatccagatccaagttccaacccaacagctggcctattttcccaaggccgtcaaagctcgtaagcccaaaaggccacaagtctacgaaactaggccttttaccccgatctgacattccatcccatttggcccatgttgtcccagcccacagctccacacgtatgcaggcatgaaccaaacatttctccgggtacgcctcggtctcccgctgacaaattgcactattgcagggcatatctcctcacttgttcatctccagctctcctggcacactccaagcacaaccttctttcccgttctgcatccttccatcctcgccacctgcgatgatgggctcgggccgttccttgatggcgcctcgcctccccgcctcctcctattcctcgctgctggcgccgacgtcgtggtcgacgccggccgcgcgttctccgccgggggccgcgtctacgagaggagtgcagcgagctggaggagctgagcgccagcgtgcactggacgcatgtaccaccgaggcgaacggcggccgacgtcgcgttccgcgtgtccgcgctggcgatgatgaccagaacggcaccaacgtttttttctgcacttctggtcaggttgcaggatgccgaattgccgatgcccattgacgatgctcagagcaagtttaataatataacccactactagctaattcatacaatagttgcttattatactattaatacatggtctcacttgtcatacacacattacattttagagttcgtgctgcagctgggctacagatatgtagtctgctgctcttctctctctttctttattattttaaaatatgtttatagctggtttatagccttctattttacctattttacctgctctcagaatggtgaccgtgtagccgacggaccaccagtacaagttccagtcgaagcgaaccttaacggtcgtctttggtggcatcagcagggcagaaacccgagacagagagacagaaacaccacgttttagcacgtaaacgcaataacgaagttgctgaattttgtgctctcagttctcacaggtagcatcactggactgtctcattcaccgagtagctatctcaaaagcatcgatattgtggagtactgaagagttgctagggggaaatgtcaatacgcgcgattcagagcacgactgtttccgaaggtcaggccgacccccccatccggcggctccgattagtggtgaaaacggtacgaaaatttttaagattttcggctgccgtttccaatgaccatttcagtcagtattggttaccgtccgtgttagaaatggcaacggtaatatcttccgaaaataggatgaaggtttttctgaccgttttatcgataaccgtatttgtatggtaattttcgtcaaaattctaaaagttccatagcgactcaaccaatcaaacatatcggaagcctatgaatgaaggaagcctagcaggtttgtagcacattagaaaggggaagtgaccaaaggaaaacgctgttaacgctagggcatggcatgtggacgttgctgaactttggtctactcaacttatcggtgttgagatattgttaaattttgtttatattgttgatcaaacttattattatatcattaattatcatataacggtgttatgtgaagtgtgatgatgcaagaatgaagttataaagtcatcttcgtacataattaaatgtgtattaggccacacttttctgattctgacatgaattttcgacttccgaccaatgtcggttgattccgtttcgacggtcccatttccgatatactgatatcgttactgtttttgaatcttcgaatctactgttccgattctgttttcgagaaaaaaatgaaaatgaaaatagtatatggtttttctgaccgctctcatccctgctccgattatgtaaccacagcattggcattttggcaggcgccatggagatagaaccaagcgatggaaacaccatcgtttacctcgccagtcgccagtatgacgcattgacgccgacggaacagagcgccccaagcccccccaacccacagcattcagaactccatggatgggtttgtccttgagattttcaccttgaccgtttgcttcaagaagagtggaaaaggctccaaccaaggtggctccatggatggcacgtcaccttctacttttcaatgtacgccgtgtttagcttcaaagtttttcttcaaacttccaacttttctatcacatccttctaattttaaccaaacttccaattttaatgtgaactaaacacagccgtattctaacaatcctgattattttttaaagtataatgatctgcatctgttattatgtgtatgtgcaatttcagtccagtttctcgtatgtttggtctattgtgatcaaacggatatggcttcctatgtagacaaggaacagtacctcaaagcaatcgaggcttgtttggatcaatgccaatacctatcctcacaaaaaacttacgcaggggcaatgtttggaagttaccaaaattttgataattgtctggactaagatccatacaaatcattggttgaaatagactggtagctgcgcttggcacaagagcaagtcttatggaaaaggtagatttcacccctaattttattcatgtagactattcatcaattaaaagatagcatatacaataaatcacacatatattaattgtagtgcactaaccctaatagttttattttatttgtttgatcaatcttctcttccttttttttcccttttttattataatttatgtgaaggttaccccttataggaggggtgactatttctctcttctcttctctccagctcatcatacgagtgtatgtggcatcttggagtaaatgtttagatgcccatagcacttgctctaggcccattcatagcgcctcctactcataagaggagccccggaaagccatgtaggctagggctacgggtctaaattttgagttctttacgatgcaagtggctctaggagtggctataattctatatttcagctccccaacatcttttgttttagttctcattttttttcaatttgtatggaggtccaaaatttacactaaacaccctaaaatctaaaaaaaattatattaaaacccctctctcccttatcctcacccccctccccggcatgcccacctccttcggttaccacgagcccatggcgccctcctctcctctcctcatgtcgcggcggtagtcaaggagattgggggcacgatggcggtcgaggaggctgaggcggcgacgaagccaccaagcggacgatgacaacaagctcaggggtgcgtgacccctcccgaccgacgatgaggagatggagcccctcagaaggcgacgacctcaacaacgacggcatgggagcttggccaccaccgtcatcacctcccctcttaggcatcaaggaggagcgggatccgacctagatagtgccacctggatctagcccagcgctaggtggcagcgtggcatgtgaggcagcgcagctcggtggacagtgtgtccggtgagcttcagccagcaacgcggattgaagtggagaggacggtggggaagaagaagaagagaaaggggtcgacgtggacaagctcaaactctctcctcgccgacggtgtcaagctcgaagtgaggccataggcagggcgatgccttccatagtggttgtagcttcgccctccgaacgacctcgctctgactcttctgacaaggttcatgcgttcttagcaagaacgatgagccttgcaggggcatcgtggagccacatcaaggatggggcgtggtaaggaaattgccacatccttacattgtgaatggcttaatcatatggagaggaaagtcacttgttttccgcactcacgttttccgaactactaaacggtatgtttttttataaaaaaaaactatataaaaggtgcttaaaataatattaattaaaatttcaaatttaaaataattaatactcaattaatcgtgtgctaatggtttagcgtgttttatgtattttcttaatcttatacaatcattctctctccaacacttcctatttagtccttttgggatatgctaacagaatctgtgttttttttcaagtacaattcctcttgtattcgtactaagggagcattcgttttggaagaattttaacacataggaatagggaaggtggaggaataggaatgtatgcacacttcgatccatagaaattttcttagaggtttgagtagatggaaaatttccacgaaaaattttcgttggttttcctatacatacatttctataaacctaatgacactaataggaatccaaatactttgattttcctcaaaaaacgaataggccctaaaacaagtaattcaaaacgtgggtaaaagaattatcaacagttcaaaatatacgaaaaatagttaggtggagcgccttgcacgtataggtagcagaaagtcataatgtaacctaaaagttatggtgacgtttccgtgatgaagaagccaggaagcagatttatagaagcagaaatcatgaactaatttttagagcaagtacatatatgccatgtccttaaggattaactacctaaaaagggtactccgtccacatgaggcccaaagctactttccaaaagacaacgaacagaaaggcacgaaccacatgccatgctatgaaaggctacattaaactaaaccaacaggcaacagcagaacagctatatat

SEQ ID NO: 67410 - DNA, 649 bp, Oryza sativa
attggggggtgctgaacaccttagactgaatcgtcatgagctgcagcacctgtgctctagcaaggagaaaacatgcaaattcaagcatgtagatgttgtgaactttgctttccagtcggacgctgttgaggtggttcatgacacacccaatgtgatcaagcttttcgtggtagcttgagccaacagtgtcggtgctatcctgagtcagatcgaaccttgtatcagaggcctgcacggaatgatgaatccaatgaatctgtgttcagctaaattgaacaggtagtacctacacagacagtgcaatgcaagtattgcaacagctcaagctcaaccagttacctgaacgtgcaatgtctccacgaaaggaaagaaatttagcaagttcatcagcttgtccatgtcattcttgctcgagaactttacactgatagccagaatcttcacgctcagaagcggagcacgcaaaccattacagacatcctgatgcaatgcacaagtaaaaataactcagtgagagcaactaaagagtagagtaggagaacgacgaggataaatgaaacaagaaaccaccttctcaataacctcgtcgaagaggaggaaattggacgagctgatcacgacatagccgaaagcggtgagctttggcgcg

SEQ ID NO: 67411 - DNA, 674 bp, Oryza sativa
ccattaaacaaaaacgaatgtttaagaaaagatgcatataaaatgcagcgaatgttggaatgtgcaacaatatgaaattcctccaaaagactatgcaacgatataggagtatctcgcaaggagatcgaaagcgcgaaaaagtagcacaagcgcgaatatcaattttcatcattgactaatcaaacacagccaaaattttaaattttaaagcataattctatatttctatagttcgttttgaaggttttttttttcattcattcttctgcggcccatttaaatggttttctgctctgattgcatgcattgtcttatctcaagaaatatgcagtaacagactaaagagaagcttattgagcactaaatacaaggagaaaaacatttctgtcgaacagattattcataaacatacaaatgccaaccgatatcgttatgtacaaaactacagcgaatgcgcaacataggatgggtttggtatagctctgaaaaaagccgttcaccctggtctatttccttcacgagtcactcgaaaacaggagctcatcagtaggcttttctacctcatcttcctggcattggcgatgaaacacaagcccctcaaatcacatcgtcagggcagcctttcttttcacctttcacttgagttgtattccggcgtcattaccacaaactcc

SEQ ID NO: 67412 - DNA, 20109 bp, Oryza sativa
  unsure (1)..(20109): unsure at all n locations
tcttacagtgggccattaataaatacatcatctctcttctctaccaattatatttattcttcgtctattatgaagacactattctctcccaatgcaaaacttgatagtgtctagtgcataggttctcgtgttgaagctgtgtcttgcataagatccagtttcttcctctcttcactctctcttaattaatatagtgccacataagctaaaagtcctacatggcaatgtagttaatgccatagacaccatcctagatggagagttgtgactgcccttaagatggtgtttatagcattaaataagcagccacctaggatgaaaaatgatgtggcaagtgaataaatgaggaaagagaaggaaaccatgtcttgcatgagacatggtttctacataacatccaagacaccatgtgagataagtagcattaaagttaagtatggaatagtggtgtttgcattggaagagtagggtctagtactagtttcttgatgatgtggagtttatagaaactatatctagtgtggagattatgggtaccacatacccacacggcatggttatccgactagttataggggataactcatatctatgaaatatgtaacagatcatgacttgggtattacgtttccttgtatattatggaacagcctagagtcctgatttgataatgttgtaaagtatatttaggaaaccgataccgtattggttaagatttctatcatgtaatcttgctcctcaccctatataaggtgggcaggaggccccctctagggggtatgacagaatatgatcgtcagatctatactacacccggcggattcaaatccccaaacaggagtagggtattacctctcattgagaggacctgaacctgtctaaattcttgtctccgcatccatccacttttaggtctcgtgcgctaccctcttttattattgctaaattcatgtttcgacagttggcgcgccaggtaggggttgcgtcgaatttcccgtcgagaagtgcgatggaatcaactccatgagtcgccggctttgtgttcacttcagggcagatttcttgcatgaggagtttgactttctcgccgccgacaatttcagcaaattcctgttcgatctcccgaacactgcagtgatctattccaagctctccaagcagccaacttcaaatccaatctgacttcggtcagcctccggtcaaccgctacattcatcacatcaatctccgacgtcagcatatacgaggatctacatggctcagccgctaccaagaaatacatcaactctcagccaccgccaatgttttctcgtcaaatatcaaagtttctggcgagattcaattattaacatgaatcggagttgatgtgggctcggagccgactgatcggactcagccatgcatactccggactcatatctggccctgcacgccgatgacatacgtgcatcattaagagtttgtgtgacaaacatttaccaggtctatcgttttaattttcttacataatctagaattaatattgatttttctagtcatctaattcacagatttctaattattttctgatctgttatttttgtgtgcacatacatacgtggcatccgccgccattgattggtgccttcacctccacggttgatgaactccgccgccgttgctgatggcgacattgtcttgactgccggccgccgtcatcgccgccgactggtgccctcgccttcacggttggttggtcacatcaccgttgttgggcatctatgtcttcaccgctggccgcctcgtccgccgccaactggtgttctcgcctatacagttggttggtcacaccactattcatgggcgtccacgtcttcatcgaccggcctgcctctgtcgccgccgactggtgtcctcgcctatacggttggttggtcacaccaccgttcatgggcgtccacgtcttcaccgccggctcgccttcgccaccgccgactggtgtctccgcctgcacggctggtttattatgccgtcgttgttgggtgtctacgtcttcaccgaccggtctgcctctgtcgccgccgactggtgtcctcgcctatacggttggttggtcacatcaccgttcatgggcgtccatggcttcaccgaccgacttgccttcgccgctgccgactgatgtctccgcctacacggctggcttattatgccgctgttgttgggcgtctacgacttcatcgccggcctgcctccgttgccgccgactggtgtcctcgcctacacggttggcctattatgccgtcgttgttgggcgtcttcgacttcactgccggcctgcctccgtcgccgccgactggtgtcctcgcctatacggttggtggactccgccgccattgatggacctcgtcatctacaccaccggcttgctcccgccgccgccaactggtgtctttattgttattgatggacgactttgttcccacattggccacctctgccatcaccaaggggaatattacaaagctaagtcatcattaaattttctttatatgatattttcttttttctctgcctcactacatcaactggtttgccgttgactagtgagtcggtggctacagatgttatatcatattttttcaacaattttcatactatttatcttgattgctcgcgacataatctgagtacaaaagtgcctatcgagttatggagttccatcttcctatgatttccgtttggtttgccaatggatagttgccattgagccgattcctagcaccgggggctcgttggatggaccgagtaacgcaaggtgctaagtattactcggaataaatcaaaagcatagagataaaataatttattttctgctcttaataattgtaaaagtacccgagtagtaaactctgatccgtgaaactttgttccattaatgacgaactcatgtccctcatatgcatgtttgggaagtgcctaagccgactcccaatgcttggggactatgactagttaggcagagtgtttaaacgtaaggagtcatctgctcggagaaatcaaaattgacaagaggagaaatacatatttataaatattttaaaatacttaaattttcctcgagtattatatttatatcagatactactcatcctatatgtttgttctttaggatccagatccagatatgcataaaagggattcatggctttaagcttatctcctacgctccaggaatggatcagtcagaacatcaccaccggcttgccctcatccgccgccaactagtgtcttcgcctatacggttggttggtcacaccaccgttgttgggcgtcgttgtcttcaccgaccggccgcctcgttcgccgccgactggtgtcttcgcctatacggttggttggtcacaccaccgttgttgggcgtctacgtcttcaccgaccggccgcctcgtccgccgccgactggtgtttccgcctgcacggttggcctattatgctgctgatgttgggcgtctatgtcttcaccgaccggccgcctcctccgccgccgactggtgttttcgcctgcacggctggcctattatgtcgccgttgttgaacgttaacatcttcaccgaccggccgcctcgtatgatgcctactggtgctaccgtcttcacggttggccacgtcggcgccactgctaataggcgtaatcatcttcaatgcaagctgtctacgtctgctgccgactggtttcttcacctccatggctgcatgattctgccagtgttgattggccttatcatcttcatcgccagtcgtctcgtctgctgttgactggtgtcctcgctctacggctggtttataccactaccactactgatggacgtcatcgtcttcattgctggccgtcttgtctgacgctgactggcttgttcgcctcgacggccgcgcgtctttgtcatcattgactagcgtcatcctcatcgcctgtttgccttcgccgccgcccatggtgccttgactttcatggctggcctattttgctgccattcaaggacatattcattttcgtcatcattctacttcttccgtcgccgactggttaagccgccgccgactagtgtttttatcttcacaactacgcgtcttcgctaccagtttgcttctgttgccgtcgactcgtgttcacttcatcatggctatgcaaccttttcaccatggtggagcgactttatctttattgtcttctgcaccggcaaaaccaattgccgctacttcgcaagttttgctgcttcaccaaccacgacatctacaagagcctcaacatctcggcatgcctcaccaaatatgatgtcgtgttattttacaacaacaagtggtgttacaatcttcaatatttctacttggacatcttcaacatgcatcttcactctagtgatggctgttcgacgacaggaagctatagttctcgactctatgttcaattgctttccaactaaccaaagagtcgggggctacacaaatacaagactcaaaattcgacaagttttatgtcaagatgaagtaatcaatcaatcaatgagtcaactctaggagttattatctttatcttcgcttcagagccgaaatttgacttcagcgactccaattattacaccggcatttggatttctagacgctgccacaatttactctaaaattttcaactatcaagtttgagatttaatctacatgtccgggagtttagagttatcaaccaatcagctcagttttgttgagttggacaacagcatatactttcctccaagtgaagcatctgcaacagctacaagaccaagttctactggcatctttataaatcaaggggcgttgcatcagtcttcgttatgcacacgctcgcatcaaggaaactactcgagctttgatatcttctcaatagtttgatggattattgtcactgacatcatcactagcatctctgcttcatcggccctgacatctccgctattgctaatggctgattatgtcttcgccgacttattatttcaccttcacgggttacctactacgcaaacgctgatgagcgtcttcgtcattatcatcggctgctacaccgctattgattggatcgccggcatcgtcatcttcatcaacatcctgtcaagcctcttcaacatagcctacactgctgccgttgatgggcaacttcgtcaccatagccggctatctttgttgccgctaatcatcattaccgtcggatgcgtttgccgtcgccgactattttcttcatcttcatgattggtggattttgccatcaccgttgatgcgcgtctacgtcttcatcgacttgctttcgttgccaccgactgctttgtcgttgttgttgggcaccttcatcttcattgctagctgacctgaccgctgccgactggtttctttgcctccacggctgtgcgacttcatcacctttgattggtgtcactgtttttactaccactgacatcttctgtcagctttgatgggtgatatcatcttcatgttagtcatttcgtctccatgtcgactgcatcagctattgccaatggacaattttgactatgacagaaggacaagctatatatttgctcaggggcttatcaactcaaacacagggatcataccttcaagttggattttgttctgagattattttctatgctcgaagactggaccaatcattattccccgtaagggctatcaaccgaatacttgcgccagtcgggattcaatttttatatctattttggagtatcccataagggataatcactcagatcaaaagctattcatatgagctacacttggtctatatcactcggaagatttattactcgagagcatgttacatacgtcatcctttaaagggtgttgaaggcatatttttttggcctaggcctaatatgtctgtagcccatattttcaggtgtggcctgtcacgttcttttagggacttaggcactttttgcttatgctaaagtgcgcgtgatcaagtgcccaataccttaaaatccttttataccgcagttactcaactttttaggagttggtacaatgcattttaaaaggtgcccagcagtgaacttttttcatagctgtcctactgacttttttatatagttaaggcgctgtttgggtttataaagcaattgattggataaaatatcattgctttttgccacgtaagtgtgcatttttattgaccaatattatggcttaggctgattatatattgaggtcattttccaggcagttggtaaatcctttatgagtttatttactcggatgttacaccacatatgccatatatttttaggtgtggtgaaaccatgtgtcttttagggacttaagcacatctgttaaagcagtgtgcgcatggcgtatgcccaatacattggaaatttctttattcacaacatacaagcttctttgtagctgttttgctatgtgaatttttaaatgatatagtcaactttaggttgcacgcatcatatgttacaaagcagtcggtatatcacttggatcatattattcagggattcacaccgcatatgctatatattaatattaagtcactcggttgactacaattatcaaaaccactcagttggttggattatttactctttgactatatgtttagtttgttcaactatccatatagtcggggcctacacctattaggtacatctagtcgatgcacctaagtctacagtcaattatttttcagccctccacagtcttcaaatttggtaaaagtactcgggggaccatggcgaagatgattgaagcactcggctttgcagtaatctagtgcgagagaagattatcttttcgactgcgaatgtctcaggggctactgtggagattatgggtaccacatacccacacggcatggttatccgactagttatagaggataactcatatctatgaaatatgtaacagatcatgacttgggtattacatttccttgtatattatggaacggcctaaagtcctggtttgataatgttgtaaagtagatttagaaaaccgataccgtattggttaagatttctatcatgtaatcctgcccctcaccctatataaggtgggcaggaggccctctagggggtatgacagaatatgatcgtcagatctatactacacccggcggattcaaatccccaaacagaagtagggtattacctctcattgagagggcctgaacctgtctaaatccttgtctccgcatccatccacttttaggtctcgtgcgctaccccttttattattgccaaattcatgtttcgacatctaatgtcttgggttgagaatgaccttattgtagcagtagtagttgtactaatggactaatggactaggcaggcatgactgaccgcgcggatgcaggcccgcgcggctggtcgccgatcaggcacacccaccgccgccacccctcccccacactgcgattgaattcttgaagggacaataactgattcactggatgaaaattgaagtccccaaatatttcgagtaaaattaaaatctgtctttttattgctggacatgtatcctattgactggccaaacacgatcgaggcaactgaatttttagagaaccgttggttcccacacggacgccccaggaaaggacggaggtagcgttgggaagcgatcgggaactgaatagaagtgttcaaccgaaaagaccggaagagatcgggagggcaaggataggatatagagaaaaaacaacctgcaccatctattaaattgaaatcaatatgtttagattaaggttaatatgaaatttaatattagttatgtgcgacatacgccatgaatctttcattagttagatgcatcaatagtggtctctgaaaaagaaaaaaaatattggttggtttctttaagtatatttattttgaattgtcatcgtgcttagtttagatatatatctaagcactacttttcttttagtactcctgccaatcgaggcatcgagccttttgctcttcctaaccccagtcgctcccaatcaagacatcgagagctgccagatttaataacagcacagattttctcccgattggaagaggattggaaaaaaaaaaaaaaggaaagaaagagggccagcctcctggccttcaggacattagacaagttggcccatactccctttggcccagtaacacggtgggggcgaattcccctcgcttgcgtacctcgcgtacccgagttaggtaaagattagttcgtcgcaaaccgaatgctttgtagtcaacacaatcttacacaaaaatctcacacatacctggaagagatggggcctgagagatgacatgaggcaggtcatagttgatgcccctaatgtgcttgtaccgcgaggtgatcatccccagggtggatccgtcacccccaccgacatcgacgagctgctggacgccgtcgaatccttggaagcgttcgagcatcttgctgaccagaatcactgaatgctgcgccatggcgtggtcgaacagcgcgcccagccgctggttcttccccatgtactcgaagtagagcaacccgtgtgccctctcgaacggcgccggcccgccactagtcaccgctgccgctatatgttgcctacaagaacatgcatagcagcatgtgatgtattttcgttggcggtactcttaaaattaactctacctgtagaaatcaacttttacagacgggactatatctagctggttatctggaaaaatgaaaacccggatcggatattggaaaaaatcgtcaaatttttatagcgataggaagaatacgtatatataccagggcaataggtggtcctcgtcgacaacgaacacagtgaagggagccagcgatccctcgccgttgtttctggtgagccaccggcacaccggcgctggcatgtagcgccggagaagtgcgccgtcggggcttgtctcggtggagcacctcaccacatcgaaggatgcgaggtaccggagaatccgatccaccgagacggccacctcggccttgtccgtggcctggattttctcggcaagctcatccgcggtcagcgcgtttccagcggccgcgctgagcgcatcgagaagaccaagctggaccgccgctctcaggaccatggagcggttgtaggcaaacatgagttcttgcgcgtacaagcaatgctcatcctccttctcttgagcatcactagcagcaacaattttttccatggctctaacacgaacagtcgtctaatcctgtgtagtgtattgcatttgatgcctcttacatggtataccgagtatgtataatgggagagcgggggcagggaggtgccgagtcgtggtgagcgaactgtctcttatttccattgtgtcctctcttaataatgacaagtgcgatttttttccatggtcaacaatcctgtactagttttgctagctttgtgattaacttcagacaacactgtacatcaattttacaagagaaaagctaaataaaattattcaagtttttatatttaactagttacatacctgtgcattgcaacggtaccagatgatacaaatatgatttagtttctttctatgtcggtttttataattggttggattttttttgagcgttttttaaaggaggaagtgattttttttctttaactagagggaacggttcttttgttgttggaggggagtaaggggacgattctctaaagtattatgacaattaatataagattataagtagttttatgggctacccatgtgtaagacgtccgatgaaactcgaaaaatcgaacgcccacttctgtgcttttgtagcctctagctttctcctttagctctatacatgcatgttatatgtagggcccacatacccccacttttacatacacgctctctttgcacactcacttatttctcttctcttccctaagtaacttagttaacaatctttaaacttttttcctaaattaccttttcaatttgagatataattacattgttatatttactacaattaattaaatattcaagcaagatcttacatgattatattatgaataacaaacaattatattttgaattgaaacatgtttgtattatatatgaaacattgaattttaactgttgaaacattaaaagaatataacatgcaacattttacaaacataaggaaaaatacttattgaaacatctaaataacacaatgtacaacatttaaaaaaatctattgaaaaaatgaggcagccaaatgtttcagtagactacctatgaaacatcaagatgcacttggtgaaacataaaaaagtagtcattgaaacaattaaataatttgtgaaacaccatgaaatacttgttgagacatttctctatcaagtagaaacattaaattttaacggttgaaatttaatgcctccatttttgtttcaccattttgacccttgatagagaaatgcctctatttttcttttctcaggatataaatataatcaagtgatatcttgttataaatatttaattataattaataaaatggtgccatcggatcatagattaaatatgtaatttatgagaaaaatattttatatttgttaatagaaccagacatgcatgcttaagagagtttggaaagaaagagtttgtgagagacactagtgcatgcatgtgagagatgatagggagcatgtgtggagaaaaaacatctctgtgtcgttttgtacagtgtagaaaaagtacatagggtgtggtggcatccgacgtctcggatgggactttttgtttagaagtattgtctgtagttttacggttgaagttgtaaagttctgctgtagagtaaggaccataaattttatacaaaatttagttcgccagtgcgccaccgccagccgctagggccgccgccgccgccgcacttccccagctgccgccaccgccgcacttccccagctgccgccgccgccgccaaccgctagggccgccacagctgctgcacttccccagccgccaccgccgcacttccccagctgccgccgccgccgccaaccgctagggccgccacagccgctgcacttccccagccgccgctgccgccgtcgcacttccccagtcggcaagaaggtcccctcctcctcctctaccagctgcttgttggtttggctcgcaagcctaactagctagctcgagctttcaaacgagccaagccgagctaggtttctagctcgttaggatgacgagctgagcgagccgagcggagccgagccgagctggctcactatccacccctagtctacgcgctgcagggaacagggctcgactgaagttgattgccgctactgattgccatcgcccacatacctcatgctgtttgaggtcatcttatcgctttaaggtactgataacaccaaaatttggtacttttgtttagtggattcggttaaataaaaactcgattggaagatggaaatttatccagatcaagccgagtttttgagcagggctgcattggttttgttcgatctccaacaagaaatcaagttcagggccttgctatcgagttgggctacatcgtttcgatctccggcgagtaagtaagttccgtcaacttcacttgtatcggtttggctagaacattctcggttaggtccgatattctattcaagttgatgcaagtgttgcctatcagatatattgattctatctttaacaacgtcattgtttacagtcgtattggcttagttaggactttctcgattaggtccgatattctgactaagttgatatttctctaatcacattgttattttagattgatcaatatatccatcacgtttatatagatctatcggctaaataagtttttgttattatgttcaatcttatattatctcggttaggtccgaactattagattgctgctaaataagtttaattctagtaaaccgaaaggtttttatgcaacgttcatcggagttctagccgatgagttatcattattgtgggcttcagctataagatgtatcggttagttagccgatatatattcgaaatctacctgcatcaggttttcagccgatgtatgctttaaccatcaataatcaactatcagctatcagtttcagtcatcagttataagttaaatcctatcgacaattattagttatctgattagttgaatttacattggatctaaagccatttgataaaaaccttaacgacatcggctgacctcaatacatcacatcggcttattggttgatcggctctttgatcttatacaatctgtctacctatgttgttagttgctggatttagaacctgcactgaagctaagcagatctcctaggccttcgtgtgttggtgcagatttttgcatcaacaactataccgatggctgggctcgaataggatgcacctgaaaccaagtatggcctattgatataatcttttgcaggttcatgtcgatgaaaatagaccgactcatgaattattcacatgcgtggcgaggtttgggtgggtgggtctatgtgaaccatctaggcccctgttgttaattttggttattaatgacaagcaataattatgaactaactattttaattgagcgatattttttagttagaaccacacgttgtacatgccatggacgatcactgcggattaaaattgatggcgcaaagaaatggaacaaagacggtatatctagcattttattttcaatcgattgatgagttgtgcgatcgaacttttgctaggtttatttctagctttgccgtactttcaagaagggtaatgaccttggtaaaatgatgataaaaatgccacattaggtcatttgcatcaacacttgtttcaacaaaattttctttgatcatttgttggccattggcggtctgaccgggatgccaaggagccgggaggctgccctcggcttggcaatacagagccgctagagccgatgccggtgttgttggaattaatgaatgggccttagcccactcgaagattaattctttggaaaatcacaaaagcccacctcatgggatggtatgcatgtggagtttagtaccaccttgcttattctaggagagggggacctccttaaaagggaggatgccctcctagccacttgaagcatgtgtagtggagagaagaggggaaacacacgcgcgcgctcgctcgcctcgcctcgccgggccgggccggtggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacttgtcgtcttcacgcaacacttgcgaaatcaatctagggtttatctcctactttgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcaaccggtctttccgtcacctcggtacgtgttcaatacgttgcgcatatttgatctgttcatgttgtactgtgtagtttacatgtatagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtctagtgccaatattgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcaacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctatgtaacatcctgaaaattcccaacaataaaaatcactaaaatttcgaactttttaaaacttttgcatcatgctggttgttatgattcctgttgcttgccaaaccataaatgatcactaagaaagtaaagaaaagaactacatttaagcaatagatatgatttacgagaatatatttaatcctacaaataattatgcacaagatattaaaatcaaataaaataaaagttattattaacctattttatcaaatattaaaatatttgaataatataggtgggtgccataatacgagtacccatgaaatgatgatcattcaaatgaactgagctctctgtatatataatagaattacgggagtatttaattcgatatgtagatcgattttgcaccaagttcctaattgcatttagggattgaaatttgatatattaaaacccctccatataaaataaactaacatatagataaattgagctaatgtgctattatgttaataacgatctcattagaaaattatagaatctttaataaacctcaaaaacaaattggtaaaataaatataaattaaaaataaagattaggtgtggatagtaataaataaaatattgtcgcgaccatatttggatcaattaaatttaattgcgatagcataagaatttaccctaattaaaactcaaataagttatataaaaataaaatatgagtaatattaacctagggtgaattcattagttgagataatacacatattgagtaaacttcgtttatgcaagatttagaaataatagaatcaaattcatataggaaataacctaaaatcgggaataataggaaagtgcactgttcattgcccgccacgtgttcgacctggtccccagcctttcccctcccctgccacgcgcgccgctccgcctcccctctgccgcgtcgctcgccgtcgcatcaccgtcgtcgtcgcgtcgagccccgtgccgagccgcgcccgtcccgctgccgcgccgctccccgtcgcgtcgccgtcccgcgtcgcgtcgccgtcccatcgccgcctgccacctcgccccgcgcgcccacgcaccccgtcaccgcccgtcgcgtcgccgtcccctcccgcgccgagccgctccgagccccacgccgcgccgcccgctcgtcgccatcgccgcgcgccgtcgcccgtcgcgtcgcgtcccgtcgccgctcgtccgtcgccgtcgcgtctcgcgtcccgccgcgcgccgagccccgcgccgccccgagccccgcgcgccgccccgagccccgcgccgccatcccgtccccgcagccgcgtcgccgcccctccccctcctctctttcccctcttcttcttcccctcttcccctcttccctcttccctcctcctccttcccccttatctctctccctccccttataaaagcctcactattccccccccttctcnccgtctccaccacccactcctccacgccgtcgcgccgccatcgtagtgccgccgcgccgccatcgtagtgccgccgcaccgccgccgttgtgctgccgcgccgaccgtttccgtgcccgcaccgccgttctcgcgccaccgtgcgccgccgtcgctgccgccgtcatcgccgctgccgccgccggtgagtcgccctccgtttccctcgagtccgccgccgccaccgctcgggtgggaaagagagagagccgagagaaagagagggagagccgagaaagagaaggagaggaagggaggaggaagccaggagagaaaagaaaagaaagggagagaaagaaaaagaaaagaaaagagaggagaggaaaaagggaaagaaaaagagaaagaaaaattaagagggaaatttaaaatatttacaaattttagaatttaattatagggttaataaaagtgtagttagatgaaattttactaattaaatacctaaaatactaactcttaagtataggattaatgaaaatataaatggatgaatttctatagattatagattatttttagtactctccataagaaatcaattcacagtattaatttagatgtaattaataattgaacaaatgtatgaattcccgtaaattattgtggattatttttgggtaatctctataaatgatccgattcacggtataaattcggacttaatcgctaggaatttttagacgtacattatatttaattgtttagtcataaactaaattaaaacgtgtaatattataagataattttaggatcccgtccgacatttagctcgcgatagaaatttctaacccaatatatggatataatgctagggtagattaatttaaaaacttatgacaacaaaatatttatacccgcaaaatactttaaatcgaaattgggtttgccgtagttcgcagatagtaaagttaataaaaaggaatcgactttcgcattcgacttttactcggatttaagtgaaacttgaacctaaattcatctaatttcataagctttccaatgatatataattcactattggataaaatatatttataaaaattaaataattaatatcaagatgatgcataatggtcaacttaaaaatatgctaataaataaaattagtattgtacagcagaataattatctttaatatgttctgtcactgtagcaaccacataaattaagtataatcgatgtttgaagttaatgggtatataggaaaatattagtgccatttattaatctatgtccaaatataattaaaacccacgacttattagttatttaaatagagttaggcttataattattaggtaagtaaaatatagatacacatagatcggtcctaagcttgtttatggcaaataataacagagctagtatgattaaatcacctatatgaaattaatcaatgacatatcccatataatagcatatagtgggagaggtgagcaacccttagttaaccaagcagtaaatagaaactattcaaataaatgattcaatatattaagatattgtgcacacatatattgtacatcccattatagatatatggtatcgtattaatttgcttgttgcatatattaatttagagggagtacgtgacgaacatgaatattagataaatactagttatacatcttgtcctcgtataattacagatcaactgtaaatttggattattcattgtaaaattatgtgatgggataatccgtaaccataatatgattaacctaaacaattctaacatacaaagcatgggtaattgctaaccttttatgatttattttgacaagtgaaatatgtacataattaaattaaagcctccattaataaaataataatacaaatgattcacagtaattatttgaccgatccaaaatccatccggcaacagaacctctagtgtataaccgttctatttagatagatgcatgtgtaaccataatccttccttagccattagctagactgaaccaccatgacaacagaaagactgaggaaccttagctcttagcttgattagagtccattagcaagcgcgaataatatgagcaaccctaggttcgacctcagcaaatatattttgtttgtgcatatttgattgttgcttgaatattggtttttctcgcgtattatagactttgtgtatcggttagtcgtgaggcaacgtctgcaacttccaggaggtgaaggttgatcaagattatatcgagaataaggattatcctgagcaggcaagtcatcactattccttgaacatgttgatcccaattggagttattttgtttacaaataaaattgcatgcaaagatgaacatcctacttgtgattatgccatgccttgattattgtttatcccttattccttcgtaaccatgtttacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatattgataacatgatttgtgaaaggagaaataaactaaataactgttttcgactggggcggacggaggatttgggtggtatctggaaaaggctagtaccgtccccggt

SEQ ID NO: 67413 - DNA, 30125 bp, Oryza sativa
ctaccgaaagctaaggggaagaggaggaacgaggagggagaacgggtaggaggcactaccgtgcggggtgaaggagcgcagtgatgatggccgatggcacggggcgtgatcgctccggcctcgggccggggaagaggaaggagagggtgtgcccggagtccacgtcacgcgtcctcgctcgtgccggctccttcgtcacgcacgacgacgaacggcgacggcgaacagggcagggcgcggcaatggcgaggccgaaaatggggaagattggtttggggaggggctcgggtttatagggcggcaacgtcggttcggaaaccgaccttgggcggcactagggggcgagggagcttcgaggggaagggataggcttcacgggcgcggtcaaacggcgcggaggacgggctggcgcggcgcggctgctcctctgccctggcgctagctccgagcggagggagagcagaggccgggccgagagaggaaagtgggaaacggagggggagaaagaaggctcgcgctatgccggtttggggaggaagagggatgggagtgggaggcactgcctcgcggggcagggcgcggcgctggcggcgcagcgcggcgcggggccggacggcgcaggcacgggcagcaggcggctgacgacggcggcgaccgcacgggcgcgcgcgcgcgaggtaacggcgcgcggggagcttgccggggatggagcggggagagagaacgggataacgagacagagagagggagagctcagctcgtcgtcggctcatgcgcatgcgcacgcgcacgcggcgcacgggcagagcgaggggagagctgagggggagagagagagagagagatgggccgagaggaaatcggcccaccgaacctgagggaggcacaatagacttttgcggaggaatttgatttgggaaggatttggattcgggatttgaatttgacgatagatcgaggattcgagatcagggattggcatggagacagacaacaagcaaagaaacagatttcgcaattagggtttttagaatttaaattttcccgctaggtgccacgacggaacgggcgctacataatccattatatatgttggcttttgttgtcgaaatgacaactacatacgtcgaaggacgtggttactcaacagtggttggaaggaaacgaagtgtattgaattttgaatttctttcttcgaatccccctattacatggccctaggggactatttatagccccactacaggttcttgctactagggtttaggttgtacaggggaatttacatgattacccttacgaaagggacatttacaggggtacataatgttataggagctcatgggtccctgatgggctgtctggcgatcgccggccctatagcccttaggcttgatgggtcggaaaagcttcctcggcccttgcgggggcgaacttgccatagcgaagttgtcttccttcggcagatagtcttcgccttgcacccttcgcccgagacgcccctggcctggcaaggcactcgtgcgactcttcgcctcatgccgttcttgctccatagccttcgccacgggtttcggcagatttggtcgaagggcctcatgccatccgccaacaagcccctcacgggcaaggggtgagattggagcttcggccgagaccgtgcaaaccatgtggtatggtatgtggcgccccctttcgaccgatgctcctgctgaaacctacattattcctgcgaatgaagtttgttacttgtgcggctattattattttgccgcgcttcgcctcctgcgagtggtggttatatattttcttttcccgggccgaacggaacagtgttgggccttcccttcgtgggctttttactgtgccgctcagacggtgggaatttactgtttcgcctacccttgcgacacgtggcgctttattattggtgggtaggcgaacggtcgcccgggtaacactacaccatgccccaagtttgcttactacatatctgtcaggaaaggacctatatgctgtcaaattatttgtcagcataacttttcccgacagatagggtctgtcaggccaagtgctgccggcaaaggtcttttccgacagataaatgtttgctgacatataactcgacagtcctacaaatgaattaccgacagacggaagttaccgacagatggtcctttaccgacagttaacggattactgacagatacgcagtttgcatatatcagtttttctaacatatattctgttagtgtgccctgcattgggttaaaaaaaatatagttcatggaatcaaatcctactgatctagaactgaatataccaccaacagttctcatgcatccacattccactagtactgaatataccaattccatttaattacaaatgccatgtacataggttagttgtacaaaaagagaaattctcctatacaatctacaaaatgagacaaaacgatggcaaatctacaacaggcaaggcatttcccttgtagagaaatgccactccaaaatatcttgtgaccgccatgataagttgagcatctaaaaacttgaatcagattatcagaaagacaaaagtattaagggtcagatatatagattataataatactccatttaatgataagtaatctatgcaacacctactatttcaatacagaattgaagatcagtgtcaaatgtgcaggataagtgtcaataacataactgatgtagttccatttaattcaatctgtagcatagcttcgatattctcacaatccaccaatattaaattaccagttccattttatgagaaatttatgttgaagcagtataattgcaatcgtaacagattcaattacaatttacaagcagcaaggattgcaatttatctcacaaactatgggaacaaactgattttagcttacatgatgtatgagcctttaagttagtgttgatcttctgttccttcaggtacccttctctgacacttcagcaagaagttgattgctcacccacaggtcgcaaatcatagctagtaaataaataaaaagaagataagtgctgaagtacagtttaattggctcccacttgcaaatgttaacttatattagaattgagatgtatgtaggtgacattttcataattaatgtagatggaaaatctgaagcccgaagactgtttcaaatttgtactacgacaactcactgcaaggacagctagccacctaatttgcagagatcaactaagggagttttatttaaaataattatactaggatggtacattctacaagtaaaaactcagtaaacacacaatgtacatgcatattcctaataaatggattgatataagttggaaatggcttcactagtaaatagaacttggcttgagtagttgctgtactatgtggtgcatgcaaagttctcaattagcatttcaattattccaactggtcctgatagctgatgcatgtctgtgtgaaatcaataatagatcaaatcttaaaaaaaaatgttcaccactctttctagtacatatataataatgtctgccatgaaatgaaaaggaaatggagcaaacataatctccaattttattgaatagtgcatcatatagaagattagcacttaattgttaataccattgaagttcttgtaatggaaaagtaagcggaaatctaaaaatatgaacaattatccgtttttcaatttgatacattagatcagacagaaaaatgtccataatgtggtacactacatgagaaatagtgcattttcttagtactaccacatttctgtaaacattacagctaacttcatgagaaatataaagcagaactggagcattagctaagattcatggggaaaagagacaagtaggttcaccctaaactcttttgcaccagtattaagcatggttgcaatgcaagtttccatcccatggctatgaatgacagccccagctctcatcaaataagcctgcaaaataccaatgaaaattagacagtttagaacacactagccgaatgttcgctctttctcttttggcaaccatgattggacaatcaataaatgagaattctataaaagctcctaatcaacaccactcccgaatacggtatgctcgatcctaacagaagacacgagagtagccactgctcgattaaccactcgtgagggggaatcgagtgcccctcgcaggcaattcgtcgaacaggagccgtgcaggctgtaatgagagagagagggggggggaccttgggtgcccagaggcggtcgtcggcggcgacccagcgccaggtgctgcgtgcgtccaggagctccatcacccgccccatcacctcctccccgagcacatccacggggtcctctcgtctctgccgcctcctcctcctcctccccctcttccgcctctcccactcctccgcctcccgcttccgccgccgccgccgcccgcgccttggttgccgatgacgtcgcctgcaccttgctcgccgccgccgccgccgcccgcgccttggccgccgatgccgtcgccttgccgccgccggaggaagcgtgagtgcgtgacggctgggtagggaagaaaaggataaggttgtggggaaattagggtttggtttatatatgataggctagatgggctttttgggcttgcaatatggtattattaatagtctaatatacaccctctaagttttgctgacatataattagctcgtactcttacaattactgacagatattttgaccaaaaatatatttagaattactgacatataacatgtctcattatgcactattgctgacatatagtttgccaaaaacctttaccgacagatattgtttatttttgccaacagatgtctgttggtaattccatgtcatggtgtagtataagctatatattccacccctctttccttttcaccggtacactcgccatttttaccgcttgcgccctcttcctccgtttctttattccacagcgtctctcgacccctcaggtgtttcgcccattcgctctcttcgccaccgcatacacgccattcgccatggctcctcgcaagccaaaccctgcttcggcgaaagggccagatcccggccgagtcgatgacgacagcaccgcctttttgggggtctctcttgtggacgacgtcgagctggcgaagttggtcagctctgggcggtggtcgaggggcaggctttcgccccggggaaagccgtggtgccgaagtctgtcgacaatcggacggtggtgttcgccgtgttttttgaggcggggctgcggtttccgtgcaacgtgttgttgccggagatccttcgcctcttccaggtggagcttccgcagttgagcccgtcggcgctagttcggatctccatctttgactgggcgtgctgcacttccgggtttcagcccagcgccgagctctttggcgccatattcttcgccaccgtgaactcgaagacggtgattaccccagctgggacgaggatgaccgtgttcgggagtgtgaatttcaacgttcgccccgagcggtccgatctctggccggtgaacgctgccatgtcgaagtgggaccgccattggatggcgaggtggttctatcacaccatccccttcgaggctggttctgaatcagcgaaaaccctccggtgccggcgtagggcgattgcgccgaaccggaaacccaagatcgctgtggacggcgctatggaggcgcggttcattctgctgcgcaaggtttgctcccgccttagctgccgtgacttggtggaggagttctgtatgcttcgcatctttcccctctcccagtcatggaaagtcacagtcgagcaatgcgaagaggctaacggtttgccgaacttggttcttcctgaggggatgaacagtaaggccgttcttttgctatacactcctgtgctttgttattttaccctgtttggcttttaatcgtgattccccctacttgcttttatagtgctaaccctcgaccaaactgaagccgaagcccgcaagatgatcggcgatgtgtctgttgtcgagttcagccaattgctgacacggcaggcagctggtctggcgaaccgggtttataatggcgaactgcctccccgggcgaatccccacaagactgatgacgaaacaggaccctcgcggaaacggatacgcggtcagataaagcttgcccccaggaagcgaagggttcctgcttcgtcggactccgacgccgacgacgaggatgatgccgaagaacttgacggcgaggaggaaggagaggaagaagaggaggtggaggctgtggctgataaggccgcgaacgaggcgatcgatgatcgcgtcgacacccctggctacactcctaccccaagtccaggtcacaacgagactggagtggagtcgaacagctccccccttcgacgaaaggatttggaaggggcgaaggccctagttgcgttctcgtcgggcaaggcggcgaaaggaggtctggtcaagaagatctcaaaaaagaaggggctcgtcgacattgctcgcattttcagcgacgacgattcttctgacgagactccgacttcacctgctggtcgcagtttggacctttcgaccgctccccttgctccgctcggcgtcgctggggcaggcggtagcgccgccaccggggcttccacctccgccgaacggatcgtgtcggctgcggcgagggtttttgggagccctgtgcgcgagccagctatttcgccgctggtcaaggcgaaggggaagtgtgcggccgccgaagcatctgcctcggagtattcccttgcggcgccccacttcgcccctggtgacttcgagacctgggcggaccttattccctttgtggagggagtaagcaatcttgtcttgcctgccggcaccccgagcctgttcaccgaacttaacgagttcgacgaggggtgttccaccattaaaagtttggcggttcgggtatgccctttcttccctcttcgttttcctcttccctcttatttttacgtctcgcaattaacctttcgttcttttcgcccgctcctatctttcatttagatttttgcggctcactgttcgacggagcgaaccgtgcgggcccgttttgatggttttaagaaccgtcttcgggccaaggatgatgaaataagccgcaagaacttggaggtggagtccttggcccacaccctcaaggaggcgaaaactgaggtcaaacgccttcagtccgaattggacaaggggaaagaggcctgggccgaggttgatcgcctcaaggccgaactggagaaggagaaggcccattcggcggtactcatcgattactacaaccttactgagctgaagatggaggctcttcgccagaaggctagcagggccgaggcgagcgccgcggaggagtcgcagcagttttcgcgggagatggcgaagaccaccgaatccgtgagaacggcttgccaaacgctccgcctcgcccttaccgacatgggtgcgaaggtgcggggggtccctgccgagggtgcctcagccttcgacttctccgagtggacccagcaggctggcggatcggtttcggactgtgccaccgcgtacggcgattgctgtgtgtgcgtatcggcggcctttaccttaggccttttgcaacagttcggctgcgagcacgtcgccgagttccctacctatgcgaagggggactgggagattagcgcgcaggacatttcgccagctcttcgcgcgtggagaaaacagttctggcagaaggatggccagtccgctgccaaagcgcgccttctggagcaactggcgaaggcagaggcggcggacctttgtgaagaggaaggcgcggcggccggagggggtggaggcgatgcccaggaccacccagaggtgtgaggccctccgctcttctcttagattttcatagtttttttttggtgctcgctagatgtggcgaaccgttgtatattcggcaagctgccgctaaaccttagaagaggcctttttgcatacttggactgtatggcaattttaaccactttttaatgatcaaagcctttggcatattattatttcgctcatttcgcattatgccataccttccccttctgttgcctattcttactatgtaagtcgtgttttgccttttctgcactgtctaccagggggttcgccgaaaatcatgcattcggcccccttctgggagctggcgaagtcaaaacgagaaatttgtggcattgaagggtctgccgaaggtgcgatgtccatttcggcctgtttatcgcaaaatggagataaacggtcgcagctataaagttttcaaggttgccaactggctgcgggcgcaccccgggcaaaccttagaagattacgatcatgttcattcaagacgtttggaggatatggctcgcttttggtgaaaccatcagaagactaaacgccaggaatcgatctttcagcgtcgttacagtttagtctgtgtttcaccccctactcctcttaaggttgtgtatgatattagtagtgatgacgaacctagtttgtctgaccattcattagggagggataatgaatacgggggcgaagatgtaatttacttgtgaagtgaattgtatcgggttgtgaaccttgtgttcttcgattttttttttcgaagttaataaagaatgtgctttatttccttttcgctatttttcgcatcgtcacattttgtgcttttgttaggtcggaacatgccggcccctttgcgcatattagcgaaataggtgtactgacttttctgcttttcgtcgttcgttttcgacctgtagcattctgtgtcgaaagagacacttttgcttttatgttgatcgaatcgtaacgttgttcggctagttattttccgagacaagctgttgcggtttcaacgttcggcgagcgatgcttcgaccgattcgtttctcccccctggccttttttgctgatcaggcgtttgccttggggtttttccacaaattatcaatcacacgaaaaaataaaaaagagggcgaaggacacatacattttatactggttcgggcctttcttaggcccaggtgaacggcttcatattctcctgcattgttggttgtgtcgaactgcagtcttgctgcgtatcgaatcggcacacctttcggcgaaaataggactgccgcaatgcctgctcccttgtgcgaccacgagccatcggagcacatcacccagaattgttcggcgagctcggggtcggggacaagtaccggtgtccattcagctacgaagtcggctagcacttgagacttgatagcagagcgtgcaacaaaatgtaagtcgaacggggatagctctgccgcccacttgctgagccggccagtgacttccttgcctcggagtattttgcctaaggggtactgtgatggcactatgactttgtgggcctggaagtagtgcttaagcttgcgcgaagccatcaccagggcgtaagcgagcttttccatttcaatgtaccttgtcttcgctccttgcagcgcttcggagacgaagtagaccggtttttgtccgaactctgtttcttggacgagggcagcactgacggccaccggcgaagctgctaagtataatagcagttcgcttcctgggggtgggcttatcagagctggtgggctttgcaagtattgctttagctcgttgaatgctgcttggcactctggtgtccaattaaactttcctgtgccccggagggttttgaagaagggcaaacctctttcggctgcctttgagaggaatcgattgagtgccgcaattcggcctacaagcttttgtacttcatgtacgcttgacggaggcttcatttgctgaatggcatcgattttctcgggattcgcctcgatgcctctttcggaaacaaggaaacccaacaacttgcccgcgcggacgccgaaaatgcacttctccggattcagccttatgcctgctgtacgcaagctgtcgaatgtcttttgcaggtcgatcgcatggtcgaaagccttgcggctttttacgacgatgtcgtcgacgtaagcttccacattcctccccaactgcttgccaaggaccttgtacaccagcctggcgaaagttgctcctgcgttccttaagccgaaaggcatcctgaggtgacaaaatgtgccgaatggagtgatgaagaatgttttggggatgtcgagcgggttcatgtggatctggtggtaaccggaatatgcatccaggaaactaatgagctcgcatccagctgttgaatccatgagctggtcgattcgcggcaaggggaagtcgtctttcggacatgctttattcaggtttgtgaaatcgacacacatgcgccatttgtcgtttgacttccacactagcactggattcgccaaccactcggatggtcaatctcttagataacccccgccctgagcaatttttgtacttcggctttcgccgcttcttggcgatcggcagacatcttgcacaacttttgttttcttggcttaatgtccggtttgactgctaggtgatgcatgatgagatccgccgggacaccccccacctcgtcagggctccaggcgaagatattgatgttctttttgagcacctctaggatactctcaacttcttcttcgcccatgtcgccccccagtgaaacgagctttgtggggtcggcgtcatcaatctgcacttttgttatcttgccatgagggatgggctttggcgtgtgcttcggccgttcatgcggttcggtctcaacactgtgcactgctttgctgattatggctagatcgccttttgaagcggccgaaggatgaagccccttgactactatcacccctgttgggccgggcatcttgagcttgagataattgtggtgggaaatggcttcgaacttgttcagggttgcacggccgaagatggcgtcgtagttgtacgggatgtcgacgacgtcgaacagtatttgctcttcgcgtctgttctcccccgagccaaaggctatcagcaaaagtgtttggccgagaacttgaactgcctctccgccgaaaccacggagcgatgctggtgctagggtaagggcttgggtaggcaaccccatcttggcatatgcttcggcgaagatgacatcggccgaactccctccgtcgaccaggattcgtcggacttcgaaaccagctatctcggctgagattaccaggggatcttgatgcgggaacataactccttctgcgtcttccagcctaaaagaaattagctggttccgatactgcggcgccccttaacccgccgaagtgatgctatggaccatacggatctgcatcttcttctgccgtttggacaactggcttggcggatcagcccttgtaatcacttggattatccttcgctgaacatcttggcgttgttcggctgggggtgtttgctcctgaattgcttcgcgggatgcttcgacagttgttccctgctgcagccttgggtcttgcgcgttgccacgttgcctaatgtttcggcattgctccgtggtgtgcgaagagcgtccgtgaaaggcgcaatagaggtcttttcggaccttcttgtgggctggctgctgatggttgctcgcttgctgggcatcgaactccttgcggagggcttgcacttcttcgaccgccatcatagctttgcccgcacggtctgttctgaactttctccaagttatgggggcctggccttgccttgacggttgtccttggatcgccggctgagactggcgaacagagaggggaggtggttcggcaatttgaacttgtgcttgagcttaagcggcgacgacggaggctttgtcgtactcagcttgtatagcttgtcgtcgcttggaattctcctcgcccctcgcgaacccgtcaatgatgcgaagtaggtgctcgagcgtttgtggctccttgttggcgatttttcttgtgagttcgccctcaagcagaccggccgatgcggcgtttataaccgacgcctcggttatgtcttgaacttggcaccgggcttgcgagaagcgacgcatgtattcccttatcgactcccccggcctttggcaaatgccgaggaggtgttgctgcgtcttcggctcctcataggtgcctcgaaagttaaggacaaaaacatcgcgcaatttctcccatgagtaaatgctattggctggtaaattgaaataccaagaacagacgatgccgtctagagcgagatgtattaccttcgcttttgtattttcgtcaccatgagccgcttcgatcgctgactcgtagatgaagaggaactccttcgggtcagtttcgcctgaatagcgcgggaagggtgggaacttgaactgcggtgggattggacgagtcatgattcccccactcagcggtagccccttttcgcctcccgccctgtttactgcactttgctgcgggtacggtgtggcgaagggcaaaatcgcagcttgtgcgcgaggttgcgccatggcattcaactgcctggctccaattggaggtacttgctgagccgccatggatgggtcaaaaattggctgcgacagcgtcgtggcagcttggattggtgcttggtttgttccgaagcctggagttggagcttgctgccgaacggttggtgcctgagcagcgttgacgaagtcgaactgcagtccttgattccatggcgaaactcccaggcccggctgaatcggtggcaaccaattaggcacaccttgacttgtattcccctccgggtgggccgatgggggtgtacttgaaatgcagtggggttggttgagttgctgaaggaaagcttggagttgcgcctgcaaggccgaaaccccttccgccactgtttgtggtgcttggccgggtggttgatggtgtacttgggcagcgactggttgagcttgcagttgcacgtgaggggccgaatgcactgctgcggccgattgctgcccgacgaagtacaccggcgcctgcgcggcttgtggcggaacgggctgggtcgtcgcttgcggatggacttgagatgggacataacctgccgaatactgaaggattggagccgacatggccttggcccgcctcgccgcctcgtatgcttgttgttgctcttgcatttggcgaagcatgtcttggagccgtgtcatgttctgccgcatggcttccatgtcggcttcggcttgtgctttggggtcagggctgacttgggcctgcacaacgacgggcgcagttggggccgctgccggctgcgatggagcggcttggggcaccaccagttggcttgtcgaaaggatctccctggtctggagtgcccttgccgccgcagccgccttcgccacgtcggccgcgttcggcacttgctcggaggttgcgggggccgaaggcggttgtgatggcgcttgtcctcctccatcttcggccacgggcgccaaaggctgtgctccttcctcggtggccatgtccagtccagcgtcgcttaccttccgtctggcaaccttctccttcacgaccctcttcggtggcattcgctctcagtggtttcgctcgaaggtccccacggtcggcgccagctgttgtcgaaatgacaactgcatacgtcgaaggacgtggttactcaacagtggttggaaggaaacgaagtgtattgaattttgaatttctgtcttcgaatccccctattacatggccctaggggactatttatagccccactacaagttcttgctactagggtttaggttgtacaggggaatttacatgattacccttatgaaagggacatttacaggggtacataatgttatagggactcatgggcccctgatgggccgtctggcgatcgccggccctatagcccttaggcttgatgggctggaaaagcttcctcggcccttgcgggggcgaacttgccatggcaaagtcgtcttccttcggcagatagtcttcgccttgcacccttcgcccgagacacccctggcctggcaaggcactcgtgcgactcttcgcctcacgccgttcttgctccatagccttcgccacgggtttcggcagatttggtcgaagggcctcatgccatccgccaacagctttaagatgggctaatagtaggaagtgagctctactattatccttgctctaaacttacttccctctttttcatgcgcacactttttaaattattattccctcagtcctaaaatatactccctcatttccaaaacctgagtcttatttctttttcaccaagaccaagaaacaattaattcattcactatgtgacaaaaccaatgaacatgtaaccaataagcattaaaatggcttcttggttcctatcaacaatttaatttagcacataatgactacaaataggacttagacttttgaaaaaaaaaagaatgaaataggtcttaaacttttggaaggagggagtagcaaccatttactagatgggacacgtcctagtacatagtacaatgaatctgaacatactgtccagattcattgtactcggatgtgtcctatccagtacaaagttgctatattttaggacgaagggagtatattcgtaaaggaagtagtttaggacaatgtttaagtcaaaccttgggaatataaatcaactctcaagtttgaaaatgtaaaaattatataaatatatttgtcttgaaaactactttcataaaagtatacatatatcacttttcaataaatatttttatagaaataaaatgtcaaagttgtgttttagagaccgtgtcgctgtccaaaacgacttcctttatgagtacggagggagtatgtcctttacaaaagttttctatagcaaaaaataatattgatatattttacaaaagaaaaactaatagtcctcaattaattacgtgttaatggatcgttgttaatggatcgttccattttccatacgggaaggtggaactggaacatagccttaagttgttctttacagttgtgccaatcatcctattcagtcgttctatgttctctctgtttcttagaggttactccagatggctttattttctacggtagatagagatgaagttgcaaaacaagaaagccatggggcgtgattaattgagttttagttattataaaattagaaaatcgatttatctcatattttaaaaacaacttatatatataattcaccgttttagctgtttcagaaatgtagatgaattggaggcagtatatactattaaactcgctcttaaactaataaagtgtgtttttttaaaaaaaaaagtttctacacaaaattttctataagagtcatatcaagccatttttaaatttttttaagctaatacttaattaatcatacattaatccgtcgctctctttagcatgtgaaagccaagagcaggtacaatagaaagctataaacaggccctaagagcaagtttaatagtatagctaactactagctccaattcatctatagccaatttaatagcttattcatacaatagttacatactacactattaatacctgatcccacctgtcagacacatactgtgtcttagagtccatgctacaactggctacaaatctgtagcccgctgccattctctttccttatttatcttcttaaaatatgtttatagctagtttatagcacgctattttaacttctcgaagtgtagctccatgaggcagatgcatgggtgtttcgctgcgaatccgtaggaaaggcgtcgatggaccggcgcgttcgtactcgtgaacagtgtctcgtcgctggttcggctttacgtgtactcctattaagtactactcgggtcgctgtgttgtgcccgaaagcgtgctaagcagcgggcagacgtgtcgagctatggttggaagacttggaagactgaatttgttcgtgactttcgtaggcatagtaggattggatcagtgagtgaccgcaaacgagtattacatgtgcgtggagattgattttcgtctttcaaggtctttcgcgttttatagtggagtatataatctaaattagatatcaaaatatgtttaaaagtttagtaagatagattaatatataatataccatttcacaagtatgtaagttcatatccgatctatacaattataaaaaaacaataaatttgactgtagattacgtattctatttgatattaattttatttttgtttatgtatagtataagcttaatttgaatttttcaggtttgtgaagtgatataggagtgtcacattgatatattttatatttttttataactttttaggtgacacgtaaaaatgaggatcatctcctcgagtgacgaatagactttccctttttatccctttgcatgattctcattgttttgtatagagttatatatagggtggtttactcttatacttcttagtcgtaggggcgtatctaggggtagtccctgtgggcttgggactacacctgattttggcccacaaacacctatctcttcccccgccaatagccgctcgtgcccaactctttcccgtcgttgcctcccagctccttccctcgccgcccacgctaactgcaccgccctgccgtgcggttgtgcccagctactcccccagcgccgcacgtggagaagagaggaggggagaggagagaggaagagaggtggagaggggaggggaagaagagactgacgtgcggggcccacgtgggccccacactaagtcaactgccacgtcggataaaaccggagacaaaaccgctgagggacctagttcgtactggttttctaagtcgggggatgcgttatatcggtttttttttattcaaggacgattttgtaactcgataacaagttgagggaccttcggtgtactttttccttaaaaaaaccaggcccaaacaatgaaacccaacagcccaagaggcaacttgggttgagtgcaggtggagccaccagggcgccagcgctactcccttcgaggcttcgggcttcgcttgtacaccacgccgccgccgacacccccgacaccgctttgttgtccgcgcaacgccgttgccaagtcttgtgggtctgccattcgtgactccgcgccgcaccgcaccgctcgcattcgtgggacgcctttccttgcgtcgcctcgcagcgagccagcgatggcggctggctattcgttctccagtctgtgcccctccggtactcctcctcttagaataatgtgggtcccatttacatttgtttttattttagtgccacgcaagcgccacttcgatgccatatggaagtaaacccgtcacgtaagtgtcacgtaggacaaaaccacctccgaaaccgacgagggaggtgatttactctggttttcagagaagaaggaggcgttatacccggttttccggttgagggatgttattcacacaagagcaagagatgagggaggtaaaatggacttattcctttgaaatttcagttctcttttcagcatcgagagtgggggagtctatccaaagtccaaacataataggaataagttcatctgaggtcccttaacttgtcaacaaatccgattttcgtctttcaaccgaaaaaccagatacaacgcgtccctcgactatcaaaaccggtgcagatgaggtccctcggcggttttgacggcggttttggctgacgtggcgcctacgtggctggtttgactcggtcttcatttcatgtggcattgacgtggcgcttacgtggcaattcgatccgaaaaaataataaaccccatgggccccacatgtcagcttcagccaaattaataaaaaatggtggggcccacgtgggtcccacacgtcattcccactcttcttcttcctcctcctctctccccatcttccctattctctctccaggcacgacgggaaagtcatcggcccgaggggaattggcaccaccaccaccaggcgacggtgatcccggaggagagcacctaccacacaccgccgcacatccctcctccatcggcagcagctggggatactgtcagccaccggcggcgcacgcggcgagtgcaggggcacggtgggtcagcgtccggcgaggtgcactgacgcgtgctcgccgggagagggtacatcagctactagtctttgcgccgagacagcgtcccgtgctctcgtcgtgacgccagctactacaactgccgccccggcgcctccgccaacccctaccactgcggctgctcccgcatctcccactgcccgcggctgatctcctcctccgccgccgccgaatccaccggggaagatggcattgtcatcgtcgtcgccggtgtagtaaactagtaatcgagctgttgttcttgtgttcttgcagtgccactcctacctctactaattagctactactgttaatattcctttgtttgatttgttgctgctaatccggccaccaagcgctctctctatctctctctctctgcttcattagctccccgtggcagcgatggcggctcagaggaggctgctcgccgaggcgcctccgtaccagccgcactcctcgcggcaccagcagggcgcactagggcaccatctgccgccggcttcatggggtggttgatggtgggcatgaagccggtgatgacatagcgggtctcgtcggagcagcggacaatggcgacctcctcgttgcggaagggggagacgcgcgggtttggtagccgccggagcggaaggagtcgtaggattcgatgccccggtggagctcatcgtaggggtgcggcacgcggaggagggctacattggcgtgcgtgctgatgactcggggatcgacagtgaaccggtaggcctcgccgccggcgggagatgaagaggggggagatggagagaggagaggtgtgagaatgacatggggacccatgtgggccccactatttttttattaacttgtatgttaaactgacaggtgggtcccatagggtttattattatttttggatagaattaccacgtaagcgccacgtcaataccacgtcaaatgaagaccgagtcaaaccggccacgtaggtgccacatcagccaaaaccaccgtcaaaaccatcgagggacctcatctgcaccacttttgatagttaagggatgcattgtatctggtttttcggttgaaggacaaaaatcgaattcgttgacaagttaagggacctcagatgaacttattccaacataataatcatcgttaagaggaaagccctggttcggcccggcacggcccagccctacaatccctcccaactcccgtgattctcacaggatcggttgctccgtcgtgggcgccgccgtcggcgccgagaaggacgcggcgtggacccagagcagcgacgccacggagacgaagaccaccgaccagagcacggcgatggtcggcggcgcccggtctcgcggcgccaggagcccccggaggaatccctgaaggtgcgccaccacccacccggcgagcgccagcttcgcgccgagcgcgccccacgactggtagtacccgtggtccaccccgtacgccaccgccgccaccaccccggcgaggttcgccaccaccacgctcgtcggcgccaccaacaggttcgtccaccgcatcgtaatctccgatgccaatgctgcctcctcttccccgtcatcgtttcctgccgccggtcgcttgggtggcgaagctgccgtctccgtggagaaggcgacgtcgatcccggtgcacgcgctgaggatgccctggaacacggcggcgaggctcgccgatgtggcggtgaccatccagagcttctcgtctcgccaccacgcccgcagtggcacgcggctccacctcagctcgagcgcgaccgacgcggccacggagaagagcagcaggatgaggaggacgccgtcgtagtagctcacgtcgctggggaacgtggacaagccggtgaagaggcagacggccgggagcgcgcagtaaacggtgaacggaagggaggcgagcgggtaggaggcgcgggccacgtagcccagccgctgcaggagcccgaggcggcggccagcccagacggggctgtgccgccggctcagcaggatccccatggccgccaccgctcgccgcgacgcccccgcgaggacgtccgcggggctggcgcgcgcgtaccgcctgaacgccggcctcgccggcgagcagtacgccgacgaccacccgcgcgcgtgcatccggaaccccgtcgcgacaccgccgccgtacatccatccaatctgcacgagaacaacgacatcaacatcatcatgggagcggaaggcgaagtgatcatcggcgaagctgccacctctttgccccatctcgtcctctcctcgaacgcgcagctgacgacatggatggcctccttgaggagagatcgcgctggcgccacggtcgcgtcaggcgagccaccgtcgccgccgcgtcgccgcccttgctcctcgaacgccgaggcgatgaacgcgggagactggccgaagtggcgctccagcgcggcgcggtacgcgcgcagcctcctcctcctccccgccgcctcctcctcctcctgttcgtcggagtcatcctccgagtccagcaacggcacggcggacatggacctcctcatcgcgttcatcctcttccccctcccgaagcagcacatcctcctccagtccgccgccgtatccatgtcgtcgccgtcgtcagccgccgccgcgggctcgaacccgtacagcgccttccggctgaagcagcaaccggaaccgacgtacaccgggccctggatgccatcgaggcatttcatctcgatctgaaccagatcgagcagcaagaatcagcgaggttacgcaattcagcaacatggacatttcgtctcttacatcgaagaagacggagtcgccgccgccgctgtcgcgcagtgcgaactggacgaagcacgtcctgttcccggcgaccgggtccatcataaagcacatcgcctctctcagcgcgctgctgttgttgacgcagtggtcgcagtccaggttgaggacgtaggcgccattggtaagcacggcggataccctgagctgcaccgatcaaaccaaaattcacatcgcaaccagatcaacgccatggacaggcaggcaggcagtgtcgcaacgcaccagcgcgttcatggcgccggctttgccgtggtgccggaaacccggtcgcttctcccgcgacacgtagaagagacgcgggagctcgccgccgtcgacgtcgcggtcgccggggtgacccaggagcacctggagagacgaaccagcttgatcaaaatggtgacaagcgctcgagagaagaggcggggaattttatggagaggtttttttgatcgatcacctgaatcatggcagggtgatcccgcgagttgttccccggccacggcgtgccgtccgacatgatccatccttcctccggcaccttgcgcgccctcgcggcgaggtggttcatcctcaccttgaattcctcgtactccctctgcaacaacggcgacggattcatcgatgcgtgcatgcctacaaggtgttcggcggtatcgcctcaccccaccttcatggcacggcggtccttgacgaaggacggcgcggcccggtcgcggaggtagtcgacgccgcgggcgaagtagagctcgggggccctcggctccacgccgtggcggcggcagaaggggatccaccgcctcgcgaagcccgccgcctcgaagagcgactcgaacaccagcatgtcggcgccgtcgtcgtggacgtagcaggcgacgccgcccgccgggtagtccgccgcgagcaccgacagcacggtgttcgccgtcgccagcgggggctccctcgccgcgtccgccgcggcgacgaacacgtccacgcccgccagccgcgacgcctccccgcccttctcgtacctgcatgggcaggaggagtctctgtctcagtgtcttgcctcacatggccgccggccatggcgatcgagatgaccttgaggccagcctgtcgaggtacgtgacgcggttggccggggagagcttcgggagctgggcgatcagccatgacgcggcgagccagagctcgcacgcgacggacgtcacccacagcgcgtgggcgtcggcgacggggcgggtgacgcggtagcggaagaaggcggcgaggaggacgagccggagcgcgacggcggcgcggtacaggttgagctcgccggacggtacggacagcctgctgctgagaggctcaggtatgtcatggtcatcaccactgcaaaaacacaaaccccaaaaatttcatcaattttttttcgcttccaatcttaatgaccatgttactaatttgattacccattttcagaattggttatgaaccattagcatggatatggtttagcattgtggggattgatgctataactgataacattttcagttgttacctttctgaagatgcaggctcaggatcagggcattctacaggcattatctctgggctctctccatccatctcggagctaacaggtaacacaattcagcaaaacacttgattcagtttttactctatctacaaagtcatctcaatagcgtaagtttggatgctactaagagtctaagaccagacaaaactctcttaaaaatggtatctgtataactgtaccgtggtgtcaaacccaatccaaccctaaatggctaaatcatatatagtggttatgttttaactatccaactagacgtgacaaaatgccgtattaataacttcctgcgatgattgcaaggcagcctcggtgaaagaaacaacttagctagacaagcaaactgcctctgtgcagtatcgccaagtaacagacaacgtggataatacagaggatgaattcgtagtacagacaacgtggataatacagaggatgaattcgttatgtacgtgctgaggaagcgaggaatcaggggaggcagtatctattgattctctcctgtaatttttactgatgtatataaagagtgagctatattgaagcctaatgacaaaaaaaaacacatactacctccgttttttaaatagatgacgccgttgactttttctcacatgtttgatcattcgttttattcaaaaaatttatgcaaatgtataaaatataaatcacacttaaaatattatgagtggtaaagcaactcataacaaaataaattataattacataaatttttttgaataagatgaatggtcaaatatgtgagaaaaagttaacggcgtcatctattaaaaaacggagggagtacaccacagatgcttagacagaatggtattcttatttcttaccggtgtttgtgcagggacaaacctgatcgacttacaagcggaacaatccggtgcttaatcttcgatctcttacaggtaaatacaaatcatatagggaaacatagaaaattaaatccgatgcgatcatgcgagctctgaaagaagttgcatttccatcatgcattacactcacataatcacattcctactgaataccggctactgttcttcaacaatataccgtactgacactgtcatcttcaacagtagacgtttgtgcgcaccatttgacggccggaatggcggaattacatacatttattacacttttgcagggctcggccaatccgccaataggaggtagacatggaaacaattatatgccttccagagttgattcgagaaggcataaataggtaagttcatttgtctcgatctggctagcactaacgagtacttattcaggtgcatagccaagaatggttgtatttaatgtagtaattaattttatctaagaaactacaaatcaatcaaaagggagcagcttccctttgagtcttagttgtgactctgccaaatggagctagccaagctaacaaaattaatcgaactccagattccagactacagattgcggttactagctgtctccgccggcactgctgtctggccctcttctgtttgctgttgtgttcttcagcacctggaaataacacatgaagttaaacatatgtcatctcagcatttactagcacaattatataatcttcagatacccttctataggcagcttttctttttttctgcagtctgattctcgtatcatgtactatttatgtatatatatatatcaggggtgttagttgacaggaagcttaattacaaggttatcaacataattaaaattatgtcaactgtcaattaagtgtgtatatatgaagagctgatcagaattcagaattatgcatatgcacatgtctgcttcgaaatacagttttattacctgcctaagcatctggttctcgttttgcagggtagagagcctctcctccagctctgagttgctcctctccaggtccttcaccctcgcctccagctcactcatgtacgccttcttcctctcccgagcctgctgcgctgacacccggttcctcagcaatctagtggattaattcccaaacgcccgccacaaaattaaggtcttatagaattaatttgcgagtgtgtatgattgagaacaaattatatggtgttctatatgcatgggcagtcaaaaatagatgtattacctctagtcacaaaagtatgccattttagtacttgtgtaggcaacacaagttagctttgatcataattattattttttctaaaattttagcttacagacatatgaagacaataattaaggtagccaactttgtcctagcacaaggattaaatattcaaattatgccttgttgatttagagaagtccaaaatgtctttcttttgcaaccaccaggagtaacattctaagatgtttttttaatcggaaaataaatggtttgattctttgggtagcagtgatttgttattggtacctttatgtagacatagagttaaaataacaagtaatacaaaaatatggtactagtaatacagaagtacatgtgattggatatggttctatattataatattattcaatcaaataaagataaacgtgagttaattaacttgaaaataattatttgcatatcagagtcaataactcaatatagcttgtgtaataatatcaattttgaaatgcattagaataaatatgtagcttggattcaaatgtatatataaaattacacccatcctattttcacacctacagatatatggcacaagttccatgtgtcaaagaatttgcattttgcataaaggtcaacatatatcatgattggaataacatcaccatatgctaaagtactgctaacgaaccttcccccatagacctgaaagtgttgggcccatttgtccaatataggacatagataatcttcacatgtagattcgctcgagtacaaagcatcgaacatcaaacaacttgtcccaaattgttggaatattgttaataagtttgtgtcacatcagaatctttatcatatgttaacatgtcagctgtttaaatggttggtttatactatgccaaatttgaaaggatacaaatggaaacatcccaatttgatttgttggttattacattttctaagaaaatgtctgtatacaaaatagaattttacaaatttggcatgtacagtttacatggcatataatatatgtactccttccggttataaatatacatcgccgtttgaatttttttgtcaaacctttaaaattttgactaccaataaattttaaaatacgtaatgcatcgatttgtcttcaaaagtaatttcataattaatctcttaaacttgctagatttaataaaaatattttaatgaaaaatagtcaatgtcgtgcatcgaagaccgataggaagcttaatgatatatatttgtgacctaagtgatcgagcattagacttctgatgggagattaatcaatattcatagtaatttttttctaaaacagtagaaatactcaagcaactgagcaaaaactagccttctagacccctaattaatcagtatatatacaggagttctctgaataaaaagggacgtggcgtacagtacaaatgtacaatacacatataaggactactccatccgtcccataatataagagattttgactttttgctacattgtttgatcactcgtcttattaaaaaaattgtgcaaatataaaaaataaaagttgtgtttaaagtactttggataataaagtaagacacaaataaaataaataataattctaaaattttttaaataagacaaattatcaaacagtgtaagaaaaagttaaaacccctttatattataggaagaatggagtaattaacatgacgtacgtatatatacagtacacatacgaagtggaggcctacactacacaccttttgaggcgccggtgctccttgtcggcggggctgcgtccgcggcggcgcccgctgctgctgctgccggcgacgccggcctgcgccgcgggcgacgacgacgacgtcccggccgccgtcgccgccgcgtcacctgcaacccgaacactacctctgcccgacgtcgacgtccccggcagcgccagcccgaactccggcaccctccctactatctcctcgtcgtcgctatccacccctgccaacgagatcgatcgctagatcaaaaaaatctgcataattaattaagatcgagacaacaagcgacagccatggcgatcgaattggtgatcatcgatcgatcaagaacacacacaaaaaaaaaaataaatcgagacatgacgatgagagatcgagcgtgtgcgtgccttccttgccgtcgtcggtgtttggggcggagtccgacgacctctcgctgctggaggcggccgccggcggcgagctcctccggtgatctcgttgcattctcttccctcgctgtccagcttatcccactcgctatcagtctatatgcagacactagctagctcgatcgctcgatcgatcgtctgggagctgagatagcaagcaagctagatagcagggaactagtaattgtgggcacgtttctctgtcccctggtgtgtctcactggattcttgttttgtttgattcgagtaagtaaggggggtatagcacagtgcctgtgcgtccggacatggccactctttttgtcgaaaacaggcatatggaacatgggacatttagcagcccaacccctgtcatttccatgtattacatacaagtgctcactacttttaccttttctttttcaagtgacaaagaagacgcacacacgcacatccacgaattcgcgaccttaacactcgctttaagagagaggtcgttgtcacatacaaattttgtatatatatactggttcaaatctactgctctaaattgcttttttttaatcatcaacgttggtaaaagatccaggggtctttcatgcaatgatgtaaacatatgtttttcttgaactggggatttttttttttgtgttaacaagtaatctactctcttgagtacgtatactacggccggtgtggtgcaaggtctgctctggcaaagctgaatatgcaaataataacatgtttttcacttgcgtcttcacagggcatttgtggagatcgatcagaattcatctttcatctattcagtgatagatcgcgagattcttcaaccccctgctaccaattctgagtttgtgttcaaggcattctatctcctttgtttctggcgcggtggcgcctatgaaatcatcgacatgacaatgtattccacggagaaccttcatcaatccaaaagattttgagattatctgtgtggaagatgcaactctttggatagcaagaaagaatataagagagcacgatgtagtttcgcattggaaagaactcttctccaccttcatttgtaatccttaaaagacaataattctgttaattttggtaatggaagttttaaggtgggggaaagtctctcccccgtctaccttttgaaaaaaaacatactacctctgttttttaaataaataacgtaattgacttttgaacatagtatgatcatttatcttattaatgtaactagctgggtggtccgcgcaattgcgcggctagcacccatataaaattatatatttttaatatgattttacttaaaatttattaaatagttatctcattgtcttaaatttttttagacaaaaccttaccatccctgtgtttctaattttatagtttttcaaagacacatcagttgctacccttacttctgtcatattattttttttattatcttgctcgatctactactgtttctattcattctccttggaacctttaaaaattagatctaaaaacttatagttttagagtttattgttctgttgggcttcttttttataataatttctaaaagtcctatcaaacgctgccattatactcctctacaaccatccactgcatcttctctttattgtcattgctattttaaaattcgaacataattatcgtttaggttcgtgtttttactttctagaagttctgctaaaagtcagggactttgtcactatactcctctacggttcgcccgctgccgcccttctttcttgtcattgagattttaaaattaagcatgattaccattgggatttatttttttactttttaaaagcccgaacctttaaaaattaaaccttatagtttttagagttttattgtctcgttgggtttatgctttttataatttttagaaatcccgtcaaacactgccactatactcctctacgacccgtccgctgcataatctttattgtcattgggattgtaaaaatcgaacataactaccattggaattcattttttactttctagaagacccaccaaccatcggcggctctaccattgtacttctatacgacccgctgcctctcttttttattgtaattgagaatttaaaaattaaatatgattattattggggtttattattttactttctagaagtcccccgccaaccgctttgactgattgcttcacgacctgcccgtcgtccttccttttaatcgtcatttggattctatttggtgttttattaatatattttagatgtctcatcaaccgccaccactctatttctctataggcttgttacttaattaatctcgtgatggtcttttctttcaatagtcttatttttattaccaattttagctatttataaattgtattcctaattgaaatattttttttctttttctaatttcagaatttattttatttattattatgttcttttgatatttttattttttattttcaattttagttgtttcaaatttatattcatactttaactctctttttaatttgcctaatttcggattttattttattctttattaagaattttaattaatctactatttggttcttatatgtactcttatttcaatattgcttatatttaattccgaatttaagttaattttaaattatattcctacttgaactcttattttcttttcttttttctaattttgatttttttattctgaattttaattaatctcgtattggattgttgtatggactcttcttttaaccttatttttaactccattttagttatttataaattgtattcctagtcgaactcttcttttttctttttctaattttgaaatttatttttttattattccgaattttaattaatcacgtattgggttcctatatggactcctctttccatattgcatatttttaattccgaatttcagctatttttatattgtatttctaattggactcttcttttctttttcttcgattaatgtgggaatttctaacctccacagcgaacgtggtgtctcctttcaaggctgttttaataatataatagatagatagatagatagatagatagatagatagatagatagattattatttatttttatgtgagttgttttatcactaaaattactttaaacataatttatatcttatatatttatataaaatttgtgaataatatgaatggtcaaaatcaatggtgccatctatttaaaaaaggagggagtatgaaattgtcaaatactcctactttacttattaggatgcattgcgtatagtactccatataacatcaatttgcaagaagtgaatggggtcaagtgaaaaaagggcagccctttttgtaagatccaccctggcgttcccatgccgagagggactccatccaaaccggtcgatcggacggccc

SEQ ID NO: 67414 - DNA, 1637 bp, Oryza sativa
cctgtattgcaaaaaaatattatgtttttgattattcttaaggggattttcatttgtggtatttaggttcctgaagggcttgcacagcatgttacatcacctatgcaggcacaggttacatggttaggagaagatccagatttaacagcttctgaacttaattttccattaaccattacattttgtatacataagtcaataattctaaagctgcattgagtcctatagttcaatatagaaatccagttagccacccaaagctgatactctcttcgattgctatcaggtataataccctctttataatatccaatgatttttagcaatggaactatcacaattaacactgctgtatacatgtattttaatgagcacatacacagttttttgaaacaaatttgtactttatttttttggtataaatctatatagcttataaataatgaatttatatcctgtaggcctcgtgatcatctgtaagacatattacccaagccactgtatcctaaacgtagaggtttaaaaattaataattttcattgttttttttaactcggaacaatatgctttagttctattctttgcgaagaacaatattcttagtcaagggccattcagctaaaatttttgtttctctaactaaattaagataatagttttgcacttttacttttgataggtataggaaattgttggccgcatacaaggatattaaatatccacccaaagaatcaccagatgctgctgtgcttgttgctgcccccttgagagggatcgaacgaactaatttggaggtaattatttgaaggtattaggatagtcacaaaatttatctacatatatatgaagcaagtaaagaaatattattcaaatgctagtttctctatttcttagcaactgaagtactcaatctatcccagaatagttttttacatggtctctaacatagaactttttccttttaatttattttccataagatattatgaatgctcttttaaatacgaatctaataatatcacatgcatggcacaaaacattgttagttattttacttattagtcaagggaaaatgttgattttcctaaattatattctgaaaaaatgtctcaattgttggtgatatagtacatgcagatacaacaaaatttcataaggacgttagattgttcgcatttcctgggacatgaaaaaatcgtatggatcttatttcaaaaaaaattgtatggagaggctatacgctataatattgtgcacatttaacaaaaagattgttggtagataaaaaatctattttccctagaagtgtaagagaatgtctaggtttaccattagggcagtattgttagttaaattaaaatcattctttttgtatcaactcaaaattataacattggataatactatcaactcagagaataatctgttaattgttgatgattttctccaaatctggactgctaaagaaattataaaaccagttaccattgttttatttttgtctggtaactgttttactttcagattaacaccacaacaaggcaatgtggacatatgtttaatatattcagtctcctaaactcaggaagaaattaatatttttttatattgtctgttattagaaatgagcatcattt

SEQ ID NO: 67415 - DNA, 561 bp, Oryza sativa
atagggcgaattcgagctcggtacccatattgtaatgttctttgtggatcatagaggcacacctcttagatgatatcaggttatggttaactatggtgttagaagattatgatattatggtggcctcttttatcgtttacttcactgttattatttttattccccatccacagtgtgtgtgcgtgggcgtgtgtgtgtgtgtgtagctggactgttgatgcctggttatgccttgtgaatgaccctgtcctaacatcctctcattttggcagttgcaacttcttaaattttgctcgaaatcggcactgccttgaatgcaaagcagatggaccaaagaagatagaaacagctaccactgaaatgaaaacgggagactggatctgtccacagtaaccatcgaatgccatatttgttttcttgtactgttcaacattattatatatttgccttgataacttatttatttttgtttcaggtgccacttcatgaactttgcacggaataagatgtgttttaaatgtgaagaatctcgaccaaagagccagctcatccctggagaat

SEQ ID NO: 67416 - DNA, 4461 bp, Oryza sativa
cggccccggccctggccgccgccgccgacgcgaggccgcggatcggcgcgcgccacatcacgcacgcgaccaccgcgccgcgcgccgccgcctccccgccgctgccgctgccggcgtgcgtgcgtgcgtgcgctccgcgtggtggcgcggtccgcggtgaagcgacggtgcgcgaccgcggccaaggcagaatggctatgttgttgggccgttgcgcggctcgttggctgggccgcgtgttgggctctggtgaacgcgtggtgcagttaggccgtgatccgtggactttgactcgagtcgtgtgatctgaagaaaatcgcgggggaatatcctcgcgattcgcgaagattcaagcggagccacgcgttgctgcttggtgagcagcacactcgcgcttggcttcttactccactcgacgactgatggaataagggcgagtactgtaatgccccatatattatctctaatggtatcacctatctattttataaataaggtgtagatcctgtgtcagtaggtattagttattgttgtagtcacaatagtaaaaaacaaaagtgggtagtaagctggaccccacaatcgctcgctacgagagaaatcatttgtttattccttatgactaggtagtaagaataatgcctggtattagttacttaccggaaatgctacttggcgatcgctagcttagagtgaccgggtagcccccccctcctcccttaccttttttggcaccgcattacttttctattttagtaaatatatgcacctaaagtttatacaactcaagtttacacatctaaagtttagagaccaaaagtatataagtcaaaagtttatatatccgattcaaatttgaatttaaattcaaatattttttatatatatagtatttctatacatctaaagtttatacacctaaagtttatatatccgattcaaatttgaatttgaattatatcctatttaaatttgaatttgaattcaaatatcctattcaaatttgaatttgaattcaaatatttttcatatatagtatttctatgcatctaaagtttatacacctaaagtttatatacccgattcaaatttgaatttaaattatatccaattcaaatttgaattcaaatattatatatatatagtatttctatacatctaaagtttatacacctaaagtttatagacccaaagtttataagtaaaaagtttacatacccgattcaagtttgaatttgaattcaaattttttatacataattttttctaacttttgtttttttaaattttttttgtggtgtactgtaataggaaaggaatgggaggaggaaggggagaagggagcgggaggtgggaccgatcgttgggcgatcgcccattaggccccccgttacttaccactcccacaatgtatacaacctggtagtaaggagtattttattccttactacccactttagatgcacattatggatgccctaagagtgtcatattggattgagtaataaggtggagaaaagaagtgaggagagagataatgagccacccctaaaccaagagacaacctccacacaaaattcaagaagggtgtgagagtattagatatattggtatttgtgaactagatgtgatgtatcgtatgggttgtctcttagttcataagtgaatagaatagataaatttataggtgttagtcacatatatcatagcacttgcccttaactagggtatttgccactcttacaagtggttctagatgattttttattggacccatatgttatagacacatggagacccatatgtcatggacaacgagagagaaatcattaattggcacatcttaaagtgacaaataattaaatctcccacgactgattgtcattcaatagcggttttatcgcgggtgcatttttcaagtttttaaacggtaagaaatttaaactatatttctatatattttcaaaaatctatttttaaaattttgaatatccaacttattcgtttgtgttccaggcaggagtactgcatttccgtgccgaccggcgaccggcgaccggactgggcaccgctctgtttgctagtggacggcgccataccgcttgatctagataagctttccaggcgaaacggcagagatggaagataagcaaagttggatagatcgatctgtggaatcgcttctcagctctcacacgtatgcacataagtcaccagctcaccatgggcctatttggctttctaccctactaattaattggtagtcctaaaatctagtcaaattttggcactaccaattttttgatagggcaaagttaactagtctatgtttggtttaataccaatataaaaccaaaatttagtataagagtgaagaagattctagaatgtagccaaattaagcgtgggccctattaattatttggcttcaattcaaactaacatgtttactattaaatttaccaaaattttggtagggtcacgttttatcttcgatataaaacttcacggcgtattgttaagaaagaaaaatcttccagtgatacctgtcggtagtcacgctatatttcaaaaggaaaaaagaaacaaaaacgtgcatcatatcattacatttccagcaaaagaaaaaaaaaaggacaagccaaaaccatgcatgtactgtcggccactatacaaaggagagggaagagaaaaacttggcatcctcttcttcccgcttgcttaagtgcaaccatcgcggttaagtacagtgctcgacaaggcacctatttacgtaggacgttgcacacacgtatgatatcgccgtcttgtaagctttatacaagagagagcgcgcacgcattgaccaactttcaatccccggtcttcttcgcggctaggaagatttttctttcttaacaacacgccgtgaagttctatattatagagcaataagaaaaataatcttctaaacgacgtctttgaaaaggatacgatattgagaatgctgccaccacacgtattagggtgacaggatgtggttttcatctaaaaaaatccattagagggtaggaaagatcactcaacaacgcctcaagagaaaagctgtaggtgcccgtgagcgtcggcgttgctggcccgaagagactaggctttcacctgtaaccctcctaccccttgtgtcgagatcgcttactgtacacagaagccaccatcaactacactccttcgatgcacagacactgcgccagcacctcaccaccagccgaccatcaaatagaagctcgacattcgacgcgttcaaatccatcaagataagtagaagagggagagggtgagagaaaaatagaaccctctccctcgcactagttttcaaacgtggtcattttgtgatgccaaggcaccgcctcaagagaactagcgtcttgatcgggactcaccataggcctgcaacgtccacgtcacggcgctattgtcatagccaccttgactagactgcacgtgtcatcataggccgtctgtctacatcgccgtcacctcgacctattgctccttagcgccactggaactacagccagagcaccgtctgccactctagctcagttgccgttggttgcggcctcccgtcgcccacgcctcaccactctcaacgccgtcaccgcatcggcctcttaccgttgatgggtgtgccaacctctacgcatgtaggaagatcgaccaaatcttctgttaatatagtagtagtgactgatatgtgaatccgaatccatatgttagtatgtactattgtaccaataatactgcagataatccctaccaatttttcagtgttcgagaattgaaaccggaaaggaggacaagcgaccagaggtgatggcgcagagccaacaagtggaagataacctgctgatcgatcgatcaccgggcggtgttaggttgcctcgttgaaaagcttctggaatttgtactgtctagtccatctggcgtgtactttagaccggccttttcccctgtctcgatggttccgtgatactactaataatccaacatgctaatctctatcagtacaaagattaacgcgtcactaaaaaggccagctcattcaagatgagcatcccgttgtcttatcaatcgatcggttcatcctttgccgtgcatatccgtcaggtactagatcttgttctctctttctttcttcttttctttccattattccatacaattaagcagagaaaattgtctcgacattcaaaagcttaaactacccacgaatacggacagcaagtagtagtacattcaagtcccattttttgatcaggtggttgccgaaaagcgaactgaagttggcacaaaagtactactcctatgtacgccactgactcatcgtgactgaggacaagacaaaccgtacgcgcatcatccccaaatcccgagattttcacagcgaaagtcagcacatcaaagaggcacgcagcccacacc

SEQ ID NO: 67417 - DNA, 876 bp, Oryza sativa
tttttccctaaagggggtagttattgcccagagtcgtgggggttaacaaaggccctttgggttttattaatatttgaaaaaatatatattgtgggacccctttgtcattcgaaaaaaaattaggacccccattttcatcctctccagcctctttcgctcatgcctcttttgtcctttgtagccggtctccaaagggccagaagttgaaccaaccggtgctcttttgtccgcaacccaagtattctgcatcgggcctttttgacttgccaatcacgttcttccgcttgactttggatcccaaccaccatgttctacagatccgccatcacgtccacacttcccacagtttccagctcgccacactcgcgtgctttctagatgctgggtagggggctcctcccaacctcgcacacctgtgccgccgccgctgctccagccttgctcctcgcatccgtccaaaggtggaaaaggggagacaaagggagagataatggagagagagggagtaggaagaagggggaggagaaagatgatggcatgtggcccgatagggttaatggactcttctgtcagatatggatcatgtttgaggagacgaagattctaaaagctagctggtttggtaggtagctatagcctctaaaaacatgaaaaaaaatggttcctcagcttgtaattttcagttattttctaaatagattgtatagttatacatcacataaaatatgtacgctttaaattggatcatgctttaaattgtaagtgagtttctagtaatggtaacttctcttacaatttctagctcttaaattggatcatgttttttttaaatattttcagcttctctacataattcaaattgtcaatcatactcta

SEQ ID NO: 67418 - DNA, 629 bp, Oryza sativa
tagctgcctctatcttctttggtccatctgctttgcattcaaggcagtgccgatttcgagcaaaatttaagaagttgcaactgccaaaatgagaggatgttaggacagggtcattcacaaggcataaccaggcatcaacagtccagcacacacacacacacacgcccacgcacacacactgtggatggggaataaaaataataacagtgaagtaaacgataaaagaggccaccataatatcataatcttctaacaccatagttaaccataacctgatatcatctaagaggtgtgcctctatgatccacaaagaacattacaaatattgtaaagtccatagtaatactagaggttccttgtccaaccatttaactcaatacttactttaagcaccgtgcaattttctttgttgaagcaaagacatatttacactataaatgtactccctccatcccaaaatatagaaaccaagtactatgaatttggatagggaggtctagattcgtgtactaggttgggtctaatccagtactagaatgctattttttaagaacgagggagtaccaaagagcgactaccagccgaaacccagattatttggattcactcattgagaactggtacaacca

SEQ ID NO: 67419 - DNA, 599 bp, Oryza sativa
cgactctagaggatccccatgtaaagggataatgagagcgtttgttttgtttttcaattaaactataatccagaattaacaatgccgaaaaaaactagatactgacatatcttgggtgcctggcatttccaaaactgatagcaaatcaaataaccataattaactaaaatttaatgagtcaatgacccagccaaaaaccagatatggttcccaaggcgtttccccaaagggcaaacctttcccccaagggtgaagtttccaaaaaacccctttggggggggggggaaaacttgtgatgttcatttgtagaacttagagctaaaatcacattatttgttgaacacaaaataatggttcaacacaatcaacaactaaaacaaaaccgcgttccgagaggaccaagtgaaatggtgaccgcagagcgagccgaacaccccccccccactaggacaacgatttggacaaaccaattggccatatataggtttggatgcaaccggaccgactaccaaggacaaaaacaaccggcaagcacagaaggggaggactattaggattttaaatgagcaaataccaataaaaagaggttttaacatagg

SEQ ID NO: 67420 - DNA, 8474 bp, Oryza sativa
cgatgtgacggaaaagtgggaagttggtgtgtgtagggaagtttgatgtgatggaaaagttggaagtttgaaaaattattttgaaactaaacatgacgcaaataaattgtagcaaaatccttaatcatccaggatattctttggattctatttaatgtaagttggcataatagttcaacaaatcgattctatcaccatggaaaaaaatgtgtgtttggttcacagggcattcttgcattttatggctttccaattcctacaatctccaaagaggcatcagaaaatcatccatcatcaataccaaagggtgtgctgttcgtgctaaaaacattgccggtcagatttcacatgatatatcaccagtattgagtaaaataatgattctcacaaatctaaacatttatatcaggttaatgcaaagtgcatagtagatggtgatggctttactgcttatgtcgacacactggatcctatagaactgcgtcaggattgcaatgcaagctgtcaatcccgtaactctaagaagcaaaaattgtgggacaaaacagcagctgatctacaaataagtctcgaaaatactggacaaaagtaagtaaactgaactttccttctcttcatgttgcttggaagtcaataatttcttgtgaaacagtacatgttattgatctgggcagaacaaatgcatttgtgtttcagtactatgaaatactcctatggtaaccaatcagcgccagaacaaatgcacatttggctttccatattctgatacatattcagttatgattaagtgggatttaaacttctcagggaaatgaagagagaatatcaaagaaaccaaataaaagtacattagaaatgtgtttatttaactagaaaaaaatacccgtgcgtggcaaaggggaagattattttattcttattattgttatacggtttagctataagataaaattcactgtagtaatttatttggatatatattttttaagaaaaccatgagctgcaattaggattccgacttttatctcaagttagtatttttttaaagagatttcttatacgactcattttgtttttccaaaagcaaatgaacatcaaatccgactcatacacagatctgtatttccaaaagcgagcgaacataaaaactgactcaaacacaaatgaggtaccaaaataccggaaaaacatctttaatttttataatagtagagatttattattttttgaaaaaatacaacagcagaggcttctactgtgatgtatatagaagggcaaagagtttctttaagttttatagaagaacatagtatttcaagaagagactaggaaattatgtagaatatgctaagattgcatatagcttaacattataatattaacttaactaaaaatggtccctacaaagaaaaacataactaaaatgctactacaattgtgaaacaaatactggaacgtaataataaacaacctattctctctctggaaacgtatagaagcagagcaaatttagcactcacaatgatcatgcaaatagagtacatattgaattaattactattttccgtgcaactataaattaaaacttgcaagggttgcaaaccaactcttggtcgtctagtttatttaagtcttattatgctgttgatcttttttagttcacatagaaatttatacataaattcaaatcgctacgtacgagcaggaaaatgttctttgggggccgtgagatcctcgcaagaaaatacgaaataagactgaggtatactctatatgcacaacacaactcaacacagaaattaatcagatatacagtgttaaatttggcattcatattgacaggggcattgatgcaccggagataggcatgcagtatggaaaggagtcgcaggatgcactggtgaaactgatcgctaggaagtgtgtcacgcttcatgtttatgggcaggaccaatttaagcgcttcgtctgtgatatccattgtggtggtgtgttcatccaggtggacacaaagccatacaccattgtgtcattagtcattgattttagtagaacaattttgtttggatggaaacgatggtgaatgtggtgtaatctttaatttcaggagcaaatgctggtgaatggtcatgcctggcacttcaagaactatgacaaacggccacaatttgcaaaggtaagaaactatggagtatatttcagtatattctttaattgcgatattcatatatatattctgttatgtaaatattccgttttgaactttgaaaatgataaatattattagcaacataagactaataaattgttagtcatacttgcagtattgaagtaagggatcatattaccgcacaccgaatcagcacgatttctgattatgtttaacatagtatttctattcaatttatcatatattcctgtataatttttgtgacatcctggcccaattaggatgaggcatgtgttgtccatgtgagctgtgtgcgcatatttactaccacattgctagtttagcacgagtggaaccaacttataaggcatcttccctctaaccatattactctcgagttaaccctttttacacaaagcgatgacaaaagtgtacctggggtggtatgtttaagtgggcccgcccgtcgaatgggctggctaaatcggttctggatggagggttgttacaaatggtatcagagccaaccctcgcggttacgcgtacgggttagtgtacgggcatatggcgcatggttgttacaaatggtatcagagccgaccctcgcggttacgcgtacgggttagtgtgcggacatatggcgcatgtgggctctatatgtgaggcacatggcatggtatatggcgctagcattaacgtacggacgtgccctaagagtaccacattgctagtttagcacgagtggaaccaatttataaggcatctttcctctaaccatatcactcctgggttaacctttagagagggttttttacaattttctattcaaattcaatttatgttgaaatacaacagtttggtgcatcactgcaggttcttttctttccatgttgaatatttggaacataaaagagcgtagttatcttgtacttgataccatgcaagatccagttttaaacagtagttctccatattgaacttatcttttagaaaagaaatttaccatacagttgaaattccaatctcgtttgagaactctatagacatacgggtgtgtgtatttgtgtgcattttctgatgaaactgctttggttacttcttctccctcggattgtgaagtgggaaaaaatggcacgggatgcacgtcaagggctttgggcatatgataaccttgagaagccatgggaatggagaaagaacaagaggaaggcatcgcgacatcacaattcagatgtacgttgatggactctggtcacttggatgatgatcttatctgaaatgacataatttggaattggatctatggttactagacagttagccccagttgagtatgtataaaagtatgatgtactttgtatatagtaagattattaatctcgatctgtattatttataaactaatatttgagtgaagaatgtgtagatgaattatgatatgataccgcttttcaattaaagcggtgaaagggtctagtactttttaactagcttgccttgtttacgcaacatgtagctacataaatactacgggttaattcgttaggattgcagcaaaactcaacaaggccataagattggcacttctaaattagtagtggtttctattttgtagccaaaaaatttgcatgccaaattatttcttttagcccaatgttggaatgcaactctggcagtgaacaaaatgaagcaattgccagttcttgccaaaaaaaaaacttgtggagatggacatccctgcttttttttttgtatggcaagaggtgtccattgccaaaatgcaaccaaatgtcaataaaccaaacaagcccaataagaacaaccaaatggatataggatccaagaaataaccactactatggaaccggtcagctgtaacggccggaactatcatctatatcgcaaaagtgtgtggtcactgattattagtcagtgatgtgaaactctcatctgtgtcagggtagatgtcatcaccgatgatagatctctttatcgggccccaaatcccacccttcaccgatcggttctctaggccgtcacagatatgtcgtcggtgacgggctccacttgcaactcgacaaatgtgttgttgttccctttgttggattcgtttagagcccatcatggatgatcatcggtgactggttccaattgtgacccgacaaaggtgttgccgtcacctttgtcagaatcttttaaaacccgtcacagatgatcattggtgatggatgaggtttttcactcaaaagataaatttattttattggcttatctcacttctagtttgttttttcttttaaattttgtactaccatgtagaaaataaactagcaagcgggtttttatgcgggtagtgagactacccatttgcatcccacccaatcgttctctggaagtctgaaaatgaactccagccaacacatttgttaggaagcatatgagtggagagaagagggataacaacgaatcttgaaaagaaatgagcgaaaacactaacacgaggagtagaagtagccaaaaaaaaagttgttgatttcttttgtacactactacataaaaagggttaggtgtcggttgggaactcgccataggtgttgaatttctcaaatggcacctagcaagtggcacttttgaggttctaggaatgaaaaaagaatgccggctcgaatcgagtagatgcattaggcagctccccttcactccaaccagattacatagaacatttaattcatataatgaacatttaatccaagaacattaagaatataagagcatccaagaacacaagaacggaccgaacactaagaacactaagagtacaaagaacgggccaacatcggggagggcgccacccctgacaccgccaggtggtagagtgccgcagctaggtggggagggccatcgccatcgatgggtggggagaggcacgcgacagagagagaccaagaaagagaggtcaaagaccggggaaagcgaacaagtcctcctcaccttattcgttcgagagaataattacgaacggtcagctcggtttggtttttacaggtgttggtttttaaaaaacaaacacgtataatagattatcgatgttagttttgtaattaacaggtgtttagagagaaaattaaactttgttctctctgtccagggaagaaataaaacatgtgcgagtgtgccgatgtactaagtacacaaataaaatagacaaagaaaaatatattttattataattcttgtggaactacaaaatacaaaatccttagttatttagatattctccacggtcataggcaaggtgtatctgactttaagtgattgtgttctcctgattccaggggtgtcataaaacgcctggttaattactctcacaagttaaactcatgagaagcctccaattaagtcgtgctagtctcatcgtcatcgatcttcgcttcgcattctcctgtatgttggaaatatagtcattaatcggcatattttaatccaaaatgttaaagcaataatcatggcataagcagtgtagggcgatcttaacataaccagtagcatattatgcgcatcatgaatgtcaggaacaggaacatgaacataatagtaacgcatagaggcatcatgaagaacaggaacaagaacatagcgcacatagtatagcgatagcgctaacaatgcgaacaggagcagaagattataccccgagaatggccctccgctggatggtgaggcagaattgcctccgttgttgttgtcgttcacggcacctcctcctggcgcaccagctccggctcctgttggcggcgcaccacctccgccatctcctccagcagcggcggcgactccagacatcgcgatgagcagtcgtgcgggaggcactccccaaaaacctgatcacccgcctacccggtgcagatctcaggcgaaggtgtggtttcggaggcactgctccttccaatctctcgtgcacgcaagagatcagaagcgaggaagcgagagcaactcaggcggagaaggagaaactaacaccgggaaagaagcgatgaaaacggatcgcactcgcggcctccttatctatcaggagaaagaacgtggacgcgctgttgcggagggaatcgtgggaacgtgggttagtggctgcaaaaggatagtgacgtgacgtgacgtgacgcacgccgccagccagccacgccacgcctcgccctcgccctcggcccggcccggcccggcctggcccggcgcgcgcgcgcgcgcgtgtggcaatccgacccccacctcaactggtcaacaaggagtctccaataactccctatttaggttgagatattcctcgcttaaatcctgaggtggtattattatccttaacacttattatgggcctttgagatttaataggataagttgggcatagcccaattattctaacaatccccaccaaatttcaaggctcataagaaatgttctcaatgttgtgcctgtttgatataccagggttttggtggagactattaagttgaacttccacctaggaaatgagctacatcagaccacaactgaacaatggactatgccttgaattgtcagttttgtgtgatcaggtttcactcagaaccttgactggtactgggctgccgttcgcatcccctctgtttggagcatataagtcaaactccaggcctttcatgagtatctagagatcgcccaaacctcatagactgtgactagcagtcgaactcatataggtgtgttccttctaagatgttctgcaggtcaacatctctgcttggaaaagccactcggatcacattaaggcatgagccatcctaccatgcaggaaagaagagaagcacatcatgaaaatgagcccttttcaagggtctcttctctcagtcacacaatagtttgtttcgccatccaaattcacgggatctccgatcacaatgggtatcaagcccatttccctcgatgcactgtctatcacattacgtggtagccccttggtaaactgatctgccagatttctagccgtttggacatagtccaatgctatcactccggagtttttctgttttctgacagacttcagtcttcttttaacatgcctggatgacttcatgttgtccttcgaactgttcactttaataatcactgtttgattatcacagttcatcaggattgctggtactggtttttcaaccaccggcaagtccatcaggaactcacgaagccattcggcctcaactgtcgcagtatctagtgctgtaagttctgcttccattgttgacctcgttaagatggtctgcttgcaagacttccaggaaacagcgccacctccaagtgtgaacacatattcacttgtggcttttatctcatcagcatcagatatccagtttgagtcactatacccttctagtacttttggatacccggtatagtgaattccatagctcatagtgccctttagatagtgcattactctttccagagcctgccaatgatcatctcccggatttgagacaaaccggctcagcttgcttacagcaaatgagatgtcagtcctcgttgcgctagccaagtacatcaatgaaccaatgatttgagagtatctcagttgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatccttcatttcaaaactcttggacagatagtccttgacctcctcaatcacattaaggctggtcccaaagatcaatatgtcatcgacatataagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatacaaggatttcaacagtttacacaccattccctcctgaccttctagtacatacccgtctgggtgatccatatagatctcctcctccagctctccgtttaggaaagctatcttaatgtccatctgatggacgagaagaccatgagaggctgccagagcaagtagtactcgaatcgtggtcaagcgagcaactggtgagtatgtgtcgaagaagtcctcgccttccttttgggtataacccttggcaacaagccttgccttgtacttttcgattgtaccatcaggcct

SEQ ID NO: 67421 - DNA, 6804 bp, Oryza sativa
atacataattctaattataatcttgaaaaatactatgttatttgtgaaaatatttaagctcctattagctcatctctatacgtgacgaagcttttccggctccgacactgattacaactagggttttgtttagtttgtgtgctaatttttttaaagtatacggacacatatttgaagtattaaacgtagactaataacaaagtaaattacagattccgttcgtaaactgcaagttgaatttattaagtctaattaattcgtcattagcaagtgtttattatagcataacattgtcaaatcatgacgtaattaggcttaaaagatttgtctcgtaatttacatgcaaattgtgcagttggtttttttttcatccacatttaatactctatgtatgtgtccaaatatttgatgtgacagaaaagttaaaagtttgacgaaaagattttgaatgtaaacacggcataggacgtgctcgtgtaaactccaacgtgaatttactgggatattgcgtattccgtgtctcccatacccacacaaggagtcaaaacaataaaaaaattgcgtgtcacaatcatatggtagccaaattttgttttttttaataaaaaaaagagaaaatcggaggtgatgaagtgttatatattatctgatgataacacaaaaattacgttacgtgtttgatgacaagaccaagagatctgggggccatattcatccctaacataagttaatgtgcgggttggaagatcagctttgcaagatcatctactcacttagttcccaaatactataagattttgagtggatgggatgcatatcctagtactagaatctagataggcttatctagattgatgcgccacatccactcaaaattccttatattttggaacggggtagtaaatataatgtctcatgcaaaatgaacaaactttgatattttgtgaaaaatgaaaaactttgtagcgttgtattagaaatatgagccttctttacaacatactaaaaaaaaattacccatcaccgcaggaatcaaactgttctttttaatttttgtaaaaatctgcaaaatttctgtgagtttgctacgcttgcagtgatgccatagtgtttttaggaagtgacaataattatgcaagggaaaaaactgtagaattttctatgtttttttacaaaatatttcgatattttcgcttgtacatgcaaattagcaatttatttaagagtaatgtgctaataaatcaacaacatttttgaaaaaaaaaagtgtgtgaatctatctagtttctgttgcctaccgtaaatcattttctgcatgaacctgaggcgtacaaagttggcctagctctgaaaaaaatctactttttttcgcggggaaaaagaattaaaggatgcacttttggaacatgccacgatagatctactttgtttcccaaccactctaaccaaaatgattgtcctttcctttcagttcactcctttacaccaatgtaacatccaatcttaatcttatcaagtgttcagtaaacactaacaccacataaagtcccaaccacttggtttggtaggccttgctaaaatgtctaatcacttttcaattagattaattcctgcatcgtcatgataaagaccagatctcaccagactctgcagccctgtaattagcattagtcattacttttttttcctgaaatcatttacctcaaataatcttccattgttttccttcatggaataattttgtgttcatgtcgttcaactggtgttatcattagcaagcacagtactacacttaatcatcaattaatgaaacattccatgaactgaaaaaggaacaggctgtgatgctggacatattgggttagcattaaacccactcgagtgattagctttgctttctttgcaagctcaattagttggttaatcgcattcattggggtaaccggtaacctctcaaatctttttcagcaacagaaggcacaagaaaacagtgtccctatattctggcgacacaaaatccatgcaaacacaaaattcatgattgattttgtagtggatcaaccttgccaatttttttgtaaattcgatttttcatgatgtgcaagtggttagctttaattgaagtaaatgttgggtttaatatccgttaaaaaactaggaaacgaataacggtgtaattaaccattaggcagaattgcttcgatattatcttcttagttattatatatctgaaaaattaggaatgaaaattccaagccgacacccaacatatctacaagataggacattgcattcgcatcatttaaaacagagcaacatcatctctccagtacttgcacccatcatccaccacatccatctgatataactctcgatatatctctatctccaacaattaatagataccgcaattaacaaaaatcccaatccaataacccccaccaaaaactaattaatctctgacatccataatgtctgcaattaatcaatctgttaatctgttattagtagttactactaacaattatagagtatattaattaatttaagctaaaaaaatggggcccacaaagcagaggaagagaacccatccatccaaccattcataaaatctatctagaattccaacttaacaccaaatctattggtctcttgtcctcatcaccaaaccccatcttcatcgtcgtcatcttcaacccccatccccatatcttcctttgcctctccttcaagcatcatcaccaagtaaaaagagaaaaagaacccataaatttgaagaattttagcttcattcaagaactcgatcgaggagggccaagaaaggtgtgagaccttgatttggtcgccatgtcgagccccatgcatgttcgcaaggcgatccacttcgtctccatgaaggccaagctccagagcttcggcggcctccgcctcctcctcgtcggctgcctcgccgcgctgctgctgctgttcgccgtcaggacgctgtcgttcacgacgtcgtcggcgacggcgacggcggcgagggaggcggcggaggcgggctgcgggaagctcccggcggcggtggcgcaggcgatggtgcactacgcgacggcgaacgtgacgccgcagcagacggcggcggagatcggggtgtcgctgcgggtgctgcagctgcgggcgccgtgcaacttcctggtgttcggcctgggcctcgacagcgccatgtgggcggcgctcaaccacggcggccgcaccgtgttcctcgaggaggacgcgtcctggatcgcctccgtcaaggcgggccacccggggctcgagtcctaccacgtcgcctacgacacccgcgtcaccgacgccgatgagctcatcgccctccgccacgagccggcctgcacgtcccagccggacctcgccgccgccgccgccgcgtcgtgccgcctcgccctccgcgggctcccgccggtgttccacgaggtggagtgggacctcatcatggtggacgcgccgacggggtggacgccggagtcgccggggaggatgggggcgatctacaccgcgggcatggcggcgcgcgccaggacgcccggggcgggcgccaccgaggtgttcgtccacgacgtcgaccgccacgtcgaggacaccttctccaaggcgttcctctgcgacggctacctcgtcgagcaggtggggcgcatccgccgcttcgtcatccccagccaccgcgacaaggacggcacgccgttctgcccttgatgagagatgagcttcgccttcgccttcgccgcgcacatggacaccgtgatgacaccattgccatcgtcgtcttcttcatcttcttcatcttcttcttcacatatgacaccaccattgctgccgtcatcgtcttcttgaattcacatgtcttttgtgatgatcaaggataagtaggatgatgagtgcacctttgggatcatgcaccaatggaggcggtggcgcgatgcgtgtgagccgtcggatcgagaacggacggttcggatcggaccgtggagatattgttattatatatagtttcttttttttttcaaatgcagctttttctttgttgttttttttatggacggtgggtgagatggatatgcaggcgaattataattcttggctatttttcatagattatcgttgtgtttctttttaattcataattgagatatcatcttcagtgggtgactgatgagtggtgccatttgagattcctatctactgaagcaataatgctaagatagaaacttacataatttgttgagaaatgcagttgatttttagatgattaacaattaatgtggcagaagtgagggtgtgaaattaatactctactcactttaaacagaagagtagagtactagtaccattcaactgcactactactacagtactatctttgcacaagctgatgtgtgagaggagggtgtgacctgattttgattgcctattggaatacctggagtacattgccttttgccaaggctgtgacatgcttggcattttgtaggcaggacattgatttcctggcacatggcccaagtatgatgaactagtaccatgaatatgaagtcaccttgggagatgggcatcaacatatgaactgccgaagacttgacaatcgtcctatgctgtgtagcagcacaaccctttcttctgggcaagtgcatggctctgattcaacaagtgtattttctctttttatatatactagcaacatgtccgtacattgcaaccgataaacgactactttggctatgatcgcaagtaaaggatttcaaccttcacttcctagagtttctgaactactaaacagtttttttcttttttttttttgcaaaagttttataagaaagttgttgtagaaaaaactcatattaatctatttttctaaattgtttaactaatactccctccatcctactgtaggtgcagttgctagcttttatgtgtaacgtctgattgtctgtcttatttgaacttttttataattagtatttttattgctattagatgataaaacataaacttatttttttattttttatattttttttaaataagacggatggtcaaatgttggataaaaaacccactactatatgtaaaatgggacggagggagtaatcatgtgttaataagtaatcttgatttccgttcacgaggtccctacctctccttccgatttccgaacacaggcttcgtctcctcattgggaacctcactgtttgtaaggtagggtttataaaatcatacggttatcgtggttaccatgcgtggtaacctttttattttttaaaaccacaaaatgtctcgtggttaccatgccgatcttaccgtggatgtgtggtaactgtgccaaaaacgataagagaaaccatgttgcgaggtcaacacctttttgccgcacgtctttggcaccgtccagttcgtcgtgaacgtaagatagttagctcagagctcatcttgattactactaattaatctcatcagtgtcatcacgttgctttcttgcgtgtgcagaggtgatcacagcaacgacggcgatactgcttggatggcatgaagtggccgaacggtctcgccgagctctacacagagcacaccgggacgtccgccgtcttcgctgccttaccacatcgtcattgatactacctcgtcatttttaataaatgataccattaactttttatcacacatttagccattcgtcttattaaaaaagttatgtaactataatatattttggtgtgagattttttatcactcaagatactttaagcaaaatttatatattacgcatttgcgtaaaattttttaataagataaattgtcaaatatgtgttcaaaagttaacggcattatctctatctctactactttgaaaataagagatgcttccatcattcgtcaaaaaaccggtcaaaaaaaccgggcgaaaaaaccgtaactgtccgataaaaaaggcaaaaaaaaatccgattccgtgaaaaagaagggcgccaaaaaaaccgtcgtaaaaaaccagacgagcgagaaaaaccgtaactgtctgatgcaaaaaaaaaaaattaatccttcgtccgtcaaaacaaaaaaaattagcgaaaaaattaaaaaaaaaagtccgactcctatccgattccctctcagaaacgaaaaaaagtccgactatagatccgattcccccgaaaactaaaaggtgccactccttttgagtccgagataccagccaccactcctcttagatccgaacggaaaaaaaatctgattcctatagaaggcaaaaaaaaagtggtgaaaaatacactagattcgattcctttaaaaacgggaaaaaaaaagtctgattcctataaaggcgaaaaaaactgaaaaaacatcttaaaaaagttcatccgatccctaagaaagtggcgaaaaaaatggttcgtaaaaaataaaaagttggttcatacaaaataaaaaatgtacacgagaaaaaaatggaaacaacgaaacaaagtctgatttctaatcaatagatatctcttctctatctctaatataatctaactatttaaaaagagaaaatacacgagaaaataaaaacgattaaaaaaacgcgtgagaaaaaagtcagaaaaaagcgaaaaaaacacgctaaaaaggttttccatcttccataaaaaaaataaaaaaacacacgagaaaaaatatttccatcgtcggtaatttttttaaaaaaaagacatgcgaggaaaaaaaactggtagaaaaacgctccgtttcttaaaaaatggttttagaaaacggcgcaagaaa

SEQ ID NO: 67422 - DNA, 688 bp, Oryza sativa
tttctgaatggtttgagaaaatcacgcaaaaaaaacaccgtttataaaaaaaaacaagccgctcattaaaatacaaacattgtcattgacatgactattcatgaaaaacgtatattatcattagaattttttcacccgttgcaacgcacgggtatttttgctagactattaaaaaacagagagtgtatattttttaaaaaaatatagttctctgatagaaaaaaatatagttcactgatagaaaagataaacaaacatcaaaacatgcaattaatatggagaagatacacaaacaacaagtaaaaggaaggacacaaacaccgaaacagtactgtcatcaattacgttgtctagcttgccatggagatacgaccgtgtgcggcggctgtggcatccggcagcggtgcgtacgactttgacatgtcattggaggtggccaacaggttacatcgcccgtaccgtgctgataaaaaaggtggtttgcgctgcctcgtccctgtctatcgacgaggtggcgatggtggaggctcaatcgggtgggtgctctttcgtacgctgaggcgcccgtggacggctgggctaccatttatgtcgaggcccatgacccgtcgtaaccggacgaacatacaccatagtgaaatagtgttgaatctctactattataaaaactagctgggtggcccacgca

SEQ ID NO: 67423 - DNA, 991 bp, Oryza sativa
ttgattaatctcgtattggttcttatatggaaacttcttccaatattgcttatttttaatttcgaatttcagctatttttatattgtacttctacatggactctcttttttctttttttctttttctccgattaatgtgggaatttctacccttcacagcgaacgtgttgcctcctttcaaagctgttttaataatataatagattaaagatattttggtataccatccgtgtttgagttagtttttaagatcgtttgcttttggaaatacaaatctgtgtttgaataggattttaatctcgcttgcttttagaaatataaaatgagtcatatgagttttctctttttaaaaaactccgtatgctaatttgaggtgaaagtcggactcctaattgtagctcatgattttcttaaaaaaagtaagcgaattcccatatggcttgtttggtaactcaatggaaggggattggtagtttacacaagggaattgatgatgggattaatatgggaatttgatttttaatcccaatattttgtttggtagaggtgatggaaattgatagggagtttagttggagattaggtcattaataaaaatggatggctgagatttgcttagacaaagtaaaggagaaattccctcccaattacccgcccctactcaggtattgaaaaggagggagtttcttcctcaattccccatccccatcccaccaaaattcccatgtctcccaaccaaacaaaacacttaatagcctcatccctttaaattcccaatcccttctaaaaacttcctccaaccaaacaggccgatagtgaattttacccagctaaaccatataacataataagattaaaatagcattcacctactgcaaacgcacgggtatttttctagtatactaataaattgtttctcccacttttgggggccatgagaagcgaaatatggcaggcattggggaatgggatgaaagttgcaacatagtcg

SEQ ID NO: 67424 - DNA, 11286 bp, Oryza sativa
ggaggagatctatatggatcaaccagacgggtatgtactagaaggtcaggagggaatggtgtgtaaactattgaaatccttgtatgggctcaagcaagcacctaagcaatggcatgagaagtttgacaccacgcttacatctgcaggctttggtgggaaccaagctgacaatgtgtatactatcgctatgggggggagaaagggtgatcttgtgcttatatgtcgatgacatactgatctttgggaccagccttaatctgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgaaatactctcaaatcattggttcattgatgtacttggctagcgcaacgaggcctgacatctcatttgctgtaagcaagctgacccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttaaaaggaacacacctatatgagttcgactgctagtcacagtctatgagatttgggtgatctctagatactcatgaaaggcctggagtatgacttataagctccaacccgagggaatactaatggttgcctagtttcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatgactagttgatgacaattagttgctccattcctcttcctattccatgactcttactcttcatcttccattcctcttataaaatgggaatggatttgatctcccgcgagaaaaagaagacacactttcatccattttaaaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgattattatcttggttatttggaataaaaatatgccgaattatgaccaaatttccaacaaatgctaggcatgagaagtataggattttaggagtaatgatacaacatggatgccctgtaagtgtgaggaagcgggatacatggaccaattattgctagattcaggtggtagggataaagagatataaggtagcgatggaaactttctcgcatgccaagggtcatggggaggttgaagaggaacggctttttccccgtggaacccaccttattttctacaccacccataaatgtggtgtttgcaccactaataccacatgctagggtcctctttccgttaactttcattggagagaagtaaatattctctattgtaaatttgtaataatgtgtgatatcttaaaacacatttatcaaaccgttattggtgcttctacgacgaaagtttaatctaaacatgtgttatgacatccgtgatttgtattttaacatataataaggattaaatgctctgttcctacctggtaggaaccatttgagagtggtaagtagtttcaacccggtcacacgactacaaccgataaaaaagagttaaaactatattattttacatgatggttcctaccaggtttttatagaagaaacatcatttgtgaaccggggattgcaatcggtgattctttaagccgcacccacgttattcctgaccaacacgctaaaacaatatggagcgtgtgatagcttaccactgcttgcaacccaggcttacactaagtagcattgagtagggcatgtactccctccattttatattataagttttttttctagttaaatgtttttaagtttgtagaaaaatatagcaacattttcaatacaaaacaaacatgttatcaaaatatattcaatgttatatttaatgaaactaatttggtattagagatgttgctaaatttttctataaagttagtcaaacgtaaaaaagttttaccgagaaaaaaaatcatatgagacggagggagtgcaacgacaatcaatactatactcttagtcaaactatagggagggagtatagaaggaaaaaagaggatggagaagatacacaaaacaaggtgagccattagcgaatgattaattgagtattaactattttaaatttcaaaaaagaattaatatgatttcttaaaacaacttttctatagatttttttttgcaaaaaaacacatcgtttagtagttcgggaagcgtgtgcacgaagaactagacaaatctcctctctatgttcagctgccgaactcgttaacaagataagtttgctgatatggaagagagagaaacatcgttgttttttttaagaaacatcattgttatgcacaacaacggcttaatatcgactcatagtgtctataaaagaaaaatgatggaaaaagtgaaagaaatataagaaaaaaatttcagtatattaatggttagaatcttttatcattttaagttggtaagagaatagtctcagattggactaaagaggtcctatatcatgctctacttttaacatgccctttggttctaccttgaatcaatcttgggtcatatttaatcgtccataattgggaaacttggcagaacatggtttaataaaataaatgggaaaatttgaaccattccaaaatttgtgatatgccaccctgacccatatatcattgactcatgtgggtcatacatgtcattgagatacgggtggcatatctcaaattttgaaaaattagagtggtatggttccaacgaacccttaataaattcggtaggatgtccaattcggtaaatagaaagaaaaaaaaatctggcacttgagactcttgacgcgcgctaatttgttcggaaaataccacagctttccacagaacgttgaattgaaaggaccgaaatacccttcaattggggaagtttgttctccttcctcggacgctttctcctccaggaggagagggagggacgagcagcggcgagaagagatgcgcggccgatcgagggcaagaagagagagagagagagatgggattagggcatgggctggtatgtatgttgttgtcaagaaattgagtccacattggagtgtagtatggatcttggacaatcccttgatttgtgttcttcagatgaatttgtgctagtttgttttcttggtttggtgattttggttctgaatctggcattctgactctagggagtacaaagaaaaagaatccaaatgcaaccatctccatgtaatcaaatctagtgtgttttgcatcttctgatttgactactcccggcaatgcctaatcccctcctgttctttctgctagatgattgaccatcgacgacctgtgttagacgagtgacgagccagcgttgaatggagaaggggatggcaggctcaagctcaagctcgcggcgccggtggtatccagcaaagtagactatttttttgggtggtattttccgaattttgcatcctgcatcccacatgtgctatgttaaccgatttttccattcttttttatttatgtgatttaatttcgttggtctgttttaggtgctgagacaaggaaggtgttggttgtatatgacattgttggtgatgtgcttaaaaacttgacagtagtattgcttgcttacatgcattctcaaggtatagttgaattttattggttcagaacataggttcacagtttccatcccactagctaagaaaatgataaatctggagagctgtaaaaatgtttgacctccacattgaaaagtagtgggaatctggtcctctaggcaatcaaccttcaagaaatgaagtatacttcatttggtggtgctggtttcaactctcgaccagtttcaaatgccattggttgcaactattgagaatttgattcctctggcagaactaggaaagaagtcatctggccctttatctcccgttcttcctacaactaggctaatcacatcatcgcaaaaaaaaaaaaaactaggctaatcacatcagtacctatctcctctggacctatgagttcatctggtggtgcgacctcttttgctcacagccgggctgttacaaatctgaatgtagaagatggttactcaatcaagggcagcattccgaagtcaattctctggatatatggttgttcttctctttgtgatggtgtttcatagcaggtggattcattcttggcgctgttcataatcctatattgctggtagtttgtggtggtgatactttgtttctgtcgctgcaattgcgatttggaatattaatttactgaggaacaagaggcatgattttgttcatcagtcgctatcctgattctgatcttagaacagcaaaagatggacagtgcatgaaagttactggggtgtgactgtcagaaatattgattttgctccatcgttctgctgagcagttttgatttgtaggtttcacaaaatactttagatggtcatctgtagtaataatattgatattaattagaaacaagaacaaacttctaggcacatggatgctttgatcatataggttagtttcacaagcaggtaactctactaacctgtacttgacactaacatgatttcttctcataatatattttcttttgacagtaatcttgtggttatagaaacttggattgccttttagcaatatgctttatttttcacatcgttaacaactagcatatcttcacaggttgttacttatggaaattttcccgtcgagtcctcatttcaaagggttccaagatgtttgtacattggacttgcctgtatgagtacagcctacaggggatgggtatcaaaagctgctaatgctgagcattgcagattaatttaacttgggactcgggtcaatggaggtgagtttctcttcaactggaaatttgattattatcaagatgatgagatctcacagtgcgctagtgtttaatgccatgaggattttattgaagaatgcaaactgctataattcttcccaacataaaccctgcaatctcacattttccttgctatgattgtggcgacatgctgtcgatttctacatttctgatttccaatctggacggcgagcattggtcagaaaaggatatggggcacgggtaacctctaatgttgatgaatctgttgttactgacataaatccggataacaaggacgtcctgagatcctgaaacggctacgagaaaggaatgttttaagtgatgatcgtataatgttcctaaaaaaagggtactcttatttgttctgaattttggagttatatgaaatcatttcacatgcacatttacatgcagaattgcagatacatcaaggagggcagcagagtttgtattatgggggttgttcaaaggaacgacagtgtgttgatgattgttcatccatctgaacccatctcgactggcacgaagatacatcaaacatgctgagaaagagaatgcctgtcgaaatccctggatttattttgtgggatgttagagttgaaaaggatgtgcaaatgcaggttgtgattatgcattggttgtatagtgttttatgtatttttctctgttttttttctcttctgttgggctttggatacttgtaacatggatggctttagttttaccatggagctgtttggggattctcagtggaatagagttcacaagtttttgttgtgaagaattccagaagtgttataaattgttccagtttcaattttatgtgcatttcattgtaaaatttcattcccatgttatatatatttcatacataatataattccatgatctttgtacgatattaaaccaaaccattgagaaaatcgcatagtttcttttgcattttattgtgagcctaaggtgagtacattggtgatataaaagagcagacatcaggcaactttcattttattctctgtttatgacatcttctttttcttccataaggatcagatatgattgattggacgccatgtggagttagttgccaaccctcttaaagtttgatattcctgtgcgtccgttttgtgatatttttccagttcattcctatgtttggtttgaatgatatttattcctccatttaaatggagtttttgagttatttcctgtaaaactcttgcatttaaactaaagccaaaaagaagagtgaagctgaagtgtcttgtgagcctaagagatgtctcatgtcaatttcagagaagcatcatatggggagacgatggagaaaataattggtagtaataataaacaaagaaattaaggtacaacaaaattgagggaggaagggacatgaatctctgaattctctccctacaacagaccaagaatcactctctgtcacagtgtcactagcctgttgtcagctaatgctgatttccattagtataaaatgtaacaactcctactgggataaggatagctagtagattgttatccaatgagtgggaaaacaaaggaaaggatacaatataaaacatcgttaagtcgttataattgttaccattaacatacctaaaagtagagagggtatgtaacatatgtttaaataatgtttttagttgtgattttgatttcaagtatctccctagtagcttagaaactagggcccatttgatatggatgaaatgcggatgaaagctaatgaatgatatgtttataataaattaaatatgatttattgtaaacctaaccaatagattaggtggtacgttctcagtagtttacagattatagatgatctccgccacacttttcaaactcataaacgttatgttttcgcaaaaaaattcctccaataattttcttaaaattttttaaatcaacttatcaacttctaatatttaatttattcatttgtgccatcgactaattgttaaactcagtttccatctatcattatcctattttgagagggcacattgaacaagtggtctgagcaatattgatttagaaagttaatggacaaatcgtatttttagaaacatgacgtgaataatctgcaaataattcgtagcaattaatctacaaagaacagggctgcactcatagcttaaaaactagtagctttagcgatcgcaccatataaatagcattcaaataacattcgatccatgtatgacactatgtatatttggcgtattttgtgtaagaactaatgctaatatgttatgttattggtgtacggacaaatgcgttggatatatgcattcaaacgcttccgcaaatagctctagctcatatatcatagtcgccatcacctacgactagtataaaaaacgtgtattgagtgagcaatacgaatttgatatttagtgagtgaattgcattcgacatattacacatgagtagggagtggagctatgtgtatgtgagcctagtctatggaagaattgagctaatgcatatttcggaagctggaatacaagtggcaatacggcaaatggcataatgtccgaaattccctttttttaataatacatttaaaaccggtttctacgtccaacacggatgtacacagccaatgtactcactgcgctgcgtagccggtgtgctgccaagggcgttagcccataaataggtggtgaatgctgctgtggtgatcaatggacacaacaaattcatgagacaacaaactttggaagctccaagctgccatgttttcagtcaggaggattcctaagctcacatgtttttcgctgtgagcccaccagcaaccctccctctccctctctctctttctcatgcctttggttggtaccacctaatttggcatcaacttcaacaaactacacacgatcagaaactcacaatcaacattatgctgacaagatacacatgaatgcatccattatccctaaaaacagaaattaatagaaaaaaagaaaccatcaaatgatccccaattaactaacttcagttttggcctcttgtcatttgaggaccatgtatataaactctctaggctagggtcctagctaggtgcctaggtggtgatctgaattcatacatgatgtgcactttggtaagagactgagaggcagctctactaggtagcaagtcttgatcacttactgccttaatggtctttttattttttttgtatctttaagtacacggcacatggtgagttagtggggctcagtacaacacttaatgacgttgttagcgacggtattaagtgcaccacaatgcaagttttgtcctttgttttcttctcctcccttttattttttttttctgaaagtgaggttgtgctgcaagtagggagcagcatgtgccatggatgtacaatacaggctttaacacccaatgactcttgattatggtagatcctggaaagcaatgatgcaatcatgccctttcgtttttctttaaaggaacaactgatcatgttgtttagaatatcttatccgtgtatctgatatgaaatctatagtcaaaaggcaagaaatcaaatctctttttcgcgagggtgactcgtgtttcttgctacattcaacagagaatttggaccggacacacgcaatcagttcagatatgcaaacataccagtatcatgaggccacagggcaggtcagtgataacttttgtttttgacaagaaatggaaacagctccagtcatagactatataattttgatgcaattatgcaatacgaccatgacaactagaccttcaaatggactttagtgcattcttgctccgacttgaagcctgatttatccaacatggtttccacctgctcttggacgaacacttcagatccagcacttaaaacccaacattaatatcaaatcgcacatacataatcaaatagtgagtgccgtaggaagcaaccaaccagttacattcatatgctcacttgacagcagctctctcttatagatgaggcattcccagctataaatttagaatgtaatcaaatttgcttcgcaggccatgtccaccaaatgcacatacagttgaccttttaggtctcaacaagtcaaatatgacattacaacatgcagttttatatggaaacaaattcaagactggagatggaagtagatgtttttatctcagcgctttgcaaacattcttttttttttcttggcacaaagagccatccacagtccttgttggattccagctagtgttccattttctatggctgttgcagaacacaaacacaagcatccagcttctccctccatgttttattaccgtgaaccaaggctatggcacaagggctggtcgatacaataacactacagcttctgagtgaaatatacagattgcaacccaatcatagcagttgcaacagattatcttcatagtgcaaggggtggggtgattaattagcacttgggtccttgccgtcatccatatgtacattggtcatagcagagacgtgtaaccctgaacaaccttttcttgtagaagcctgcagaaaaagaatttcttttagccgaatcatagtttttggagcacatagtaaggacacaagcaaacaaacaggtgaattcccagaggaaacaaggctgtctgcgtgtagcctacatttttacaggctctgcaatcaaaaattgtacaaggcaccagagtttttaaaattttaagacaaatttacccattgacccaagttttaagttcaatgatagattcagataaaatccca

SEQ ID NO: 67425 - DNA, 3636 bp, Oryza sativa
acgttgatcgtgattggattccacgactgcagcctgcagaaacttttctactgcagatgattattactcccttcgtactcgcaaaggaaatcattttggacagcgatacggttttcaaaacacaactttaacttcttatttctataaaaatatttattaaaaagtgatatacttcctccgtccaaaaaaaggcaaaccctgggttttcgtgtccaacgtttgactgtccgtcttatatgaattttttttataattagtattttcattattgttagatgataaaacatgattaatactttatgcgtgacttgtctttttaatttttttcataattttttcaaataagacggacggtcaaacattgaacacggaaacccagggtttatctttttttttggacggagggagtatgtatacttttatgaaagcacttttcaagacaaatctattcatatgatttttatatgatttttacatttttaaactcaatatcttgagagttattcatgatttatattcataaggtttgacttaaacattatcctaaacgacttctcttacaaaaatattgcaatttctatcctaaacaatgaatctggatacaatggatataggttattcattatcctctatgctaggttataacatttcgggatggagatagcatcgtagaaagacgagtcgaatatttctcagtgtgaattttctacgaaaatcatgagaacgatgtttaaaagatgacattaaaattatgcgagattaactattctggccgtgttcatccggttaggatgtagagtctgaatttttagtccatttaaaaaaattaagaaagaattattggcatcgtgataatgataaggtcatgggcaccatctgaatttaaatctcgacatcaatattgcgcgtgagtagatatataggagtacgtgaggctaggatttttattggtctgtctttatttaagtgtgttaatatctgagagatgcatttaaggcgacgatctaagaagtgtttgggctgagctattcaacggtattcaacggtatgtgatacaagataaaccattaacccatgattaattaaatattaactattataaatttaaaatatatatgtatttaacttttaaaagtaatcaatatataaagtttatgcaaaaatacatatatgtagtcatttctataaattttgatatagaaatttgattttggtataggagtaccaaataacagtttggcaagcatacaagtgagaatgtaacacctcaacagcccaaacaaacagcacccttagaccatctccaaccctccatgtcatctagtttccatgatattaaatacattgccacataagtaaaaatcctatgtggcaagggagttaatgaggagagaggaaaaaaaatgaagaaaccatttctcatggaagaaaccatctctacacaagaaccaagaataaaaacaagatgatatgtggataaaaggagagagaagagagataattggataagaatttaatttgaagacaccatctattgaatacatagtttctacacatagtgtctatatgacatggcaagtatgaaaactactttatagtttctgggttgggaatggccttaggtatgtcgtgtacatgtagcgatttgcgcgccttacgtgggatggaaaataaatcctgatgttagactgtcagcaaacatgataatttcggactagctatttatcgacaacttttccctagtcggtacattccattagggactaactatacatattgataaattttctcttaaaattttattagatgtaaatatattacaatcatactatggccatgtttagttcctccaaaaatttttgacgtatacggacacacatttgaaatactaaacgtagactaataaaaaaaaattacagattccgcctgtaaactgcgagacgaatttattaagcctaattaatccgtcattagtaaatgtttactgtatcaccacattgtcaaatcatggcgtaattaggctcaaaagattcgtctcgtaatttacatgcaaactgtgcaattggtttttttcgtccacatttaatgcttgatacatgtgtccaaacatttgatgtgacggaatttttggaagtttgaagggaactaaacacaacctataatacattttaacttgcatgtaaatacaataaaatttatatataacattaatccaaactttcaatctaattatagttgcaaattataaagttactagcaaaatgcccatgcttcgctacgggtaaaggaacggttaaattctatgaagtacatcgttaacatgtatataataatgttccaatataggcaaattgttcattgcgttaatgataatcaagatggataaaaatattcctgtttagctcgcatcgcgaaagaaaaaattaaattaaaacatattaaattctaatttaatgaaatataattttttttgcaatattaattacactctttgaaattatagcaaaagtgctagtgctttgcaacgggaagtgtatagaccagaaaattgaggaaaagttaagaaaaatctacactatgtaattaattaaaatacaaattttctaaaatatttaatattttaagtaggtaggtgtaaaactaaattaattgacaagtaaagtaagtgtgagaaataaaatgacatggttaagtaagtgtgagaaataaaatgatatggttcaatttaattttattaaattcttcatgattagttatgctctttggaattttatttaaattttcagagcttaattgctatttttaataatacaaacatcatttaacaattatttaattggaaaaaagaataaaaatcctcccttttaggtttgggccgaatatggcaaagtttatattacctcccttttgcctatcctatgtatctggactattctttctccgttgaagttcattttacgtcctcatgcaaacacgcggtccattcagcggcccactaatgtggtggcccaataggccgacggcccgatgcgggagcagctggagccgtccgatcgaatgaacggtctagattgatcctaacctaaataaatacccaaaacctaaccctagaatacattcccccctccctcccccccggcaccaccctcccccgcgagcggcggcgtcggcggcggaggcgctgtaggaacgagatgtcgactagagggggggtgaataggcgatttaaaactaaatgacacctaatcaaaactaacctaagttgctaggcttggtgaggatcaattctaactaagcaactaagttatgttttgcaaacctagggtgatagtggctcaattatatctctaggaaagtaaatcactcctatgtcaatgtttagcaatcctagggtgatatgatctcaagtttatctctagaaaagtaaattgcacaaatgtaaatgcgacaatcaaatgagagaaggagacaagagatttttcaccgaggttcggaaactcaccggtttactactccccgttgaggcgagcccaactccaccgctcaaccacgaagccaccgcacgcccccttcgtcaaggggtgggcaaggcgaaagctggcccacggagaggactacccaagcctcgatcaccag

SEQ ID NO: 67426 - DNA, 17491 bp, Oryza sativa
ccctttaacacactagatggatgaacacaaagctcaagtgagtgtgagagaggtgcaaggggtgtatgcaattgaattgggtgccaagagagctcccttgctgctggtgggggagtatttatactcccacccaccaaaactagccgttgggggcgaaatcccccaactttgtgctctgccggtctgatcgaaggtatgtggccggtcagaccgtgctactctgcaacggctagaaaactagccgttgaaatgctgtcagagggccccatcggcctggccggtcagaccggcgtagagtgggcggtcagaccggcctcggctcggtcagaccgccatcggctcggtctgaccgactacggctccgccggctctgtatcggccatcccgcgcagcatcatctcggcctctagggggccggtctgaccgctcatgtgctgccggtcagaccggccctatgcgacggtcagaccgccgtcttgcggccggtcagaccggccatggcacgccggtcagaccgccactatgtggccggtctgatcgtccctggtcaggtcgaacccagtgaatttgcaagtgaatgtgtgtgtgatgaaaaagagaacacaaatgaaaatacaatgacctaatgtggcaattcaatcatctctatgctaggtcattacccctcttaatagtacggcgaaactagaaaataaactagcaattttgatcgccctacacctcgatcaattctaaactaaagcactagttttaccgtcttctttctctttgctttgcgtcgtcaattttaatccatcgataatcatcgatgcgcacatatgacgtggacctaacttaaaatgtatagctcaaagacaacggttagtccataattagcgcttgtcattaattaccaaaattaacaccgggggcctagatgcttcaatctccccctttttggtaattgatgacaaacaccacaaatatatataatcaaacatagagcacatggacatatattgcattgacaagcaaaagctccccctaaacatatggataacaaacacaaatatcaaatatggagccaatgcacatttcaatttcacatttcaacatagcacaacacatatgcaaattataatgtgaacttcacatatgaatcaaccgaatgcataagatggtcacaagtatatcaatgtcacaccaaccatccatcatagcacaagttcacatcaagaccacataaagggctcacaaataaatgtaggctattacaagaccacgaagggtccaaatgacatagagagtttaacaaaacaacaaataacacacaagatagagtaatagcccatactcatacaaaatatagcccaatcctccttaacctattaaatatgaggtgactaacctcactactactagtcccaacccaacaaaacataaaacacacttttctcccccttttggcatcaagcaccaaaaaggtcttcactcgtggggaggagaaggaggacgcgccgaagtggaaggatgagaagcatcacgacgacgatgatacacaaatgcttgggagctctccaacatttggactcgagaatccaatgtacccactcgagtgtgcaatctccccacagaagcattcaagtctccaacgtccgtgcgcaagccacgaacatcctcatgcaaagtttcatgcccggtagacaagcgttgaatgctttcacttagggtattaatagccccaagtaccgggttgaagtattcgttggattgcattccaaaataggcatactgcggatgaaagaagacatttggatcatacccatgaggaggaggaggtgctgaacttgagctagctccaggatgagaggagggcgccgtcctaggagcacggggagctccaggctgaaggcggggcttgtactgcttgtgcttcttcaaatttggcccagcagccccaagcttgtcttgaatcaatctcatgatgtaaggggcataatagataccctgagtgaaggtccccttagagatggcaatctcttgcatcatgagagtcacagtgtcgaactgacggccctgaatgatggcatcgataacgtgccaagccacccccctaatgtcattattgttacccaggcgagggaggatggtagctctcacaatcctgttaaccacactcgggatggttctcaagccggcaaccttcccatgtgtgtaccgcgctccatcttcataaaactgagagaggtagtccatggagagcggattatgggtgtgctcctcatgcaagtcatctccaaagtccaagcgaacattgaggagccgccggaattgcctcctagagatagaacactggagggtgtcggacatccacttcatctcacaatagtccccggccacccacactgtagcataaaactgccggatcaaatcttcattataatcttgcttaagagtcacaatccggtcaatgccaacagtcctgaagagatcctgcaagccttcaaactctggagtctcattaatgtctctccaagagatccacttatgttctgcaaaagctttccctgcatagacttgctcatacacacttttctggaaagcggtgtgaaaacggggattcggggtgtcccgaggcctcaaaaactgatgatggtgcctcaagatggtatactgtgatggattccgcatgttcacaacacactggatggagggatcaatgttcatctcatcacttccttcatcctcatcctctccacttccactgtcatcatctccactttcatcctcgctagccccctcaacattggcctcaacctcttcatcactttgagcgtaatcctctccgctcgattcctcaggctcactcacgggatccggagtgggcgcacgacgaccatgacgagtgcggggaggcatcactgaaaaaacaggagcaaaggatatataagcaataattttagaaaccacatagtgaagtgggaggaaggggagtgctgcctgtcaggggcggtcagaccgagagccacggccagtcagaccgcatgcccaaagtcggttagaccgacgtctcaaggccggtcagatcgccagcactaggccggtcagaccgcctctgacagtagtacaaccgaatccttccacaatccactcaaatgattctaaaaattgctaggacagtgttgcacaagattggaacatgaacatcaaggtgtaggactatttcatcaagattgaagcaatgggggaaactatccttaaccctagagattgaaatagaccgatttgagagcaatgcacaagagggagagagatttaccggttgaaggagttgaatcacaccaagaaactaccctctattggtgcaaatcgaagaacacctcttccttcacctagggttccatgccatggatcacaaactcaataaaaactcaaatcaatccatagaatagagagaggaagaggaggaaattcacttacggtataaccggagtgattttgacgattgaaccggatggagttggtggagggaggtggatagggtttgggagaggagagaggagaagaaatttcgagttggagaagtgaagagatgagatgggatgaagaggggtcgggtagaaggaggaggaggaagaaaggacaaagtcctgggcccaccatcccaggccggtcagaccggctatatgcggccggtcagaccgccggggtgctgccggtcagaccgggcccaagaagccggtcagaccgcgcatatagcgccggtcagaccgcctggcccccagccgactgtgcacagcccttgcacagttcggctacccccacacaataaaattcaacaaaaaaaatttgattttttggagcaattttgaaatgtgtgagttgaaatattgccaaccattcataatatttgaaatttatgaagatttgcaacaaaactcacttgagtgctaggaggtgaccttttatggtctataggggttttttttgggcgaatttgattttcaaacaacttttgaaatatttggtttttgaatatgatttgaataccaaaaacatttcaaatcctcctctctaccaattttattttgaaacttttctcaaattccttctcaaactcattttggggtttaatctcattttggccaaaaacaagaatatagtttcttcaaaagagagccaaaatgacattttcattcaaaaattatttttcttgcaatatgaggcttggaaaacatataaggacccttttgaaacattttccaagagatagttttccaattacattgattttgcaaaagttttgacttatgttgacttgggcattttgaaaatactactaacatcactagttgatttgctcacatataaaaggaagtagaacacatgcaagagtgcaaaactcccccttaatgtgacatgctccattttcgcaatgaagaatcaaatggcaataaatccaaagcataagagcaaataggagcaaatatacaatatgcaaaagaagcaactatggtgcaccatctcaagccacattagagaagtctatgacatttaactcattcctcaacttgcaaaagcgggtttcatcaagaggcttggtaaagatgtcggctagttgatcctcggttcttatgtggctaatgactatgtcacacttggcaacatggtctcttaggaagtgatggcgtatgtcaatatgcttggttctagaatgttggactgggttatttgctatctttatggcactatcattgtcacataggagtggggttttggtgaaggatatgccataatccaacaaggtttgtttcatccaaagcaattgggcacaacaattacctgccgaaacatattccgcctcggcggtagagagggctacggagttttgtttcttggatgaccatgacacaagggatctaccaagcatttggcaactaccggatgtgctatttctatccactttgcaaccggcataatccgaattggaatagccaacaaacttaatttttgcaccttttgggtaccacaagccaatagtagaggaatgctttaaatatcttagaatacttttcacggccactaagtgacactccttaggagcggcttgaaaccgtgcacacatgcaaacactaaacatgatatccggcctagatgcggtaagataaagcaagctaccaatcatagaacgataaagctttaaatctaccggtttacctccctcatcaaggtcgagatgcccgttggttgccataggtgtcttgatgggcttcgcatcctccaagccaaatctcttgagtagatccttgatatacttggtttggctcacgaacgtcccatccttgagttgcttgatttgaagtgcaaggaagaagctcaactctccaatcatggacatctcaaattccctagacatcatatcaccaaattccttgcaaaatacctcactagtagaaccgaatatgatgtcatcaacataaatttgacacacaaagaaatcatcaccaatgatttttgtgaaaagagtggtgtcaacttttccaattttgaaatcctttgaaaataaaaaatctctcaatctttcatactgacggagctcgtggctcctcaccgggagaccgcgcaggcccccctttgccggttcggccgggggcttagggtgagatctcaagctctctctctctctctgtatatggaaagatcacccgcccgcaagacacacgagacacggcgatgtatacaggttcgggccgccgcgaagcgtaataccctactcctgtgtttttgtggatttgtgtatggacaagttacaaaggattaactccctttcccctcagccttccaaaagggaaaaaatcctcctctaaatgggcaaggtcctccttttatatcttaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtacatcagaccgccagtcgccacctaacccgtgatctgaccggtctgtgactggtcacagaccggataaaggaacgcgctgtactgcgctgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgacccccccctcgggggaaatcaggaggagggcggacacctcaccctcgggcccgacgtccccgaaggtgccaggccacgtcggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtagcgccgcttcggtcggcgagcgtaattaacgtgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttcttaatcatctcttcctccaccgccatggcacggggctctgctctgctcgacggcagtgtactaccgccttcccgcatcgtgagcgagaggcacgccggactgccgcgccgcttcatgccggagtccgccaccggtcgggagatagtgatgctgggcgaggggcgcccggcaccagactacccgaggcggtccatcttcttcctccccttcgcaatggctgggctggtcccgccattttcttctttcttcatggatgtcctggagtcctacgatctccagatggcgcacctcacccctaatgcggtgatgacattggccatcttcgcgcacctgtgcgagatgttcattggggtgcgcccctctcttcagctgttccggtggttcttcaccgtgcagtcggtgtcaccgccgtcggcggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagttttttcttactcattttgttcgtcttctggttttttcttctgcttcagcgatgtcccgtcgcattcctcccgccaccccaagtccggccagtccgaggccgaagatcctgcggccgcggaggagcggaggcgagaatctgaccggcgtgaagccgtagaccgccttcgggaagctgaagaggccgcccgggaggccgcccggattcgccaagcggaggaagctgctcgggaggaggccgcccgggctgaggaagccgctaaggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctggatgggtttagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgcggcgcaagacgccctccgccttcaaaacgccagccgggaggcggagctgaaagaaaagctcgacgccgcccagggagtccttgactccgccgctgcccgagagcggcgggtaacagagactgaggcggcgtcccggcggcgcgaggagtcccttgaggcccgtgctatggcgctggaagaacacgccggcgccgtggagaaaggcttgacgggccgcgaggccgccgctactctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaggaggagcaggcgcgccgcaatcttgaatgcgtccgcgccgagagagccgcattggagcagcgggctgctgacctcgaggcgcgggaaaaggagctggacgcgagggcgcatatcggtggggcggccgcgggcgaaagcgacttagccgcccgcctcgcagctgccgaacacaccgtcgccgatatgcagcgagcgctggactcctccaccggggaggccgaggcccttcgcttggcgggcgagattgggctcgacatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatagcgctggaggagttcccccccccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggatgacggtggcgacgaggccggcgacccgggcacattggaatgagcccccaggcccccgccaatctccaattttttctttttctttcttctttttgtatagatcaacttaatctgcaatcaaaaatgatgaaaaatttcttatgttaactttattttgctatgcatatgagttgaggatgatttgtgccgtggtccttttgcatcttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggtaaggttgagcacgagtgaccttatttcaagttaagattcttcagaaggaaaaacggcacagacacaacctttaggaaactgaaactgcttttattgaaatgctgaaataagaaaagtaaggctgtgcatgtgtggtagcccccggctaaccctgcacacccgaggggggtgcggggttagcccgagcccaaaacctgacacccgacccccctcctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgtggctcggagggccgcgcgccgccttcgctcttccaagtagtcgaggtcatctctacgaagctgatcttgatcagcctcgcagtacatggtggtccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataattcggttaggcactccaaaacgggccgtgatgcccttaatgaatttaagagcagagtgcttatcgatcttgacaaccggataagcctcgggccacttagtgaacttgtcgatcgcaacatacagatactcaaacccgctcggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggctcatccgtctcccctaaggggtcgggtcgcgccgacggctgggtaagcctttcttcaaaggcgcccggtggggtctgggctcgcgaggacgcgagccgcgagagttcgtcggctatcatgttatcccgtctgggcacatgccgaagctctatcccgtcaaaatgacgctccatacgctgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccaggtatctgaggacgtctccgtttggagaggtcaacgtgacccccgcaccagcgccctggagagacagagaaccgtcgaactgcatcacccagtaggtggtgcgaggcagctgagaggggtccgtgctggcctcgggtattgagacggtctctggagccggggtccactctgccacaaaatcggcgagggcctggctcttgatagcgtggcgtggttcaaaatgcagatcgaacccagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcgttcttcgtccaagtggcctctcggggcgcactcgttttctgtgccgatgacctcggggtcggaggatgacaggagcggccttcccacagtggcctcggggccgtcctgggggtcgggggctcctggcatcgtcggacaagcgggcaaaggtcctactccggtcgtcaggggcctcaggcctccgttcggctcgggggcctcttctccctgctctttcccgggtcgagtcagcacagggttagccttggggtcaaagggcgttaagtgcggccttcccgcagtggccttggggccctcatgagagtcgggggcacctagcaccgtctgacaagcgggcagagggccgactccggtcgtcaggggccgtaggccaccgtccgactcggaggcctctccaccccgctcgctcccgggccaagttagcacagaatgggggtgcacgaaatgaggattattttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattacacatccctaagtttgctgggggggcgcatccgctcaatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatatataacaataggttcctacgggggtaatgaacgcagttttttcctcatcctccctagccatgcgaatttgatggtaaccagagtatgcatctagaaaacacaaaaggtcgcaccccgcagtggagtcgacgatctgatctatgcgaggcaaggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccatctcctcgcggatgaaggcttgacgctccggggcctgccgccgcactttctgccggaccggccttgcgcccggccgcacggcgagacggtgctcaatcacctccctggggaccccgggcatgtccgctggtctccatgcgaagacgtcagcgtttgcccgcagaaaggaaacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggcgccaagcctctcgtcaccaccctcgggcttggtcgcagcagcgaggtggtccgcgcgctgctccatgcaggcgagcgcgactttaaggtcgccacggacagagatggggccactggggcccggcatcttcatctggaggtaggcgtagtggaccgccgccataaacttcaccaacgcgggcctccctaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccaatgatcggttgagacagctggagcaccatccccggggccttgatagcatcaaaggccgcgggggaaaggatgttgagagccgctcctccatctatgaggacacgccccaacttcacattgcagatggtgggggaaactaccatcgcaacctgccctccccgggcaatgcacggtgggtggtcggtctggtcgaaggtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaaaagcgggggccttctgtctggcctcacttcgccgtttaccggagggaactgccgcagacttgccctcacggcgttcctgcctcctgtcctcctcccacttcctcgttcgctcagccaagtttttgactgcgcgacagtccgcgagatcgtagagggaggtgttgtggacagagcaccacttgctggctgggcgctcccggatgggagtaccagcctctttctttttgtcgctcgcaggcctcccctttcgggtggcccgcggagcgccctcgacggcgaggacgtgaccctcgtcgccggaatgggctgaccttttcttcctcctcctgtcacgccgccctgtctgagcggcggatccgggagcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagcgactcatcatcgcctcgctgtactgcatgcaagtccgcttcttcgcctgggcgcggatatgtgccttgaaagttcatggtgaactgttggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggtgccgacgagggagtggtagccgaatggcgtgcagcagccgccgctcgccgcgccctccgtcttgacgacgcggaaccggtagtggcggcgccggaggtcctggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcctccccccgcttgggactttggcgtggaggaggtgggggagtgcgagctcgacggcgtgggtttggctccccgtcgtcgccgctcacactcggagagagatcgtgtgcctttgcttgctcggccattaggctgaacaagaaaaacttggcgcacacggaagagtctgagagctcagaaaacacacactgagccccctacctggcgcgccagatgacggagctcgtggctcctcaccgggagaccgcgcaggcccccctttgccggttcagccgggggcttagggtgagatctcaagctctctctctctctctgtatatggaaagatcacccgcccgcaagacacacgagacacggcgatgtatacaggttc

SEQ ID NO: 67427 - DNA, 755 bp, Oryza sativa
gggctggaggtggggtgtgggcctttgcttttttcctctttagatcaatctgattgtatattagtgaaaatcaactattagatgttttgcttttttctctaatttgctagagtaacacgtggtaagttaagagcgtttctagaatgccacatggcggcttgagagctgctggccttgggccaacaaatcccacatgacaatgcaacaaatcgccccacgcgcggcgggggagctttttttcgcgtacggataggatgaaagacaccccgatcgaacgatgaggagaaaaacggctgaaaatgcaaaaaaaattcagctgttttccacgtagatgatcccttaatattatggatctaccgatttaaatggacattaatgattaactttttttctaaatttaaattattagctagaaaaaataggaagatgcacggagtaagtgtacgtacgtgcctttgtgcgtgcatgggtgttaggagggattagtcagcgtacgtttgttgtgcacggggtgttcggagggattataatcccagacttgcgaagtaatttgatgaaagaattgatgtgttgtatgtgttgctagatcatatatacattggtaaaaatacaagttcagttgcataatgtggtgataaaagtaatgtttagcaatccatttgacatgtggattgtattatagttttatattttttttgtcttcaaagataattattctgacggtaccaacgtggtttttctgacggttgcccgcc

SEQ ID NO: 67428 - DNA, 677 bp, Oryza sativa
taggttttgtcattagtctacgtttaatacttctaatgaatagcaaacattctatgtgatttagtccctggattcaaacaggacataagtccaggcatgcttctctcaggtagcaaccaaattaaacatgctcggagtaatactactactagcaaggatccatcagaaggaagcaagaaagagagattaacttacttcttagcaatggaaccagaaggaggttggaactgaaactgcttttgctccttgcgatgaatagagagcgctaattgttgacgagagaaatagagaggagctgaagatcgaaagagcgtgagtagggaaatgtttttattcgccaaggacaacatatgagggttgatgcaggcaggggttaggtaggagatgaagacaggacagaagaaaagaggcgtggcacatctcagactttcagatacacctaccactccgaaagttccaagctccccacgaacttaaggaaaaaaaaacaagaagagcagctaaattgctaatagaaggggtaggtaccatgttctagatcgtggccaaaacatatacaggttcacaccgaacgatgcatttagcttcagatgtttagctggatgtcattttaaatcatatctttttttaagttgttaaatatgtacattaatttagttttttttatcaaactttag

SEQ ID NO: 67429 - DNA, 1737 bp, Oryza sativa
ttttatagcaaataagtttacttgggctctttttatttttaagatacaccactgatagatgtagtagtataattataaatgcacaaattaatgtgcttcttctttatgttgattaatatcactcaccaccccaacagtaacctccaactccaaataacagatatccctttctttcttagatcagaaaagattgctttagcatcttcagctgcttttacctgcaggatcaattcatatatactggtcaaaatcaacttattgagttcttgataattagcatctagctagtataggttaagtactttggatatagttttgcttaatttgcggcttaatttgtgcatcctgataggtgcaggagctgagaattttcatctgaacgatcacgattactaggtaattaatgttctatggaatataaaatcaaattgcataagacggtgaaacgaattaccggagaatgtttgctgaaccattccgtaaggttcaggtctaatgtgtaaggatctccgtggaagaaatcaggtacagcgacataatatcctgcttgaccaactttgtcagctattttcctgtaattttcagcatcattatcacacatatgcttttaaggtgtttccggatctactactggatcataattcacgatatattcagtggaattcaatgcaacaaaacagcacaattataccgtcctatgggtattagtcgaacaaaacacatcgctgataagggttttcccaccatataccagcccgcgccctccacacagcaagaagcggcactgataaagatatggcctcaaaacagttcaccaaacccccttataattatggacaagcttgagtagaagtgtagagcatgcagggaaccctgttgctcaacgggttgagattttgcagtttttttttaagaagaaatgggaattttcaaagctcttcttcgctctatatttattttgtatgtctcgcacacaattaattattcacatagagctttattatgtgaaaagtattgcattttttgtcctctctctgcaagatagataaaattacgatgttttgcacataatttctccttcaggaacaagtacttatatctcatgggttgaagaggtatatatctccttgcgacgcatatatattacaaatggattgatcagagctattctctaaaatatcaaacttgagatgacttgcttgaaggaaatgcttatagtgaaatatattagtttgattttttttgacatgctaaatggttcgaacaaaaaaaaattgggcacgcgtaaattaatactaaatcatacaatagtctggaacttcaagacaactttgccggcttcgtcattagggacatttctaaaaagacatgttcattgatcgagggatcgcctcgtactatactctctccttctataaatctgagacatatttcattctttggtttctctaaaaatctaagtcctatttatagtcactatgtgttaaattaaattgttgatcggaaaccaagaaaccattgtagaacttattggttgcatgttcattggttttgtcacatagtgagtgagttaattgcttcttattttttatcaaaagaaatagtctcatattcttggaaggagggagtacaaagtaaacagaaagggctaaacagaagagcaatcatttctacaagacatagagatttgtcaagttgttcaacaaaaaatagctgttggtttcttgtaacgacaaa

SEQ ID NO: 67430 - DNA, 690 bp, Oryza sativa
tcaggtaataaccctacatcctgttggccggagccggagttgctttttattcaccataatcacaccagtacaatatgtggggtagtctatctaattgttgtcgacatggcggtctgaaggtctgactcgtagtcgacaacagggtagccttcctcctcaaatccgtgtccggcgagatcagagatagcgctttcgtatctcctgacggtatccggagacaccgtaggggaatagccatgcctatccctgaagtcgatatccggcagcgtgtcttggcgtatgtaggcttgtgtgttgtggcttctggtggacgtgtgttgattgtcatgggtgtcttccatggtctcctcaccctctcctcctaggggggcttgtatttatacccataggtatccccttgtccaagtagaactaaggaaaccaatatggatacaatccgagtagtccttgtcgtttccatgtataactctggttgtctttccttatccggaactccctcgaggtcagtttccgtataagacatggtatgtggtggatcctgccgaaatttagtcaactactattaggtatgtgttatccataaccctgacaattttaaagagttagttttttttttcatatttagtggtggtcctatttttaagggtctgtttagatcctccaaaatggcaaaagctatgccgttttgga

SEQ ID NO: 67431 - DNA, 2413 bp, Oryza sativa
ggaggctgaggtggccacgctgacatgtggggctcacgtgggtcccacgctaagtcagctatcatgtcggttaaaaccggagtcaaaaccaccgagggatctagtttgcactggttttgtaagttaggggatgcgttgtatccggttttgtgattaggggacgattttgtaactcgatgacaagttgagggaccttcggtgtactttttcctttggaaaaaggatttctttggtttattgcccgtacaggtctatacagattttgacgaattttggtaaaatactatattcaacgaaattggtacaatatgttgttcccaaaaattttggtaaaatactatattcaacgaaatagctgattggaagtagtttcctttcctgtttctttgtttttgcaccacaaaaatgtaatagagtagcgcatgctttagcagctttgggttgtaaatgtcctcggaataccgttgaaccatgggacagtatgcctccgggcatggaggacttggtggccagcgattttgctgagtccttaagttaagaaaggttcttttcctctccaaaaaaattgagacgtgcggagttcaaaagaaatagaaatgtttgcgttttaattagtggggtttgtattgacgggttatactcgcctactgtatttatagtatggctgtcgttgtaaccaaggtatatgcgagattacggtaaaaagagataggagacagaattttatataggttcgggccccttaactgacaggtaatagcctcggtatcacatgagtacagtatttaggatgacctaatctagtctaccttcagtatcacatgagtataatatttgggatcacctaatctagttttttttgtcggtttgacatcatgtagctctcacacgtagtcgacagctagtgtagtattcgtctttgaatatgaactcatcgagattgcaggtagctctaatccctcatgtcagccttcatagctcttatctgtattggcttgtattttgttggtatgttccctctccttctagggtcttgtattatatcgaacatcatcttcctctccaagaagaattcggagagatagaatatgatacggactaaggaggcattatcttcccgactataactctaacgcctcctattttaggaagataatttccttctctattcatcgtattttcttaataaaaggatacattcacgtatactattggctatatggtatttccatataccgaaaggcacaaactcatgtataggaggtatgcttagactcaaattgacagtttgttagccaattttttggcaataaattcttttgagtaaattttatagattcacatgtatgtattatattattatggcttgagttgtaaaagaaccttgttagtttggacatgtcacatatataactgcagttattatggtcttaaggtttcaaaaaaccgcaccattaactagttttactcgatattgtagcataagaaaaaatattttacttacatggctatactccaatattttggcgatggattgaacgaactcaaattttgaatataagtatagaattcaaatgtacaataggttaagaaaatgtttgacaaactatataaccataatactaatatatgtggttatacactgctacagaaatgtttttttggacgagaccctctttagatggcagacggaccataactagtcgcatctacaaaaatcgtcctctattttggtatacggcttcttaagaggaccttgcggaaaaatcaattttcgcaagcgggtctcttaagggtccgcacgcaaaaataagcttatttttgcaggcggacctcttaatgggccacacacgaaaatatattttcgcagacggacctcttaagtaatcacctaaagtccgagttacctcctcatttccctcttaacatttcaaaatttttcattcttatccattcatctctcttacctcctttccactaaactctctcgcctctttttcttctctccactcctctgtcgcgagcggcgctcctctctcactcttctctcacggccggcggtgggcggcgcggccgacgatggatggcggcaggcggtgggcgcggccggcggtgacgggcggatccgcctccaccgggcccatgacgaccagatccgcgggcggcggcgggaggatctgacggtggagctagtttttttattattatttggatttttatttttgcgtgcggacgacataaagcacccacatgaaaaaagagcgatttttgcatatcctttcggatagacaggctagagttccacatgcaaaaaccatttttggtacgtctggaaaaaaatgttttttattaatgatacgcaatattccaaacatttagttttgtactacttgaaacaaatatactaggtttt

SEQ ID NO: 67432 - DNA, 11248 bp, Oryza sativa
ccctttgaaaataattaattagtcaggtgacaaattaagctaaatctcaaataaaaatggccaagaataataatcttcaacaaggttttgaaatgcatgcacatggaacaacagggaaaaaacataacaaattattggggagaaagatatgtcaactctatatactatttgttcagtgaaactgatatgttgtgttgatcagtgttggcacacagggtcaggaatatataatagaataatgccttgagaaaaaaaatcaacaagataaatattcatgcctagaatatataatagaaggtgatgtacttctgaagaatctatatagaccaaatggtatagacactggaagggaagaatgtaatatagaccacatggcatagacactgcaagggtacaatgtaaactctacagccattactaacacaatttaccaattcatgttttgtacggaatacacaagtaatgtcctgaagtaaacaaatcaactacaatggtttaatgtttgcctatgaactactgcacgtctgcaccttactataagttcaattcttagtttttaaatcaccatatagatttttgtgctatattttctagatgatggaactacaaagacctaaaagtgcaaaacagagtaattaacaaaagaggaacattgtttgccaacactgtttcaagacatgccatcacaattcatctttcatgtgcaagcgaataaagatctatagtgtatcatttgcacaagtgctatatggatatcaaatttagcttcatatttcccccctgccacacaatatttgcatgatatatccctagattacctagtaatttagggcgcacatgcaaatgagttggtgataaaataagagagatctccaaaagagaattacaaatatccatgtctagggtatttaattgtgatttaaagggtgattttaataagtgcaagccatcaaacctagaataacatatcaaagagtccatacaaatagtataatatggtgtcgtgagtcacaagagagtaactgcacatgcaagtacaaaagcaccgaggtaggcaatggataaatcgaacagaacaggcaccatggcacatgatgaagaatgtgccagtgttgaatgcccttactcttttgtattgtagagactcaaaacaacagacaggtaacaaacctaacagaaattaaaaattgcttctaaaaattattgtagcaagatattactacctccgtccagaaaagtaccgaggtaggcaatggataaattggacaaatagaacaggcatgatggcacatgactaaagaatgtgccaatgctgaatgcccttactcttttgtattgtagaaactcgaaacaacatacaggtaacaaacctaacagaattttaaaactgcttctaaaaattcttgtagcaagatatcgttctacccgtcccagaaatgtagctgtttctaggtatgcacctggacacaggttgtagttactagagcatagttatctgaattgtatagattggcatactacaacattgcaatttggtctaagaattcagctcaatagttgtagctaaataatgtaatccagttcaataggtggtagcttaaaaaatgatggtccacaatgaataccaaacacagaaaccgatgtggtgcgctaataatgttcttgaatcaaatccacaaaacaaaaatcaattaattctgcataacccgagctgggaatccaagatctcggccagccgaggccagcggctcaccttcgacgaagtaggaggccgacggccagccccgcgcggtgaaaaaggagagcgcctcctcctccgtcatgggcgcgtacacctccggctcgtacgcgagccctccggccaccacctccgcgtcggccccggacgccgccgccgcgatccggccgacgaggtccgcgaccccgtggggccgccgcatggggggaacccagaacgagcccccggggacgaaggggagccagtcgggcgccgcgcggcgcaccatgacgccgtggatcgcctcctccaggcgcctgaccccgaccacctccaccgacgcgggggaggaggcggggcccgaggtggaggcggaggagtcgtcgtcctcggcgaggtcgatctcgatgacctcgaccttggtggcgaggccgcggagagggaagaaggggcgccgccgccgccgcagccgggcgggctagggttagggttagggtttgcgcgaggaggcgagccatcgaggaggaggggggaatggagggatgcggagattgggacgaacgacgacgacgacgacgacgaagggcgaaggggatagggacgggggaggagagatgtcagatgccgcggagacgagaggagaatgggttagctcacgtgcgaggtgcgtgcgtatgtgggcccctggtgtcggtgtggcaggagcgtcggcacgttactgttggccaaaaggcctacggcccgacggcccggcccacggcatggagatttggcctggtccaggcacggcatggcccgattgttgttgggcctctgccggcccggcctgaccaatgggctgtgtctgggccttttcctcagcacgacgggcacgacaaccagggaagcaaaatagacttattccaaggcacggtccaaagaaatgaaggatgtaaaatgggcttattttaagccatataagtcacgctctaaagagatgagggaggtaaaatagatttattctaagacgagcgcgatgaattggtcgtgctttcaggccggatggcacggcccgcatcttatgacgaagagtatgacgggccgtgtcgtgcctaggctacaagcacaatatgtgggttggcttggcacgacacgacatgaagagtatgacgggttgtgtcggcctgacattttgccttgggttgtgctctagtcgtgtccgggcgaggccgtgttagatgacccatttgaccatctatatcaccggtggaggcggagtgtcggcagcgtcgtcctcggcgaggtcggtctcgatgacctcgaccttgatggcgaggccgcggagagggaagaggggcgccgccgctgggcgggctagggttaggttagggtttgcgcgaggaggcgagccatcgaggaggggaggaaagggggaatggtgggatgcggagattgggacgaacgatgacgacgatgagtcgtcgccgatgaaagggctaaggggatagagtatagaaagtttgtaaacgtatacattaaaaaccaaaaaaccgacctggaaagaaaaacgagagaaaaagacgcatatatgtggtttgttggtttttaatgtatacattttttatatatgtatacaaagtttgtatatatgtattaaaagtttgtatacatatgtataaaaaaaggaaaaaaaactaaaaagaaacggaaaaaaactaaaaagaaacggaaaaaactgaaaaagaaacggaaaaaaaagaggagagcgaaagaaaaaaaaacaaaaaagaacgagagagcgtgccgtccaccccaccccccaccccccactccgcgtgcgccacgtgtccggtcgcgcggggggaccgcgcgcgcaactagccgctaaatagtcatttcgctacacatgcacttcactctatatattatatacaagaccacaaaatcttatgtccaaactcaactcacacattaagtataaaaaaataaatttggatatgaatataatagtgatactatatatattcattcttgaatttgtttttttctcaatgtgtaggttcaatttaaatttaattttggtggaattgctagatgtgaagtgcggtgcgtgcccgagcgataagtgctcggcttcctcctgacttacctctcttgagaaatggctgagaagtgctaattaatccgtatcttgtttctcttactagatttaaacctctcttattatattcttactacttcctcagtttataatcatattataagattttctagcattacctatattcatatactacatgttaataagtgcccctttgatttgtaggaaaaatataggaattttggaggatttcaatcctatggaaaaaaaaatcctatgaaggtctttgaaacaaaggattgaatcctatccaatcctttaaaattcctatggaatgggtaatcctatgcacattttggaggaaagttagcaagaggtctaacctcttggaacatttcctctgagtctatctctctcatctgattcctgcgtttttcctgtggtccaatcaaacggccattcctgtgtttttcaaacctctgttttataattgtattcttgtcagaatcctgtgtttttcctattcctctattttttcattcctacgatttaaagggggcctgaatctagatactgtgtctagattcattaacatctatataaatgagaacaatgctagaaagtgttataacctgaaacggagatggtatattcttagatgtataggctattgcttccgtttctatgggcaaaaaaaaaatactatgttagtttatcaatgataataacaagtttaccttgtacttagatatataaatcaggacatatagtgccataattatgaaggtagtatattcacatgtcactaaaccagttttctcattattttcatgatagaaaaatctggatgttacattttactccctccatcccaaaatatagagcgtacctgctctggacacggagacgaaggatatatgtacttatcttgcccatcccaacgcgcgacgcttcgcttcacgcgcgccctcggccttcccagcgcgtagcccatcccacgtcctattttcgtgcacgtatcccatatcccacgtcctattttcacgcgtttatgagacttcttgatcgctcatgcttgcccgcgcgcgttaatttctggccccgcccgctgacaataaaaatttggaaagcatcaactaaaattagcaccatgcatgccagtttgatcggagatttggaaggcgccatcaaccaaattaaatttggaaggcatgaacgaaaattagcgccactttgagcttatcctataaatgtgggcaatggccattcacagttcacacttcacctctcttttttcttctctcgtaaaccctcacatggttcaacgtaatggctggttttgatctgaatcagcctatcaattgggatgaaattgacgatttagagggagttgtaccttatttgaactatgatttcgtttgggatcccggcaacgaaggtgctcattcatgatttgttttccttttctctcttttgtaatctgtcttttttcgatctgtacttgtttgatgatccaattttgtttcgaacgaacagatggagaaggttctggagaagagcgcagcgacggagatgacgacgccggcggcggagcggacgccggcgacggaacggaggccgtggatgcagctgaaaccacaggtactcactagtcgtttagctgtttgagctcaaagccatttgcatgcatggcctgtacaagctcaaagcctcaaagccatttgcatgcagccatgcacagtgccatgcaagcaaaccataataggcatcaacatgctaattaaagccgtatgtatgcatgacttatgttttttattttgtttactgttgcctcctttagtaagcacgtactaaggcgtcatgaactatatgtgcaggtataaatatcaggaagagaaggcactaccctcctgatatgaaacgaagcatatatgctttgtgtttagagagatcaactaatggcatcataaaggagggagtgaccaaatctgttgctaacgacatgcgggtggggaaactgtggagagttgtccaacgtgtatggcggccgcaaaaaaacttccctttaacgctaatgcactggtggagaaaccctttgtagtcccggttcgtaacccccctttagtcccggtttccaaaccgggagtaccaatccgggactaaagatcgagctgacctttttttttttgaatggccctgttgctgcatggtttatatatatatatatatatatatatatatatatatatatatatatatatatatatatatatataaaacccatgcatatatatgtttcaatacatatatatgcatacatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttcttcgttgatgaatcccatgagttgttcttgaaccgctgcgataaattccttgtgtgttgtcaggttatccctcatacgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctgtctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattgaactaactctgtgttgtacggcaacagtatgaacgtcttgtaatgctgcgccttcaggagatggacgagattgtcctctgtttcttgtggatattggtcgagcattgcgacgtttactctccgagggtcgatgaatccagtatcgaaaaccctttgccgtcgggccctttgaatctccattctacaacgataaaagggagtattttattttatatagtctacttatatacaaggacctaattaattaaaggagacgtatagtaagaaatctaattgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaagttcttaacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcgatggagctgggggggcccttgactttgaaggtgccggaagaggagcttgcggaggagtatgtgtaggagcccgaggaggagtcggtgcaggatcctgagaaggagtcggtgctggagcctagggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctaaagggtccgttgggatggccatgcccgacgccaccttcatgttgtgagagattatttattagtaatcaacatatataagcagcaactagcggaatggctaaatcttacctttattgataagttcttgaaaggaatatgtagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcagctggggatcatgggaccgatgtgcggccatgcgttcatcaaccttccttgccacctccttttgcatgttgagttcgtagctcgatacccggaactctaggtctgcaatcttcgcctcggtatctttcttgctcctcatccgactcctggacgtgtggatgtcctccttgaaaccaattttccaaggaatcacccctttcccttgtgttcgtcctggatgctctggagtctgcagggcaagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgatgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttcaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagctttttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatccttgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtggtaagtctaattacaaatcgtgatataagctaagtctaggtgacgtatattatacaaccctagctagtaaataattatatactaagtctaattacaaataaaattatcttatattaaaactcaaataatattacatgctaagactaaaatagtcatgtatatgctaagtgtttcgtgcgtaaatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctcctccaattccttctagggctagctcttccactcaggcttgacggacgactccgacaacacgtcttttctgcaagatacaaaaagatgtattaggataaatgcgaagtaacatatatatatatatatatatatatatatatatatatatatatatatatatatatatatattgcatttcacgttaacgttcgctcgttcacgttcgttcgcttgttctcattcacgttcgttccctcgttctcgcttgtcttcgttcgattgttctcgttctcgctctcgttcgttcgatcgttctcgttcttgttcacgttctcgcggcaacgtacgttgacgtgttcgttctc

SEQ ID NO: 67433 - DNA, 689 bp, Oryza sativa
aaaactgtgataatccctaaaaggaaattaatctgagattctgaatactagcactcagcatactgtactgaattctaattcagattaagactataagaagatgaaaataagaattaaataaccaataccaatttttacttggaaggatatggttaaaagaaatatatcaaacaatagcaattaactattctcacatcattagcaccggtagctaattctatacaagaaaatggcatgattcctgtgaagccttgaatgatataacaatgcaattttcttgaatgagtgatatgatgagtgcttacgttagtcgcttagctatgaagaaaacaggtattctctgcagtttccctccatgcgaaggtttcagttgatcaattactttttctgcttgggtacctgcagcagtcaatacaaactgcaacagacaacattgcataactgcactcagaatatgttggatgggaaatattattagatggaagggaacaaaggaagatactgttttttctcatccagtttccacaccagtttcggtggagaaaaggactggatgtagaattgcggattgagttctttttaataagagaatttggaaaaataccatcgtagagataaatgagttaaaatttaacatcatatgtaagaatgacaattgacatgtggtgtctggacccacctgtcaatga

SEQ ID NO: 67434 - DNA, 571 bp, Oryza sativa
cagcacgcgggggccatatgattgcaatgcgaagcgtaggtctagtcgcgtcgcgtcttggggcagcgagcggcatcgcagctcccatcttgtccgcgctttctgtttgctgcagcggctgcggcagaggcagctgcagggcgaggcgtgtaggagtagaggctagtactgctatagtagctttcggttttgtttgcttgttcggatcaaaaagctgccgcgagaatcatttcgctcccacctgcttcctcttcttcttctctcctcctccactgctgcgtcgtctgcgtgtttttcttttgttttcttttggttccaggggcgctgacaggttgatcagatggatggaggggatggaactggggcttttttgcctccccgtctccagtctcctaccactactgcttctacttctactgcgtctggcagcttgtgtttcccgacgcatcgatctgcatgtttttgggacttgggagcgatcatttgctagtatacgaatacttgtacgcgagcgacacggaatgatggagcgctaatttttcagtgtgccggtggtgtaaatttgcactca

SEQ ID NO: 67435 - DNA, 6183 bp, Oryza sativa
ggatctttactcctggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatatatacttagcatatatatgaatgatattattatattggtaaaaactctaattaagatatatatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcatgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgattttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcataaatcattacgcctccactagtcaacctaacccattggcaccggaacagaggaaccttgagaggaccatagtcaagttcccatatgtcctcgatggcactgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcaatcgacccagacggtcccctcgccaggaaggcaagttgttggttgatcgactcgttacccatgagatgttgtcgtagccacgcggggaaagtatcaatgtgataccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgttttccttccgagagttccctttccccgtagtctcccttcatggcgtgattcaggtaccccgattgggcgaaggtcttggataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtgaaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgagcagcagcgctcgtaggttaaactcatcctgtttgtcctcgtcccacacggggacacattccttcttccacaactgtttaagatcttcgaccagtggtcttaggtacacgtcgatgtcgttaccaggttgcttggggccttgaataataatcggcatcattatgtacttcctcttcatgcatagccaggggggagggtgtagatacacatcgtaacgggccaagtgctatggccgctgctcatctttccaaatggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccctggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattggcgtcttccacttcatcttcttccatttcaacaccttgctctccgtgggatgtccaacaattatagcttggcatgaaccccgactcaaacaagtggaaatgaatagtcctggatgcaaaatactccttctgatttttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataacgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaatttttggagacaaaaaaagtgtgcaaaacataggtgcaaatgtagtatgacaaaaaaaaaacattggaggatgaagttgcaaaccttttaggcacctccgatttgtatgtaatcaccaaaataaatttaatagaaattttggcatgacctcccctcttttttgaagaaattttgaagcttgctcgggcagctggaggaggaagaagacatatatatataggggtgagactttagtcccggttggtagcaccaaccgggactaaagatcccggggggggggcctgacatgacctgacagcattcgaactgggactaaagatgatctttagtcccggttggtaacacaaaccgggactaaaaatcaaatatgcccgttacccttttgaaccgggactaaagatcatctttagccccggtttttattacatccgggaatattgtggaaatcggccgaccgacgaaagatggtttctccaccagtgaatggcatcgaagatgtgccggttagacagcgccatactatcaaagacctcgccaacgctttgcaaatgtcactacaaagaaaacaatttttcatagcgtcactataattttccctgacggttatatgctaaaaccgtcataaaaacataaggaggggtgggggtataggaccgccagtgaaaactgattttctctggtggccatgttaagacgtccgccataaaaaatactctatttttcgaggcggacctcttaagtatccgccagcgaaaaccaatattttcattggcggttactaaacagttccgccagcgaaaaaacagagcccgctaaaaaaatttgacgacatttaaaatctgcgcgggctgagatattttccctcacccacccatatagcaggccaaacgggcggcccggcccagcacgacacggcacgccgacggcacggcccactacggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaaatatgagaaatatatgggaaaaattagaaaatcgtaaaaaaaataaatgggccggtgggccgtgccatgcctgggccgtgccgtgccggcacgctacagtaaacgtgccgtgccgtgccagcccacgggctgaggcatcggcccaaacacggcacgggataacgggccgtgccggcacagcccacaagctggcgtgccgtgccgggcctgggccggctacagtactgccgtgctcgggccggcccggcttggcacggcccatttggccaggtatacccacccacccg

SEQ ID NO: 67436 - DNA, 5267 bp, Oryza sativa
ggccttcccatcccctcctctcccctctcccatatctgtccgatgggagaagcccgccgctggggaggacgggcgcggggaggacggatccgccccggcggcggctcgaggagcacggatccgccccggcggtggcgcggggagcacgaccgcggggcctcgacctcgtcacgaccgacgccgtcgggccgcgggcggtggtgctcggatttctgtgaatttatgtagatttgtgtgcatttgtgtggatttctgttgatcgtgaatggaaaatatcggttgatttgtgtgcaatgtgaatggaaaattctgactgtttttattgtaaattgttgatgtaaatttatgtgaatttgtgaatcgaggagtggatttgggaataatttgaaacggtgttgacggaggcaaacggagcggtgttgctctgtcattttttttaacttgggccactattttcgctggcggttgttataacacaaccgccagcaaaaattgtttttcgctggcggccggtataacacaaccgctagtgaaaatcgattttcgctggcggccgataaccgctagcaaagattttgatcttcactagcattccgccagcaaatctaaattggccgccacgaaagatggtttttgtagtagtgtgttgaaaagcacattgcataggcgtttgaaggaagggaggtttaagcgccatacaaatgccataaagttcaccttaactgaagataatatgaaggcccgtgtccgattttgcatacaaatgcttaatagccaaagcataccggattagttattgctttgctaacataccacaaaataaagtattatgcaagaagacaggaacagattgttgataagctaacatctcaattaagttattttttaggattttacaacttgttactgacggaggaagtagttcttactttgcgggcacacactagaaaaccaaagtacaagcaaagcgattataatatatactctgtacagaggataatgaaattgtaatgcaaagattaaaactacaaagtatagcatctgggtgaattttttttttggagtagtttccagaagtctgaagtgaaattcaaacttttttttttggcaggaaattagcctgtcaccatcatcaccaaaagacgaccatagagtgagtgttgactagagcacaaacctttaagcgcgtaaccaatggtgagaaagagtcaactgaaatgcctaagttattgaggtgaattttccatagcaattgcattgaactcatcatcatccttcaaataattcatccaacaactccttcaactgctcgggcgtggacttgggcggttgattgtgcattccccttgctgctcgctcctctagatacatgctatagtgtgtgacgactttctggacgatggcttgacgcagtctctgccgaaggtcagggtttggaaccttccaaaacttgtgatttgtgtaggttctttggaattctgactcaaacctatcaagtgacaagtatcttcgaaagccgaaaggtttgccggctcttgtctttccaagactaatagaagggttttcaatgaacaggcaactcagcagaggggaccaggagacatggaggtaagtatctatgtacctctgtgtcatgcttgtttctatcagggccgaagatggcaggtccatggattcaacgcggcgcaagacaagctgccaattgttgagcaagaatatgcaccgcaatcccgggtccgagatgagaagggatgcttcctcgagcttgctcctgaggcaggagatcatatcggtgattaggttcaccaccgcgttgaagccctcggtgtcggagatgaacaagcggaagtggtgatcctgtaggatgaatttgagcacgtctccgttgcaccaaacaagtgcgatgtagttcatcatcagctgcgtccggtgagacttgccagaaggtgtccatcaggaaggatgcccgaaccttctccatcattccccagatagcatcactcagcttggacctcttccgcgagaagatgccattgatggcgtcgtcaaatgccggccccggccgcgcctcattcttcccggagccggagccggaggacatcggatgcctctttgaagaaggcgaggacggttggcgaggcgtcggagaagcagtcgtagaggtacagcatccccgggagcatctccggctcccggtggcggcggcggtggtcgtcgttgagagcggctagtgtgatggcgtcgacgaaggccagcatcctgaggatgctcgcctccgcgaactgcacaacctcctgcacgcacacgaagtccggcagctccggtgccggtgacctgttgcctgccgatccctttgtgcgaagcaggaaggcatcgtcgtcgtcggtgccggcgagtgatgacgacgaccttctgtctcggagctcgagcagcgtcatggagaggacctgcaccatgattaggagagctctcatccaccgctccatcaacgccatcaaatcttcgacggaggaggagtctagatctctttgtccggcgtggaggagcagaacccactcgacgtccagctgcgagaaccacttgtggaggagagcttcgtcatggcggcggcggccgaacgcccggatgagtccttgcgtgtagttgtcgcggaccatctggtggagcccggatgacgccgccggagccggagaagctgaccagcggccgctgccgccgccccaaggggatgacatgcaagaagacgacaacgtcgagggcgccgggctcgaagccgtggagctatcgctggaccagcctaatttttctccggcagcgctgctgatctgcgggaagaagaggccgccgcccctcctcatcgaccaccgatgctgatggggccgcccctccaaatccatgaacgacgccaaggcctccatgaacgcgtactgtatacaagaatgaaatctgtgatcgatcgccgcgagcacgtgcctccccgggccgatctcgtcagtactatatactatactactgaggattttcctcgacctcgcctactctacctagccaattaatactacttgcctattaattacttatcggctatcgcctatcgcgtcgcgtgccaccgtaaacacgtcagtagccgcggaaccctccatcgcgacgtacgcgttaagtatcccgcactccgttaggaacagttcatggtaattagcctctcggtttgggtactgctacacgtggtgacgtgcatgctgattttcctcttagacattcatgtctttttctttcttcttataaagttttctctcaaattatttatctaatctacaatccgattacaccattgtgttcgttataattaaatcttcacagcaagatcttacatgattatattacgatgaaaaaatatttatatttgtaaattacttttattatatacgtaagttacttttatcatatagtatataagttacttttagatttgactaagttacttcttagacatataaaagtaaattcaataaagtctaaaagtaatttacatatattataaaagtatcttaaaacaaaacggaagtaactttgtaatgacattagaagtaaattcgttgcagggataaaaatataactttatctagatattaaaattaatcagcacagatcaacacgcgtaagtttaacaatttttaaaagtaacttcaatgttaattagaagtaacttttgcatggttcagaagtaactctctataaatctgtttaatcactgattgtttttttcctttcatttttgtttttttttatgtagaatgagaaaagaagataaaaccgttgatggattgtaaataacattgatagaataaataataagaattaaccatgtataagatgtaatagtttctttataacatgtaataaattacttttaaattaataaaatgagaatattttcaatatgaatattgttttgtcacatattttgagtggagtaaaatgatgcaaatagatcttaaaaacaatatgtgatttaaaagatataagttattaaagagattaaaaaaagatacatactattatactattggagtacaaaccagcagtcacgtccaatgaaaaaaggcaggcattaaagttactttctttttgttataagttacttctataatatatgtaaaatacttttaagctttattgaatttacttttatatgtcgaagaagtaatttagtgaaatctaaaagtaatttagatatattataaaaataatttataatttttcatcaaaatataatcatgtgagatcttgttataaatatttaattgttatgaacacaacggtgtaatcggatcgtagatcggatgagtagtttaagataaaattttatttgaagtataggtggatagagtctctcatagatggagtgacaaaccagctacacgtccatatcaaagtatgaccgaattaactagcttctctttcacaactactcggcgcatcttaatttggctgtgtttagatccaaagtttggatctaaacttcagtccttttccatcacatcaacctatcatacacacacaacttttcagtcacatcatctctaattttaaccaaattcaaactttgcgctgaactaaacacagcctttgtaggtcggtatgcatacacatatgaattggataggaaaacaaacaacacagcaaaattacagcgaacacaaaaagacttgcgcgttaagtatgacggaaaacaacagttgaaattaatatacatattaattgacagcggtcgcaagagaggaggataacaaagctaacagctaattgaaagggacatcactcgcgtaatgccacaaagtctcccagttaaacaaccttggaaaaggctagcttgctgcaacgaactcagcagaaaattacaaccatatatacgaaataaagggaaggatctcaggaagctccctgtcatgtaccatcgaagctgagaaattatatcttactatcaagttacaacccattaaatcttaaaattcaatataactcttcgaaagaagagtgtggtggcaaggttacagatcgatattacagctcgattacatacaactaggtggtggcaaggtttgatgccgccagtggcggagcgacatgccgcgcactggcacaggtggttccatagcttcaccgtcaagaaaatgagataagcggtagctttaccacgacttggcttggccatacaaagcctaggttcaagcccgtggttagatgtttgtgtttttttcaaaacc

SEQ ID NO: 67437 - DNA, 1521 bp, Oryza sativa
taataaatactgcatctcttaatttgagtcaatgatcatgcagtttttcgtcaacttcgaacgaaggttcacaaataagattcaataattgtgagatctttatctagtgttggtgcatattagtttgtgtttgctagtatttgggtgtgcttttatggactttctggtgtgtgctcgttatcgggtaaatttatgtaataattggctgtaactcgttgagtaaaggctgaagttttattccattatctcaaagaaaaaggaaaaacctttcttaattgcaattcattccctttgcagaagctaaaaagaaggaattttcatagaattttttttccgattcctttggtttttccgtggtgcaatgcgcactgatcggttaatctgttaccttcaatggaggaggagatagccgaaagccagcgtaggtatcgcggagacaatcacccggaagccaaagcgaaaggagaggagagtgcggcacgcgcgcacacatgcagtacgacctctggaagaaagaaacgaaagggaaatcccaaggaaaagttcgtgacaaattctcctcttcgaatcattgatctgcaaaagcgaggcaaatttgaaaaaagccatttcgaataaatgtaggagtttcgtggtggagcttcttcgctgaattctaggctaataatattcggctttcagtaactttctgtagattgaatatactcctatctttttttgatagaaaaggcacaataattgtaagagttagtataagtttaattaatgtaccatattgttccatgattccatcttttctagtacatgcatgcacgagtggaaaagagggacaaaccggcacggcgaggagacagagcttctgttgtctgaaaaagaagaagaggaacacagctgcatttcggcgctttacacaagcctagtacagcactacaaccattgcactgatgatgagcagtgccactgcaagaaagtaacaggaattataacagaaattatatttgcttaattgcattgcttattattcggtcagtaatatttcctttattttacctgtatccaattggggaatgatccttttacttggtaatggatgtagacgctcatcctaacaccgattgggataacatatacgctatgggttagttgcgcaaacaggggttttcaaccagcatcataatgagcaagaaattttagtcttcaagaaaagcaagaaattgattaatttgtgggtcgacggaatcaaaacaataatgttgacaaccaacaggaaaaaaggtctgcctgttaatatgtactaccatatatttgattgcatctctcttgtagagtaatgcttggtgaaagtattgaatagatttcataggaaaaaaggttcaattcccgcaataaaacacagaagaaattccctcgttccaaacgcggcgaaaagggaaaccaacaatttcttcgaaaatcattgtaacattcaagttcatctgaggcaaacttcctctaccataatactgggaatcttgccattta

SEQ ID NO: 67438 - DNA, 3235 bp, Oryza sativa
tcacgggtgtgaaaaaaattaccccaaccccaaagtgaacccctgaccccccaagcggtggagaaggagagcgcctcctcctccatcatgggcgcgtatacctctggctcgtacgcgagccctccggccaccacctcccatcgcccccggctgccgccgtgatccggccgacgaggttcgcgaccccgtggggctgccgcatggggggaacccagaacgaccccccggcgacgaaggggagctagtcgggcgccacacggcgcaccatgacgccatgaatcgcctcctccaggcgcctgaccccgaccatctccaccgacgcaggggaggaggcggggcccaaggtggaggcgtccgcggcggcatcgtcctcggcgaggttgtggacccccgtttttataacaggaatcaatcgtgtaaacagtaccattttcctggatcaagtagtctggtacacacgaattcttagctgaaataccatgtgcacatacacgagtgtctagtacgaatcattacatcataagcccgcagacatagtcttaaatcatcggaccgaacggtccggaatacatcccaaaaaaagaagtaggtaaggcagcggagttaaggcagcggcacgccattgccacaggcaacgaccgtaactaagacctactgggcgccatcgtcttcatcaccctcctggtagtaagcgtagggatcctccgaagcttcatctccgacctctgattaagtttgtatattgcaagggtgagtaccaaccgtactcagcaagccaccacagcaataatacacatgacaggggtattcaaaggatggctatggttcttttgcgcaaagcaagttttgtaattcttttcacaagcctaagacctagcacagattgatcaaattttagtaccagtgttcatattaaacaatgacggttctgtccaccatccattgtgatcctaaggatagcttcccgccattgagtcgtcatggttttctgaggacgtccacattcccgcctctcaggaagtggctccatcagcatagaaatcatcatgcaatatcccatcccacacaaattaagaatttagagtctagccaagtgtaatacatgtcccggtgctcaataaccgcgagcacggctattcgaatagatttggtttactcacactgcagtggatgtacactttacccgcactccgcgactgtccaacacatgagcctcgtcccaacacatgagacgcgtcacggcaaagccttttgataacctcgcattggcagtacccactccatgaactttagtcctcatgcactctaggcgtcatacgtttctagcagtgagaggagttctggcgctcccgggaagggaaaaacacacactgctacgttgcttcttgtcgttgaacccagtccatcatgattgttctcttatgggtatcctcatgtagtattgccaagccagcctctgaccatctggaacgggcatccaccatccacctggccatccgaatcgggcatccgccagcagactgcttgccgcatcacacacctaaaagaagaccactacgcatggatattgcctccgctcagctatctactccgctaggtctatacccatacgagaagtgcggttgtacgggggtcgtttcatgcttaacttcatggctcggtccttaactgaccagggacggcactagcctttttcggacaccacccaaaacctccagccgccccagtcgaaaacagttgtttagtttttatttctcctttcacaaatcatgtcatcaacatcatggaaatgtggcgctcatgtctccacatgccacatctcaattaccttcccaaaggtaattgcccaagcatataacatttgataaatatgagtatgcatgattctaaaatagcatttctaagcaattgtcataattgactagggactcatacgtaaacatggttacaaggattttaagggtaaacaataatcaaggcatggcataatcacaagtaggatgtttatcattgcatgcaattttatttgtaaacaaaataatttcgcaattgggatcaacatgttcaaagaatagtgatgacttgccttgctcaaagtctttcgggtcttgaccttcgcttggatccgcaactctctcggactctatagttacgtgcgaaaattgatttgaattcggttagaattcaaataaaaatccaaatcaatccaaatgaaagtcgaatgcgaaagtcgattcctttatattaactttactattcgcgaactaaggcaaacccaattttgattcaaactattttgcgggtataaatattttgttgtcataagtttttaatttaatctacccgagcattatatccatataataggttagaaatttctatcgcgagctaaatatcggacgaaatcctagaaatattatacaatttaatttagtctatgactaaatgattaaatataatacacggctaaaatccctagtaattaaatccgaatttctaccgtgaatcgattacttatagggattacccaaaaataatctataataatatataagaattcatctatttgtttagttatgaattacatctaaattactaccgcgaattgatttcttatagaaattaccaagaataatccataatttatattaaattttgcaattctacgactataattaatctataattaaattctaattattttaaattttctaaacttccctaatctccccctaatttcttttttttttcttttctttttctctcctttcttttctttttccttttctttctctcttccctcttttctctctcccggctcctttctcccttcctctcttttctttttctctcctccctcccggcttctttctatctctctctctcggctctttgctcccccgggcggcgacggcggtgggcgcgaggtggagggggggaaagacggctcaccggcggcggcggtggcggcgacaacagcgacggcggcgcaggacacggcgcggcacccggtgcggtgcggcgtcaccgaggtcggcggcgcggcgtcaccgaggtcggcggcgcggcggcaacgatggtgacggcggcgcaagtcgcggcgtggcgcggcgactttgtggcgcggcgcggcggctcggaaacggccgcgcggcggcactacgacggcggcctgtggagaatgggggagagggagaggagaagggaatggagtggggaataatggagaggggtg

SEQ ID NO: 67439 - DNA, 6500 bp, Oryza sativa
agggagcacatcgaacacctacgccataatgaacagtgtattttcctatttatcccgattttagtttattttccatataaatttgattctataatttctaaatcttgcataaatgaagtttactcaatatttgtgttatctcaactaatgaattcaccctatattaatattactcatattttatttgtataatttatttgaatttttaattagggttaattcttgttccattgcatttaaatctaattaatacaaatatggtcgcgatgatattttatttatttctatccttacataatctttattttaaattataatttatttatttctttgaccaaatctaatttcagggttgattcctaattaattttcccctatttgtgatcgatgagttccgaaatcaaaatctaataaaatcatcgaataaaattggcatgatgcaatttgtttaaaaagtttttgaaggcccatatttttagagtttagatttttgtcggtcgaattttcagggtgttacagaggtcgatctcgatgacctcaaccttggtggcgaggccgctgagagagaggaggggcgtcgccgccaaacgggctagggttagggttagggtttgcgcgaggaggcaagccatcgaggaggggggaatggagggatgcggagattgggacgaacgacgacgacgacggcaatgaaagggcgaaggggatagggacggggggagagacgagagatgtcagatgccgcggagatgagaggataatggggttagctcacgtgataggtgcgtgcgtatgtgggcccccggtgtcggtgtgacaggggcgtcgatcggcacatcattgttagccaaaaggcctacggcccgacccatggcatggagatttggcctggtctaggcacgacatagcctgattgttgttgggcttgtgccggcccgacctgaccaacgggctgtgcccgggcctcttcctcggcacgacgggcccaacaacagggaggcaaaataggcttattccaaggcacggtccaaagaaatgaaggatgtaaaatgggcttatttctagccatataagtcacggtctaaagagatgagggaggtaaaatagatttattctaagatgagcatgatgggctggtcgtgctttcaggccgaactgcatggcccgcatcttataaggccgtgcctgggtcacaagtacaacctgtgggttggcccagcacggcacaaagagtatgacgggccgtgtcagcctgacatttgccttggatcgtgctctagctagtcgtgtccgggcgacgttgtgcttggtggcccatttgacttggtgcattaggaatcattgggatcaggtgcagtgcatgcccatttgcccgtttacatattgatctatcttgttcatatttttttaatttttttcataaccatttagatgatatgtaataaacgggtggacgttcactcgagctgttaaaatagtttcccggtgcaatttaggcagccgatcaatctataacgcctacaacgtatcaaacggatgagactaaaggaaatatgcttcttctcgagatcatctgcttctcctatctattcctttttcttttgcatacttcgtcacttgaagcaataacaacttggccaagagaaccccgcggttcaattatgaaaacgggccgaactcatcacattgttcaattccatcaagattcaaggttgattggggtttacttgtgctcctcattggtcaaagcattctcattctacgctactgagttccgaatcgttcgttagtttcatgcgtaagagcaagtacaatagagcatagtccgcaggctataaaaagtaacacatcatccaaatacacatgtggaggagtaagaaaattggagagggagggtagggggcgctagcgccaggctgcgcaagaaacaatgtaaatcacgggtaagtggtaacggtgcaaatcaatgaaataagtaaaccaaaggaaaattttctttcctacaagttatagagagaaaacataagaaattttacatccactcaaacctccattttttctattcccatgttgaaattctcaaaacaaataggccctaaactgaattagagctattacctatctcgaggacctgatccactataaaagttcatgtttcccgtcctcttccaatctcgcgtataccttggtatcaatgcaccttacgtccttgaaataccgttgttggttacattacttcgacaaaaacatatgttcaacggtcagctgctttgggcctatttggtacatcttctattctgagatccttgtctcctatagttcctatagttaaagttgtaccaaacacttctgagattatatataatatgaaccagggttaatggattgactcgacaaaaaatggacaatgagaatggagcgacattccctccgctcagcccttggagtaggaggtataccaaaaggtcccttcgtctatttaaacatagatgtaatattatattatatattttaaaaattacaatgtaggttttatgatttctattgtaaatttaatttagaataaattttacgaaactacaaatactttgaccaaagtatcacaaaactagatatttaagaatgtgtatctaaaactacaaatttagcatgaaatttatcatagaactacaaattttagagtttatatccattgcactattgagattataaaagtttaattttgtgattaaactgatgttaaatctgtagttttctgatatgaaaccttaaatatgtaattttgtgaaaaatacaatttcaaatctttagtacatgtagttttagttttgtgaaatttactctttaatttataatttaaaaaaatgtctgaaaatgtggcgctataatttaataaaaatgcttacaatcggccgtccgatgtgaggcgcaaacgtcggacggacgcgcgagccgttcgatccgctaggaacgacacgagactagcaggtagcgaaccttatctcttcatcgctcattgtcgtccactcatttccctcaccctttcctccctcctccccttcttatctctctcttctccaagaaaccagagctgcttgcaagtccaagctcctaggtgatgcaagctccaaggggagagggaggtctggtcggcatgcgacggtagcgtggtcgacactggagtgggaggtctggccagcgtgcgatggcagcgtggtcgccgatgtcgcctaggcagcagcaagctcctaggtgatgcatgcagcgaccctacgcgtcaagctgaccaaccaggcgatggcaccacttcttctctcgcgttcaatgtgtcgccgtggaggccggcaccgtcatggacgtcgacgcctcaccaccgggagcatgtaggggagaagtacaagaacgggtgtgttgagatttttttcaatgtttcagatagtttagtttgatgtttctttgggttggatcgaatgttgcaattggattttagatggtgttccataactttgctccttgatgcaaaccaccaatggaaatttgttgtttcacatgtgtgaatgaaatgtttcggtcatgacttgaatatgtttcagcattttaacaatgtgaaacatttttttctagtggtgaaacattttcgtagtagcgctgaaagagcgcccaattttttattttttgatgtttcaccccatgtaccataatatagttagatttaaaatgttccagtgaggttgtcagtagtgtttcattcttttttttcgtcgtagttggatgtgtttcatgtttcattttgtaccgtgtagtaaaatgttttattgcgtgatttgattgtgtttcactattttttttaatgaaacatatttaggagaaaaatcgagcgcctgatttataggtgcttccgccggcgacagagagaaccgctggtggcagagtcgtgccgcgcagcgccaatcgcgccaccgagaagatcacttcgagctagcggtcaacgggtttattttgttcgggacgttgcaaccgcaaggcagggtgtcctgtgcacacttttaatcgacggctaacagcgtgcgcgcagatcagacggttcatatatacgtctgaattgacgcgtagcgctctccatagtttggtccttgtaatattgtgctttactaaaatttacaccatttacaaatatcaaatataactacaggtgtgtagtgcacatgcacatgaacatgcattgtatattgacttttctataattgtgaaagttagccatcgaatagtactataccgaaaaaaaaagaaaaatccatctgtcagtctcacatccggtcccacatgtcagtctcacgttgctgctctcgtaacaaacacggattacacgagctcttatatatatatttgactcccgaaatctcgacgcttacggcggcgcgcgactactattacggcgatcggatctgctcgccgccgccaccgccaccgccgccgctgacgacgacgacgacgacgactgagcgagccatggactatttcacggggacggggactatcgtggtctccgacgacagcctctacgccgccttcggctacggcgaccccttcggcttcgccccgcgcgcgaggcccccgatccgttccctgcccttcgccgccggcggctaccagtggtgcctctggttccaccccaccaccttcgccggcttcttcggcttcggcgtcgagctcctcaccgccggcgccaaggccagggcgtccttcgagttcggccccgtcgacgccgcctcccacaacgtcatcgtgcggatgccgcccttcctcttcgaccacccccaccaccccatggtcatcatggtctggcccaaggccatgctcgccgaggaggcgacactgttcgtccgcgaccacgccgtcgtgttccgggtcgacgtcaccgtcgtcccggacgagccgctgcctccggacgccggcgtcggcgacgacgacgtgctgccgccctcggacatgctggcccagctcggcaacgtctacgacaccaaggagggcgcggacgtgacgttctccgtcgacggcgagctcttcgccgcgcaccgggtcatcctcgccatgcgctcgccggtgttcagggcggcggtgtacggcgagatgagggagagcggccgcggcggcggaccgatcgccatcgacgacatgcgccccgacgtgttcgacgcgctgctccgctacatctacaccgacgccctccccgccgccgccgacgacgacgacatggaggcaacgtggagcgacctcctggtcgccgccgaccggtacggcgtggagaggctgaagctgatctgcgagcgcgcgctgcgcgggaggctcgacgccggcaacgtcgccgacatgctggcgctggccgaccggcagcactgcgagacgctcaaggatgcttgcatcaagttcatggcgacgtcggggaagatggaggaggtgaaggcgagccaggggtacgtgcagctccgtacttcttgccctttgctcttggtcgaggttttagagaagtcaagcaaattttgcaaaccttaattactaggacaactggacaattgtacagattaataaaggtagtgataagtggatacaatatgttataatgttggtcttttggccattatttttctatgccttacggaatacgtactttaatgaaaactgaatactccgtatgtaaaaaaaaaaatccaacctacgtaggaatatgacaatgtgacactacctaggacaacggatatgaacaaactgatccgcagctaggttggttttccttggaacggagagagtacatcactttcaacctctgcatgttctattctttcctctctcatcctacctcctttccccaaatcccccattccgttcttcctctgctaggcaagatgacaagatgtagactacgcatgattaccaccggcatcgagtgacctccaggaatgcctgattctcatttatatacagatggtggccgatagagaaacgggagccaaagaccaaatcggcgtctaccttgagctcatcaccaagggaaccaaggcgagagcctcctacaagctcagactactcaaccatgtcaccgcctgtccttgcttgtggtacacctgcccactcaaaatctatgactctatcgatgataacaaatctttcacctggggaaccaagaaattcgctgacaggagcaagctagaagtcgcatcggagtatctacaagacgttcgcctcgtaatcgagtgcgatgtcatgccattagtaaggatcgaagcgatcgcggaaatcatccgatcaccttcttctccttggtcgcaactgtcagaagacattggcaagctgctagagatggagaccggacggagccgacgtgagcttcaaggtcaacggtgaggccatcgacgcgcatagcatggtgctggtggcacgatcaccggtgttcaaagcggagctcaacaggctgattagaggcgagagagggctcaagataa

SEQ ID NO: 67440 - DNA, 2157 bp, Oryza sativa
  unsure (1)..(2157): unsure at all n locations
cggcccgccctagtgcccttgccgtgcctgccgctggccaccggtatcgcctactcctaccatgcccaacgttggccaacagttcaccgttcgccaccaacttcaccaccgtaggccgcagcatcaaaatccaattgataagtcaagtcccgttggtcccctctttcaattttgctagaccatccataacccatgattattgattaagttagtgtttgttgcttgcattgaacggaggggagtaggatgacagcaagtggctagttataagatggtttcttcattatggtacgcatatttttaatttttctatgtattttcttgttatatattgccatcaattagagatatgatgcttatatgtattgggtacacaactatttagtacaatatcactttagaattatacataccggtattacacagagaaagtcaggaaccccctcatcttttctctagctccgtccctgtgtaaaagtattgttcatgtgttaatgtaatgtgctgtagcgatcgatcccgtgcgctcgctgtaaatcgggcggctgagattaccctaaagtcaccgcactgtgcttctctgacttcactgtgtaaagtaagatgatctcaatctctttacagaacatttggcagagtaagacttcgatctgatctggcaacaaatgaaggttcttgttgtgatgagcgaaatcctagcatcataaggcgtccgtctgccagtccatgcgacggcgatctgaccaatggacaggtttgacacaaagattctcttggtctcgatcgtgcagcttgtacgagtaattctgggtctctacttcaattcatgatgtttgttcttcattcagaactcattttgagtaattcttgtgccaactgaaaatcaatcaataatgccgattggatgttccatttcattcgagagtgatctcttatgaccacttgggctctgtctgttcccgttaggcaggagaggtgagaatgtaattaggttccttttcttcattnntgcatatcttattatgctattccgtttttttaacataggggtatgaaaaaaaaagggagaattgtgaagatggtccctaaaattttgctcctgggtcattttagtccttaatctttcatattgtccaaacaagtcctttaaatttgtcacatgggctgatatagtccttggtcccaccaaaatcgccacatggacataccatatcaccctcctatgcaaaatctatatgatttgtccaatttacccttatatatatcataggaaaataaaaaacaaaagaaaaagttaaaaaatatggtatatataagagcaaaaatatacgtcaaaaaggtgaaaaaaggaaaagtattttttttccctatggttatgtctaattcacccttacatttctttttctatgatatacgtaagggtaaattggacaattcatcatagattttgcatgaatgatgacatggcatatccatacgacgatttggtggacccattctaggccttatgacaaagtttaaggacttctttgaactatttaaaaggttaaggactaagctgattctacatagaaactttagggactacagtagctattctcccgaaaaaaaaagtaggtactactttcatcgtaaaacagttgtcattctggagtgtttaagtatatattaaggtttaaaaaagactacaatgtccctaattaaatggggatagttggggacaaaagggaaaaatttaaatggaaagtgtttgatgggatatttagtacaaactattttatgataaattttaaatcttagaaaaaacaattgttttaggacggatagagcaaatgacaaaatatatcctacaagtgggtatccacaattgaattagtataaaattgtcaagattgaatacataattattatatatcgagcttaattaagacactacgtatacatataagtgagcgttcgtgaactaatattatccgttgtttttaatatggtggcatctaaacgttcggccgccaataagatcaacaaattaatgcagtcaaaatattttaggtaaccattggtgaaacattaagttatttggttgggaaacaaaaattttaaatcattgaaataattgaaagatatgcgaagcccaataaaatgtgtgatacattt

SEQ ID NO: 67441 - DNA, 722 bp, Oryza sativa
ttttttatgtttatcgaatttgtagtgttgtacctcatattctagctaagtctatagtttatgaagttgatgctatatggactgtaaataatatttagtagggcctctattatatcccctaagatagaaaggcatcaaaatcacccttgactacagcccctattcttgaggctctatgccacagtccctatacactattcattagcgcagaaagacatttttcctcacctatttgttccctctcctccctaccatgcaccgtacctccgccatgctgccgccccaccgtccaacatcctcactattgccccttcacccctctttcgtcgatgcatgctagaagaatagatcgatggttcattgtcatccccaatcttcgttgtccttatcttcaagctccctagatgttgtgttgcaaccaggttccacattagccttcgagctcctccgtcctagtccgccgcaactcttttatttgtcccctatgacatcctctaccgacgccatgttgttgcttggatagacttcaaataactatgaactatgtggtgtcttaaacatttgctactcgtattttgtcattccatatttaaaagttttaaatttaaatttgagttgtggtctttgaaattgtgaatttgtatatgatcagattatatgcattagaaatatttatgttcaattattctatgttaactaataatagtaacataaagtgtatg

SEQ ID NO: 67442 - DNA, 3178 bp, Oryza sativa
ccaatcctccccgtttctcgtccgcgccgttgccgtagccttccgagctctgtctcgcctccgccgttcatcgccaagcgcagggagagccggtgcgttcgtggacgcggaaggggactccgggcgctcgtcttcctcctcttccccggcccgaggccggagagattactcccgcgccgtcggcctctcgtcactgcgccccgcccgcacggtagtgcctccctccgttcttcctcctcgctccatctcccccccttagttttcggtagtagcttgtgtagcctccccgtagctagccggcgccgccccaaccgttgccgccgctcgccatgtgctcgccgccgtcgccgcccgtgctccgtagcacccgctcgtcgccgacctcgctcggcgtagctccgcccaatccgacgctagcaacggattcccgtaaccgcgtagatgctctcaccgccgggaattggcccctcgtgacctcgtcgccgtttcccccttttctctccgccgggtgccgccgccgcaatccgccgccgtcgagcatcccccggcaaatccgagtagttggctcgactcccctcgtcccgcgcaacttcccggtgtgctcgctttcgcctagatcgccgtgtttcgcttcgccgcttgccaccgccgtccgccgtccgttccggccggcgtcttcttcaacctcccgccggcccgcgtggctgccacgtaggcgccacgtcggcgccacctcgaccgtgaccggatcagctgacccggccagccgctccctccgtttcccctccctcgcgcgcgcggtccaccgcgagctgtgaggctgcgcgtgggcccgccgcatccgcgtcctccgcgaaccgcgcgcgtgcaccgcgtccctcccccaaaccctggcgcgcgccgcgtgcgcgttccgcacggtgaaccgtgtcaccgacaagcgggtcccactcgggaccacgcgaggtgagcccagtccaccggctccctctctcctcccctcccgcgcgcgcgctctgggccgccttcttgggccgaccggcccatttagctcggccgagccgccccttttctctcgggccgcgccctagccgcccgagggaagtctacttcccctccctcttccttttctttttccaaaagggtttaaataaatcctttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccggttgttgagttgtcccgttttgcgtgtagtttcggagcccgaagacccgcagtgcgaggatttcgagggtcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttattgcatttgatccttcctttgttaattgttatagtcatgtccccttgtaaccatctagttgcgtctcgatattcgtgcaccctgtgcgaatatcgacggacgccttcaaacttaaaatctgaataacaacttgggtaaaacttgggttttacaaaagacttggaaaacccgacacctgggtcggtgcttgcgaactaaataaatttcgaaaaccgcggaccggggaacttaccgggtgtacggtttcccgctctcgcacttaaggaccgtttccttggaatttcatccaaacgtaagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttagaaatgccttgtcatgaaagcttggaggtctcccgacgtggctgatccccacgggctgggtgatccgggttagtaatgtcgtgtgggtaaagtgtacctcctcttcagaggttaacaaactgttcgaacagccgtgcccacggtcatgggcggatgtgaggtgattcctagcacagttttgtttgactactgcttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacaaactccgaccggacgagacgcactgtctcaaccgtgttgtttgagaagcactcacttagttgtttttagaaaagagttcaaataaaatcaattgcaaaaacaacagcctttctttgaagcctgcattaaacacttatttcccatggcttgctgagtactcccgtactcacccttgctctatataaataaccccccccagttgctgaagaagatgaagcggatcctgctgatgagaagttcttccaggagcaagccggctacgatgagttttagggtttcggcctagttcccaagtcgcgcctgtgttgattggtccaagtcctggcttccatttcccttttgtaatgcagttgtgagctcgggatctgtccgcagcccaacatgactgtatctctactctataataaagagacccctgttgctgtgatattctgtctccctgtgataccagcactgtttcctgggactggtatcgattaacaggttaatttggagcgtcacaggctagttccggtcggtactagttcggggcgtgacaacttttaatattcctttttctaatccaaaatttcaatcatttctagattatattctgtatggactcttatacttttatttcaatattcctttttttaatttcatggtatttataaattccggattactgttatttttaaattgtattcctatttggaatctattttttatttttttcctctttttctccaattaatatgagaatttctcgaccgtgagagtgaatgtggaggctc

SEQ ID NO: 67443 - DNA, 837 bp, Oryza sativa
acgcaggaataggaactggcttgaagttctcgatgcgccatatttccaagcctctgtagtgtattaaggataatcgtggctttgtacattgattggactaggaccaataaaatagtgaactgaacagattgtcaattgtaaatactcaaaaaagatcaagagtttaatgaatatttaaagaaaaaaaggcttctgctaaatcactacagaccctgtgatcattgttatctcattaacttctactctgctaatgctaatgtctagcatattgtcaagaagcttgcacctgtcaggatacttcatatgtgtgcacagtagcattgcaaattcatgatcatctagcaaacaaatgcattttacttgttttagcagaagtgtacaattaaattatcttcttaggaccaattaattcaacatggtagatagtgttcactcaacttatggacaaaaaacaactaaaccacaaattcagagtttcaacatgcacaaagaagttttcctggttgacttaagtaatgttatcttgcaaattaagtgacttcaatcaaggtgaagataatgaaagcaatagaggaaagtacactaaggtgaaattaaaaaaaaggatactccttttgcccagcaccacgaaaagctggatccaaatccttcatagaaaccgacatccttgatgttaaagaaacctctcaattcttctctttcacaggagagctaatagtatgctgtaaacaggggtagaaaaggtgggcagtaattaattagcaaacgaaaatgcacttggttttccttttttacgaaaattaaactagatagttcagttgttaagaaacacgaccg

SEQ ID NO: 67444 - DNA, 580 bp, Oryza sativa
agtgccttgagccacgtcgtccccgacttggggaggctggcgaggaggacgtcgccggcgcggggcacgaggccgccgcggtgcatggcgaccacgccctgcgcccagctctcgaacacccaggtccccccgtagcagcgcatcggctggccgtaggagacgcccgccggcagggcggagacggcggcggcgagctccgtcggagggcgcaccggcgtggcgtcgacgtcgacagcgtccttgaacgcgacggggcctccaccatggcgcacagctgctcttgctgccggctctcctcccttgttcgccatggcggcagcaagagcgagtatcgactcttataagaccctagtacttactatactccgtatattggtttgctgttgagaaaagatttggtatgcatggccagatggccttgacagccggatgagattctctacaatactttatttggcaggttactataggcactatctggacgagattttagcggccacagtttctccaaaaatttctagctctcgaatgatcaatattcttatccggattcttaggcccgtttagtaggactccaagc

SEQ ID NO: 67445 - DNA, 4610 bp, Oryza sativa
tccatgtgtcaaacgttctcctgtattcatgctttagacatgctatttggactttaaaacttttctttggttcctcgtgtgacggttcttttttcattcttgagattcaactcggtagtttcaattttatttttccggttacaatgtatctccttttcgattttctctttagacttcaaagcttcaactatgttctgaaatgacaatctcctaaattttgtctgaacgtatgctaaccagtttgtgaaaagaatatatttgcttgtgattaaacctttgcatccttttgtgctctgtagtttttatcctagactaatatctagtttctagagttacgtttccatgtttataaaaaaaatatctttattgtgggctagacgtctacatttggttgcatcttattgattttatgaatatcgtagtttgcttctcctgaacgattttatgaatatcgtagtttgtttgaactttttttttctggtttataaaagaaaaatattattttgcattgaagcccgagcgttttattttctctaacgttcattttgaacttattaattgagttttagagattcgttttcttgtttattgaaaacaaataagtttgttgtaaactgaacccatgcattttgttgcaccttaaagcttttttaaaaattgcgatttccttgtatcgatcgtttttaggtttgtcccttcacgctttaatgttccgtccttttattcaaactaaacgcttttagttggatttctttattttcgaacttttctgttaatgcttttgatgttctccttggactttaaagctttaattcagttttgaaatatcagatttcctaaattttgattgaacttatgcttactagtttgtgaaaagaaaatatttgcttgcatttaaatcttgggcttttttgtgctctaccattttcatttttaatttataactcagttcgagagttacatttccatgtttatcgaaaatatattttggttgctggctagacgtctacatttggttgcatcctattgattttatgaaaaccgtaatttgtttgttccgaacgatttattggtttctccgttgacgcttcttttttcatccataagtttaaattttgtacttttaggtggatttcttgattttgtattgttcttgcatcgattcttcaaataacctttttggagtttccaatattttttcgttgtcacgattcatgttccttaagttattcttttgcattgaagcttaactgatttattttgctcttataattgagttgtagagttggatctccctgtttatcgaaaacaaatatctttgttgtgagctgggcccatgcgttttgttgcacgttgaagcttttatgaaaatcaaggtttcctttctcatgacgattcattttctgtcctttcgtttaaatcttttgcatttagttggatttctttattttcgaacgttctcttgtattaatgcttttgacatgctatttggtctttaaaacttcattttggtttctcgagtgacggttgttttttcatccttgagtttcaattttgtactgttaatttgatttcttcaaatacgaagtttctcttttttttttcatcttctctttggactttaaatatttattttagttctgaaatgtcagtttcctaaattttgtttgaacttatgcttaatagtttttgacaagaacatacttgtgtgaatttaaaccttgcagttttttttgtgctctgacgttttaattttggccttatatttaaattctagagttatgcctccttttttatcgaaaaaatattttggttccgagctggatgtctttattcggtcgcatcttattgattttatgaaaatcgtagtttggttgtaccaaacaatatcttggtttctccgttgaggcttcatttttcattgagaaatttatattttgtacttttaattggattcctttattttgaaacattcttcttcatcaattcttcaaatatcccttttggagtttccaatttttgttgttgtcacggttcatcttaagtttgtttgaactttgttttctagtttataaaaacaaattattcttttgctttatgccctgaccgatttgttttgctctgtcattaatattgatcttttaattgagttgtagagttgagtctcccagtttattgaaaacaactaactttgttatgagttggatccttatagtttgttgcacgttcaatcacagtttccttgtatcaaacgtttctaggtttctcccttgacgctttattttacgcatttcatttaaaattttatgctttttgttggatatctttattttcgaatgttctcttgtattcatacttttgacatgttatttggactttaaaactttactttggtttctattttcgagtgttctctagtctctattttgattttgaaaactcttatcttgctctataggaccgagactttttcaaagcttgtacttctgtgaaaatgagattgaaaacacttattaatcataacaaatcagttccagagtgtcttgcaaagttttgaaatccatttgcaaactacacctatgtactagtacggatttgcaaaatatcaggtcaaaaatagcctctagtatataggatttgaaaatggatggataaaatttaaatcttgaaagatatgataaggtttccatctccttacgttatctctgcaccaaaaaaatgaatttggtagattttgaactcctctcttccgacatttcaaattttaccgacatggtctagaacgggtagtttgtgaaggataaaattgttgtgcttaaacctgtagattgttggcttagattgaccacccaaaattcacatagcctctataccaccctaacctaatgtaaataaaatatgaggaatttaggtaacttaaaacatgaataaagtttctttctgtgtcggttgatcgtgttctggaatttcgagtcagtctgttaattttgccaaggctaaactgtaggcgatagacctgagaatttttatgaggaacatgtacgtcaccccaataggcttcatgaattttattgtgatttttggacctttgcatcatagggtaataactcaattagtgtgcataaccgtgttctgaaatctttagacagcggcattcatgtttttatgtagtccaaaccgtaaaagataatcatgctatcttttaacagtagcttgtagacatacccagtagactccatgaattttggctaaattttttgagtctttgcatcatgttctaaaagttcataaaacactacatagtcccaacctgaaaacagtaggtaacctcgttgtcgaatttgtgtagcccaatctagaagggacaaaatcttggttccttcagggtgctcataaggtagctctgtttttcttttaaaaaaattcttttgaacctttagaaattgacctaaaaattaggtaaagatagtagaccagtaaatgccagcactgcatcacttgttttgaccaatttctccaaaataatctatttgcccaaaaaatcaccattccttctcagattggagaaaactttgttaggatcatgaatataaatttttttctaacttatcacccatctaccatagtcttttgcttcagtttgcgtatcgggactggatagtacatcatatggcacatagacctatttagctcatccattaaaatttcttgataaaccccattgcagaattttattttattttaagggggatagagtgccatgaccttacaaacccagagacaaaacatgtaaccattgcaagcccccacaagcctaaatggaaatatcatactaggaacaagtcgtaagcaaactatgtaatttaagttgagatggctcagggtgcaaattttgtgcccctttacggtcggatgcaatatttgtacatcgcaacaactcacaaacatggtttgggaacttgacttttaagttttgaaaacttctctaagatgatccactagataaggagaattgttctatggcatgtatgcaatacaaaatatcttcataagcattgtatcattttatacatgcatcgcatcatttcatacatgcatcgcatcatttcattcatcatgatatcatagcatacatccttgcctttttgagaaaaagaaaagttattgctatacatgccatctagcatcccgttttctacaacgacccaagtttatggatgcacataatgagaccatcccgatgcatccaatatgactcgacaaatattcctagaacaccttggattagattgcatatgactaattagcacctgcagaacaaatattgccaactttatccttattttcccaactgccttacttgctatcctagaacttaaatttatcgaatgtgagattaacaaggttagatcatgaccgtagaccatgaagacttgaatcttgttacatcctaatggttagagatactaaatctggtattcttgaaaagttttatagacatttaaaatcaataatattgtattgttattagaaaacaacatatccatgacaccttagatcgtattccaccaaccaaacaaggataggttgtcataccaccctcaccaaag

SEQ ID NO: 67446 - DNA, 730 bp, Oryza sativa
tgtgctttcagtggtaggcgacatacccgtcgacggtgagcgcctgtggtgacttcgtcaatctcaaggatttgccggcttagtcttcaaagatgcttatagaggtagggtttacgtgcgtatgttcataggggtaagtgtgcgtgcgttgtgagtgtctgcgttgtaccatatgattaaaaaaaaggtgtgtcatatattaagagcctgattagttgcccatattccctgataaaccaaaacggcttattagagattaaaaaatcatttatatgtaaaacttttatatatattttttcgtagcgacttaaaaatcaataataaaaaaattacgtagaaaatatcttaaaatcaataccaaatttaaattttttgctttgacttatttggcgaaacgatgggatctctaatccccacccatccgaactcgatgaggcttctttaataatgccccaggtcataggagctgcttccctccgagctctatataaaccacataaacctcttccaaatcaccccaattcccaaagcaaccgacacacacacacacaagctacaaacatggctgcttcttcttggtgggttgtagcggcgtgcgtggtgttggcggcggcggcggcggccgacccgagggacgggttcacggcggtgagcctgggcgatggcaacttccagctgcagtggccgtacgacgtggagagcagctcgaggtacagcttcgacggcacgg

SEQ ID NO: 67447 - DNA, 9112 bp, Oryza sativa
ttttcccgtatgtgtcaccttgattttgcgctcagtagtaaggccgcaatagtagattagtagttcatatgatgtgcttgaagtcatggttcaatctacagctgttactccctctgggctgataatacttgtcgttttggataagggtgaggtcaaactttagaatctttgattatgaattatttttaaaatatttgtctttcaaatatggtgactacatgtataaattagtcttaaaaagtactttaataatatcatatatttgttaacacttttatacatattataatagaaaataatggtcaaaattgttttttggagaccgtgcccttgtccaaaacgacaagtattatcaacccggagggagtagttctcaacttttttcaaagattatgttgatttagatcttactcgttttattaaatgtgacctagctacccaaatgatcgcaagagcttttttacaatataagatttagttaatttttacttctttacgcttacaaaatcatgaaacttttatttacttgacatatttgagtagattttacaaatggtggagtaaaacaatctaaaaaaagagtagcattcctatgccaaacaacattaccattagcggctaaattgttgtactataacctcttggactacgatttcagatgcaccattctttcctttttgtatacaatttttatctgacaaatatactgtttacttctaatttttgtttcagctcaattatgcaccaagaatacacactgcaatttctgggcctgcagttaattcaaggtttatggatgaccgctttcatgcatgcaaggaggatgctaaattttcctgggtcagggcacttgattttacacccaattattcttttgggaggtgctctactcttgtccttaaactgggtaaaagtgcattggtgtctgatattctcaaaagtttacctttctcaggaaatttaggggaattgactatgaattcaatggatggtgttggtgcctcctccaatgtggttccccttgttcattgtccgagggactattcagtgccttatgaagttctgtttcgtctgaactctctcatgcatatggggaagatagtcgccaagcatgttaatgccgatctgtttaaagcccttcaagaactaccggttgatgtctcaaggagaatttttgagaaaatgcacaaattagagtctacctgctacgggcctttacaatttatccaacaggaggcttatagcatgaagagaagccataatgttttgctctccaatgaaggtgaaggtgaaggtgaaagaaaattgatgaagtgttatagagttaacataactccctccaaaatattctgctttggacctgaagaagaggttacaaattatgtggttaagcatcattctgcatatgcttctgactttgtgagagttacttttgttgatgaagattggagtaagctttcttctaatgcaatctcagctagaattgaacaaggtttcttttctaagcctttcaaaactggtctatattatcggattctctccattctaaaaaaaggattttccattggtccaaagaactttgaatttttggccttctcagcaagtcaacttcggggaaattctgtttggatgtttgcttctaatgcttccttgaatgctggaggtataagaagatggatgggccactttgagaatatccgttcagtttctaaatgtgcagctagaatgggtcagctgttcagctcctccaggcaaacatttgaagtcttacgatgggatgtggaagtgattccagatattgagatcacaactgatggctccaaatacatattttctgatggtattgggaagatatctttgagatttgccaagcgagttgcacaccacgttggattagatcctactaaccttccttcagcttttcaaataaggtatggtggctacaaaggagtcattgccattgatcctatgtcctctattgatctttctctgcgtcctagtatgaagaaatttgagtctgagagcaggatgttgaacattacaagttggagcaagtctcagccatgctatgtgaatcgtgaaattatttctcttctctcaacattgggtataagggatgaaatttttgttgcaatgcaacaagatgagatgcgtgaaacagaagaaatgctaaccaacaaagaagttgctttgtcagtcctagggaaacttggtggttctgaaacaaagacagcagtgaagatgttgctgcaaggttatgagcctagttcagagccttacctgtcaatgattcttaaggcccatcaggagaataggcttactgacattagaactagatgtaaaatacatgttccaaaaggccgtgttcttattggttgtttggatgaaacaggtgtattagaatatggtcaggtttacattcgaattacaaagaacagcaaagaacaaaaggacagtaatcaatcatatttttataatgatgacgggaaaacagccacagttgttggaaaagttgcaatcacaaaaaatccgtgtctccatcctggtgatatccgagtacttgaagccatctatgaccctgatttggtgggcatggttgattgtcttgtcttccctcaaagaggagaaaggtttgtgatactgaaactgaatttatctcttaccttaatgttttttaaagtttgtattgctttgcccatggcttcaatggaaggaaaggagtccatcacttctctattgaattgaatcaccacgttgtccagcattatcttccttgctaggttccttttttattgtcaaccttatgaatgaatgctgccaatgatttgcttgtatttgatgttgatcaggcctcatccaaacgaatgctcggggggagatttggacggcgacctctattttattacttgggatgacaaacttattccagagaaagttgatacacctatggactacacagcaacaaggccgcgcataatggatcatgttgttacactcgaggtaatgcctgactaattgttccttttcccctttttgctaggctgttgtttctcatttactgaaggatttctttttgttctttactaattcaatcttgatagttgcaaaatgtcaccaattatggactgtagcattatagtcatatatatgggcctgaggcaccttttaaaaatgtatgcttgcggttaagggcatgaataaatgcattaggacaatatgtgcatatgttccatgaaacatgtgatgctaataaggttatgcaaaccagaaagtacaagcttggagtgagtttctaactcaactagtcaactcactcaggatggtttaacaattaacagaaaaactggtggtcattgatctaaaagtaatatatctacgtgaacaccaatcattgaaaagttttgaataatttcaaacaagtatgcactgaccatacacatttaacaatagtatttagaaattttgagagctttattcagaaaagaaaacagcatccccaaaaaaaagaaaaggaaacagcaaatacttgcttctgtgaaaaaagaaaggcctctggaacataaatggcaaatcttattgagtttatgagtatagacttttcaaagttgcctcatgggtgaacaaatgcatatctcctctcaaccatggtgttatactcacctgagtgaaatgttttttaaaaaaatgtctgtaactgcaggaaattcagaagcactttgttgattacatgataaatgactcgcttggtgccatctcaactgcccacttgattcacgcggaccgttcgccactgaaagctcggagtcccgagtgcctccagctggcaactctgcattccatggcagttgacttcgccaagacgggagctccagctgaaatgccgcgaacattgaggccgagggagtaccccgacttcatggaacggtgggagaagccgatgtacatctccaatggtgttcttggcaagctctaccgatcagcgatgggtcacatggagaaatcaggagattcaggagctctctcatcatcctcagcacaaccaagccccacatacgatcctgacctcgaggtccctggctctgacgaattcctgcaagctgcagaggagtactacgagctgtacgaggagaaactgaccacgctgatgaactactaccgtgcggagctcgaggacgagatcctgacgggcaacatccggaacaagatgctgtacctgaagagggacaacaagaggtacttcgagatgaaggaccggatcgtcgccgccgtcgacgccctgcacagggaggcgaggggctggctgctgagctccaggaaggaagaggacgcgtcgcggatggcgtcggcgtggtaccgcgtgacgtaccacccagaccgccgccgcgggaagcggttctggagcttcccgtggatcgcctgcgacaacctgctggcgatcaaggcgtcgagccagctcaggcggcggcggcagaaggacgatgactccaccgcggtggtgcagatggactgcagcgcctgatgtggcagaggattctctgactttgagtgactgacatgtgggcctgctggataagggatccatgggtcagtgacaagttagagggaaataaattagaggttctctgacgcgccgtcctaagtgaactttcaactgcacagttcattgctgtgcgcctgtgcctgtacgctgtacaaatctggttcgactaatcttagctgagctgaacagcagagctccggctcgcaacttggaagaggaaagagtttgatgatgaacacctacgtagagtaaaagttcctcttcctaataaaagagtcttagtgctgatctaccggtaaggtggaggcttccatttcttgttttctgcgaaggaaagaaacttagggtgtgtttagttcacacaaaaattgaaagtttaattgaaagtgaacgatgtaacgaaaaagttggaagttcatgtgtgtaggaaagttttaatgtgatgaaaaggttactccctccgtcccataacataagggattttgagtttttgtttgcactctttgatccctcgtcttattcaaaaaaatttaaaattattatttattttttttgtgacttgctttattatccaaagtactttaaacacaagttttcgttttttatatttgcacaaaatttttgaataagacgagtgtcaaacgttacaagaaaaacttaaaatcccttatattatgaaacggatggagtagtttgaagaaaaagttggaaattaaaccagaccttacagggcaatcagtagtacaaccagcatatagtggaacctggaactttgcactccagatttccaatatgaaatgcagaaatgcaccgagcaggtagcagcgtttagctcagcctctaggtaattggacacccacgggtgacgatccccactgttcgttttgtttaggcaggtggtctgcttacttgcttacatatctttttctcgaaagagcgctgcttgactagctgactgttcttacaagtgacatcagtcgagcgagcttttgagcggatttcatatatcgaaatccttccaaactttcgaatgacttcgaaggtttgtcgtgattatcgacgctgcgaatcagtaaaatttggtagaatttgatactaatactcggagtatcgaaccagattggttttgtactagtcgaaaccgaaaccacctgcacctttggcggtaaaaccgcacgagaaaagcaagcgacgccgaggaggagcaaacaaacggcaacctacctaccatatacgagtcggacacggagcgagcaagtcgccggagttcttggtccaactccccataagagcagccggccggaagttggaccacacgctccactccaatccaactcgtcgtcgtacgtctccctcctctcgcaccgaaccaaatccccatcgcgccgcggcggtggcgaggcgtgcgtacgtacgtgatgccgggaccgggggcgcacctgctgtacgcgctgtcgggcggggcggcgctgtcgcggctggccggggcggcgcggttcgggccgcaccactgcgccgtctacgccgccaacgccttcctcggcccggacctcggctccttcgccgagtggctcgcctcgttcctcccctcctcgtcctcggccgccgccgccgtgggggacctcgccatgggcgtcgtccaccacccgttctactacccgctcctcctcggcttcccgctcgcctgcctctacgcctggctctcccggcggctgctcctcgccggcgtcctcgacgagccctctcgggtgggggcaccgcctcttctcctaatcccctcctggatttgctttcctattaattaaaccatttttttaatcgcttcggtcgccaaattgatatctagtattaattaaaccatttttttaatcgcttcggtcgccaaattgatatctagtattaattaaagagcaatgctacacgtattaaatttttcttactaaacttttactaacaatcatctcaaccgtttgatttaagtaaatggaagttacctagatgcactcatagcatgacacatcagtgttggtaagaatttagtaagaaaaagttagtacgtatagccttttccttaattaaaccatttttttaatcgcttcggtcgccaaattgatatctagaagcagccttgggattgtttgttcgaattaactaaagctggaacatccgctacctatgccagtagtacataccttctgttgtctcatttggatcaattaaacaattagcacggcagcattgctcagtagaatcccaacctgcaatttttgcaaatggaaggaacatatctgctacctgtgccagtagtacattccttatgttgtctcatttggattaattaaacaattagcacggcaacattgctcagtactagaataccaacctgcaattgcaaatggaaggacacagatataagcagcacattgtagatctagctctagtgtccaggcgcctctgctgattatttgggttattcttccatgtttgaatttgtactgatatcgacgttgatgcaggtggcactaagcaggagacaatgcttctaccttatcacggcaggctcgctctcccatttctttttggatcacttgtttgaggtgagaatgtgctccaatgtctctgtgccccatttagtagcactttatccatccaaaaaggcgtcgcatgcttattaggctaatttttttcgtcgtgttttcctctgcaggagaatgggcactctacgatgtatacttggattctgagcactggttggtgggtaggccgtgctcctatcaattcggatgcagtggttattgtaggccttctttgtatttgcctcgtgctggggtttgtgtacattaacaggtgtgaactctgcttcatagatgcactatgtgtttttacattattattaataaacatccctggcctcggcatcatggatgcacacagccaacaagtaggctatgtacatagctgtaaaggagatctagacacttgactagaaaacttggatccttgctgatgctttagaaattaaaagtttcttactagtaccagaattttgaatatcactctttctaccaactagtaagtatactgatcatgttgctaacaacatcttgttctatgttttggcagagtgaagcatgaaaaatcagccactcaaaaatcaaaccaatctttcttcctcatcgtggtgatagctatcttgtactgtatgtggtgtgccactcagatatacctgcgaaatccacctcaaccagccataggtgaagaggctgatcttggagtgataatatttgttgccatttacctttttctcccccatggcttgtgtgccctgtcaatgaaccagaatgattatgctgaactggaagggatccaacttcgataatgtgccatatggtggtgtacttttatcctaatctacaaagaacatcattttttgaagtctgctcgctcctccatgttgtaatcatatttattttctaataataattggctaattgccagggatttatgttttctctagtgcaaaaatacttctagcgaagacttaggagttaggattatggagttcaggatgatactggcactgtattatcagttgtgatagcaataaacttctattggcagtggtgttcaaaacatcccagcaagttctgttttccactttagaatatacatttcaaagttatgatatgatttgaaaaagcttaccctggacattatctttcctaatatgaggcatgatttcttcttattaggtcatactatttgcttagctgcaattattgtggtaaactgtgaatctagatttactgtctctagatctaacatatattaattctttctttttttaatgcaaaatctatttactcttgcatagatgaaaagtatatcagttaattagtatatttcctggtgtgtatctcaaacacagctgaattatgctcacataaatgcacgcaaatgtttaaacatgttagtggaaacactaagttgcagcctgaactcctgaaggattgcacagggtactatgaatgggactcgatgatgctaatgctgttatgcttatcgtcatctctcatggagatctttagggccttctcaagatgtgacacaacttgctccatggacggacgctgcttcttgtgtccagtgcatgaaagggcaagcttcaaactgagatcaaatgcctctgtcgagtactctccgttcagcctaggatcagcaaactccaacacgttgccttctctgatgagcatggaagcctgaggaacgaaggtatggatatcagattcagcacaaccgatcatttaagacgaatacttaatatccggctgactgtttataatcttaccattcgatccaatgacattggtttagcagtgttcatgatattgattgctcgttttcctgacaggagttgtaggagcaccataccaaagctgtagacatcccctgcagcatttaccttgtgattgtggcgatactctggatcgacgtatccaaatgttcctctaacttcggagcttacgtgtgatactcctatgtcaatgactcttgacagtccaaaatccgaca

SEQ ID NO: 67448 - DNA, 942 bp, Oryza sativa
tctgaacgaggaagctcttcctgaaaggctttttcctccacgcttagattttcattcagattctgttgctaccagggtttacatttccgacaggatttcgcgaaattttgatgtttcgatgaggctcgaaagtataaaccgtttaagatttcgagaagtttcatccaaattcaaatttgaattcataaaaaaaaataaaatcaaataaaatcttataaatactatgatattcatataacttattgagatataaattttcgaaaaacattatgtattatgtgtatttactgaaacttacatcagaaaagaaaagaataaagaattaaaaaaaggaaaacaaattactgatcgaaatttcgatgatttcgatcggaatttcgccaaaactgatcggttttcgaaaatttgtcggtaaacttagggaatttgtattcaaattttggtttatgaaatttgttcagaatttaccggttttccaccggatttcgcgaaattccgaattccaccagtgcccgaaacggaaaagcctgtcggaattgtaaaccctggttgctacaaaccaagtttcccaaacagggcgtagaaaggaagcaatatcatgatacgcttgaagaatactagctatcaaatttcaaccgtttcacttcacaggcaaaatccgtaagctgaatattagctgaaccaataccatgatactatcttcatctatgaattatctcatctcatcttcaaagtgacacagcagttcaaacatagaccctagaaaatggagcctttgccatctctctgcctgctagtgagactattgactgctaatttgtaagctgaatattgttagcagccgggttgatgatgattgaccaacctgcacaatttttcaacacacctgtatcatccttctcaattgacagctgactgaggccactcttttattaggcttag

SEQ ID NO: 67449 - DNA, 605 bp, Oryza sativa
ggctgccattggaccaggcatgctcgagctctccgtcccgccctcgaacgacgagtggtggtgagtgcacctgacactggccgcactggcgggatcctcccgcagcgacgagactcgactggcatacgccacaatggcccaatcagagcatcttgagtggtgtgagcgggcaccctgaacgatttgtaccatgctctgatatgcagcgacaagtgaggaagaacaacaagcaaacatccaacaccaattaactggccatccattaccagggagaaaatgtataaggaggaagaaatcacaccagacatgcagattcggcactgagatagaaagagcatcgattcaataccaaatcaggggggcaaaacaatggagccgctgatatcggagcaaaaatcgcacggaatggcgcggccaacgacgaagaggaaatgcgagtgcatccagaaaatgccacgccgtccccttccctctttaccacggatgaaccgcccaagctgccacagacacactcaaagacacgtgccttcacatgcaccaataaacgcagccgtacacatgaaacgcgaccaccgtttctgaacagcgcgaacaaactaaatttg

SEQ ID NO: 67450 - DNA, 687 bp, Oryza sativa
ttttgtttgcaaagtatctttctgcccctgcttggctcatcttcatttatgcttcacagatggcaaatcaggtgctatagcagggcgaggtcacagctttgcagttgccctccaattcatcagctgacgttgatccattcacaccacaccacacaatactccagcagccgaagcagcactgacgattctagtacaacggagtttaagcaatctcatggaagtggaatgtggttatgccttctgactgtcagccctggtgctaatccgcagtatgctgcccccttcttgtacagcttcatttgacttaggaagatcgtagcacggttactgtatttacttagggacttaggtacgattgacgcccaaggcgtgtagccaagccgtacatctccttgtggagacagccgaacggactgtaccgtggttttttttccgtacactcgtagttgtagcctgtagcaaagctgcagtttagtactagtactagtagtcgtcttggtgtttatttgatgtttaaatagcgtatgcatatatatacctgacgctgtactttattgaatgcgggattgacttgagcggttaaaagccggaccgtggtctcgccggaacagcgggacgggctctcccattgacccagcgtcggttacggatgacgcgacgtgacagctcgtgcgctctgcgcaaatt

SEQ ID NO: 67451 - DNA, 17074 bp, Oryza sativa
tctcgcgcctcattggcccatggagctccactttgaacaccattgatcgtgtcgctagcaccataagacgggccaatgagagggaagagaaatatctcggtgaagaagagaggaaggagttgatcaagcatttgctcattaccgtggatcgctatgctatcgaggggttgaagacgatgctcgaagacggactctgcaaggtccttagcttaggcaacgtcaaggagatgtttgccctaactgatcagcatgattgcagcatattgaaggatgtgtgttttgaatttatcacctcctcatcggtccatggattgggcgatgtggctttgagtgaagggtatgagagcctacgagaatcttgtcttgctgccatagtagatgccttacagcgagtacaatagcaggctatatgggcagtcctaatcctccacctaggatggtgtctatagcattaactacattgctatgtaggacttttagcttatgtggcactatattaattgagagagagagagtgaagagaggaagaaactgggtcttatgcaagacacagcttcaacacgagaacctatgcattagacactatcaagttttgcattgggagagaataatgtcttcctaatagatgaagaataaatatgattggtagagaagagagatgatgtatttattaatggcccactttaagaaaccatgggttgtagagtagagtgtagtttctattgtgatgtcttattgacatggcaccatagacactgcttatgggcactatgggttgggactgctctaagtcagctctaagcacacatggaggagagaagagaaaagagagaagaaaagcgggctacagatttgtagccagctgcagcacgaactccaatacattttgtgtgtatgagaggtgggactatatattagtgatgtagtatatacttataggtaactattatatgaatgagctattagattggctatagatgaattggagcctattaaacttgccaccatacgtaagagacaatctgtacacaaactctagaggaaaatgatagtattaaattaaggggggttgtgatgatatggattaaattagagttagcaaccactggcctctattttatataaaacttgctcttttagagtacttcatatttctatttgagaacggtagtatcagctcaagaatcaagacagtctgtgttccttccacaaggttcccaacctcactcctccattttccgcgcgcacgcttttcaaacagcttaatgatatgttttttgcaaaaagtttctatacgaaagttgctttaaaaaatcaaattaatctattttttttaaaaaaatctaatacttaattaatcatgtactaatggaccgctccatttttcatgcggtggagttgagttcccaaccccaaggatcaaacacacagtcgtgcctatatttctgaagagcgacttcaactgaataagttgagaggaaaggtattgggataatgtgctgggggtagggatgaaaacggagcggatacaaacggataatgctcataccatattcgttttcatattttttgccggatacggaaacgaatacggatagctcgaatacggaaacaaatacggactatcttgaatacgaataagaatagaatatgatcggacacgaatacggaaacaaatttttctcggaacatgaaaacaaattcaacttctaatagaaacaaatatcaacatatataattagctcattttatataaaatgtagtataatttataaatatttttaaaattttaaataatattaataatgtggactaatgttaagagatgaactactattaaaatctaaaaaggtatattgaaggtcatagagttataaagaaatgagatatgtcttgtggcttctgcggatatccgaataacactgtttaccggatatccgaattattatccgtatccgacggaaaacctgataccatattcgtattcgtatccgagagaaaatatccgtatccgtatccgtatccgaactatccgagaattatccgatccgaaaggtatccgtattcgtttttatccggagcggacggaaactatctactccgttttcatccctagctgggggaaccgatcctagtataggctcttcttacggcttttctatccagtggatcgacatggctgttgttgtatgtgatacagtaccaagagcgatacatatagggtacagggttcactatattggtttagtgttttctactggggtcaccgaaatcctaaaattttaaaaattttggaatttcggtctgaaatttctgaaattttaaacaaaatttagttgtatttaataaatattatccaaattcatgaaaaaaaattgaaaaattcaaaaatttcggccaaattaatatcgtatcgggggtcaccgaaatgaccgaaatttccgaaatttctaaccctgatagggtattgcctcttctttgagtgcgtttatgagctacagtacccaaagcttgaacaaccaaaaccggtcagcatgtagatatctacctgctactggcatatttttgtttaggtaatggaatttattttagcctttgcttcagaaaaactacaaccctttattatagagtttgcaattcgaacgtgttacatatgtcagttgatgcatatatagcaagaaaactaattgggtcactatcctaaagacatagcatactttctatagttggcgaaaaccctacaggttgcatatacttattagcggatctagaaatatttttgaacccgagcaaacttcaatttactaaagaaattctattttaatttttttaattgtatgaaattttaatggattccccgctgacgagcctgggcggttgctcaggatcaccgggcgatagatccatccatacatatacatgtagtccttgctctaatcaaactaaaaactagatcgactatccaaaatcagtgcccgaccgttctatcaatctaaaactcacatcaccgccggcaccatcgaaccgaagcggaatgtattcatcgaagtataactgcattacaaattaaccgctcgtccaagcgtagtcgctaaatgtagacggtgaccatcaactggttaggttcttgttgtgaaaccaacccaccttccaaacatagtcgcaaaacgtgaggaacaatagatggcgaccattaaccggtcctattggttaggttccttgtagtggaaccaattcacattggttcaagttctagacgtgatacatgtactcacatttatgattatttatttttcagtggtagacgacgtagcgtgctgcgttttttggtcgccgatggctgctgctctcgctattgtgcgatgcgaacttgcgaagctaaatgataggcgatcgaagaaaggcgaggcatcggcgttgggtgtgttgcctatatctgatctctctcgatctctcgttaatgggctgaaaaggcagaccattttttactaatgggcttaccagtgagagagaaattggggctgtcggcccaaatctaataggggtggggggtgtgtttgcccacctcgccccccctagcttcgccactcgaaggtgaaggggacgtggtgtctccatccacgggacgatcgcccctcgccgttattaattctagctgagctcgagctctaacgacctcgatctcggcggcactgggcagattacactagtggagaaaccatctttcatgagttggtcaaaaatcacaatagttctggttgctcaaaaaaccgagactaaataacatttttagtcccggttcataagtccaatggcactttatgatatttaatctggttggtaacactaaccgggactaaatatcgatcaatagctgttaggccatgtccgccccctaaccggaattaaaaatcatatctttagttccggttgatatcaacaatcgggactagatatctttctcccacgtcctacctcgagatgcaaatcccacgtctttatctctctcccacggcacgattgaccctagaaaaatgagagagactgagagacctagccacgtccttatctctcttgtctctttctcttctatcgctcgctctctatccgtcgatcccctcctctctcgccttcaaactaaaatatccttatttgaaaatacaaggaaaaaaaatccaaactaccaaactactaaactcttagactcctaaattactaaactacaactaatgaattccacaggcaaaacctcgagtgtatactagcctagaaaaactcgtcgttgccggtgacctcgctatcttcttgtcttcttgttagtaactgcttcaagtttgactaaatttgtagaaaaaaaataataacattttcaacccaagacaaatttattatgaaaatatattcaattatcgatttaatgaaactaatttggtattataaatattactatatttatctataaacttagtcaaacttgaagtagtttgactataaccaaagtcaaaacttcttataacctaaaacagagggagtagatgatagcgatggacggatgagattatatgagacggcagatgaacggatgagatgtgatgggatgatttgactcgtaggattgctaggggtgaactcctcctttttatattagtatagattgataggatcacaattctcaagttaacaacgctggataaatcacttgcaactcaccggcttgcgacattgaatttaaatatactggccaagagggcatgcgttgcaacggaaaacaaattgagtttatagcttattaactcaatcaatcgcatatttaattcaaatagtacttttatgattttccttattaaataagtaggtgattttaaaatttttgggagagccaacaatgaaaagagaaagaacttattggagggtggcgtaataatgtaatttgtgggacccaaatatgagctgtaggcgtagtgtggtagaacagataccactacctctaacattacatttatttaatgtaacataggttgttgttgactttatttaataagacttttaaaatttttaccatcaataattctcaaatatttagcttgcagaaataaaaataaaaagtagaatttttatagttacttttacaatatacctcttgaaatttttttcattcaattcatacattttccctatgttttatacaactgtatttctatgaaaatattttcttttacaattgcgtgtttcaaaagaaacctttatcattgtgttagattttgttgttatcatcacatttatcaatatcacaaattcaattgcaaactaaaaaaaaaatcacaccagtaatacatagcaaatcccttaaacatatggcgctattgaataattcatgcaaaattttgaaaccttgatcactaataattctcaaatatttagcttaaaaaaacatattgatagattttcataagaacttttgttaggctaccttttcttggtagaaaaaacatatgattcttggaggattttaaatcctttatggaaaatttctaggaaaagctctatggccccatcgtttggcttatttaggaaataagccaaacggcatatttacaaactaaaaataatttataaataacgtgttcttagcgattcaaaagtaaatgctgaaaaataaactttattgaaaaaaatcccaaaattaacatcaaatttaaggttgaaaatttaaattttcattgataagcataagcgtaataaaaaaaatgaggctactaatctcttggattatttttttcaaagtttacctcaatcatgtgcttcctatatttttccaacggtctatgatcttttctccttttgcatttttatgtgttatgcagttacatttctttcaaaatcttgtgtattttttttctcatttatgcttttttttcatccttcatttcaaagtaagtgttcatagggtgagcacgtgcgtttttgtactgattgaatccaacgctaatccccgcgcaaccaactccagcgagcgaggcaaaggaggcatgcggcggcgcgcattggactagcggagagataaagagagaagagaggggcttgggtaagagacggcgatggtggcagccgcagtctcggtgcaaatccagcgacggggtcgagctcaccacccggcggagaaaggtggagctaggggggagtgcgggttacaacctcaaaatccaacaggcgcgctactgcgggagctagaaggaagcgggggttgcaaccttcaaatccgaggaccacatcgcggccggagcttgaggggagggtgggtcccttgcagcctacgggggttgggacgggtgatgttttccaactgatcacctttgtggggcaagggcccaggggagggggtgtcgaaacatgatttggccaataataaacgggggtagcgcagagaccttaaaagtggaaggatgtgaagacaaaggatttagacaggttcaggccctctcaatgagaggtaataccctactcgtgtttagggatttgaatccgccgagtgtgtattgatctgacgatcaggttgtttcatatatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccataccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtaacccccgactatgtggttaatcgaacaaaccaaacatatagtcaaggaataaataatccaaccaaccgagtggtttttgataattatagtcaaccaagtgacttgataccaatatatagcatatgcggtgtgaatccccgaataatatgattcaagtgatataccgactgcttggcaaaatatgatgcgtacaacctaaagttgacaacatctttgaaagttcacatagcaaaacaattataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagccagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctagaccaaaaaatatgccttcgacaccctttaaaggatgacgcatgtaacatgctctcgagtaataaatcttccgggtgatatagaccaggtgtagctcatatgaatagcttctgatctgagtgattatcccttatgagatactccaaaatatatataataattgaatcccgactgacgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaaggaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaaatagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcgacaacggaagacgatgatgtccatcagtagtggtagctgtataaaccagacgttgaggtgagggcactagtcagcagcagacgagacgaccggcggtgaagaagataaggccaatcaatactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgtaggcggaaacaccagtcggcggcggtcgaggcggccggtcggtgaagacgtagacgcccaacaacgacggcataataagtcagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataataagtcagccgtgcaggcggaagcaccagtcggcggcggacaaggcggccggtcggtgaagacgtagacgcccgacaacggcggcataaaggccagccgtgcaggcggaagcaccagtcggcggcggcgaaggcaagccggtcggtgaagacgtagacgcccaacaacgacggcataataggccagccgtgcaggcggaaacaccagtcggcggcggtcgaggcgagccggtggtggtgttctgactgatccattcctggagcgtaagagataagcttaaagccatgaatcccttttatgcacatctggatctggatcctgcggaacaaacatataggatgagtagtatctgatataaatataatactcgagaaaaaatcaagtatttaaaatatttataaatatgtatttctcctcttgtcaattttgatttccccgagcagatgactcattacgtttaaacactctgcccgactagtcatagccaccaagcactgggagtcggcctaggcatttcccaaacatgcatatgagtgacatgagttcgtcattaatggaacaaagtttcacggatcagaatttactacttaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggcaaaataggccagccgtgcaggcgaaaacaccagtcggcgaaggccagccggtcggtaaagacgtggacgcccatgaacggtggtgtgaccaaccgaccgtataggcagggacaccagtcggcggcgacggaggcaggccggcggtgtagatgacgatgcccatcaacggtggtgtgaccaaccgaccgtataggcgagggcaccagtcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccaatcggcggcgacggaggcaggccggcggtgaggacgtaaacgcccaacagcggcggcataataggccagccgtgtaggcggaggccccagtcggcggcgacggaggcaggccggcggtgaagtcgtagacgcccaacagcgggggcataataggccagccgtgtaggcggaggcaccagtcggcggcgacggaggcggccagccgtgtaggcggaggcaccactcggcggcgacggaggcaagccggcggtgaagtcgtagacgcccaacagcggcggcataataggccagccgtgtaggcggaggcaccagtcggcggcgacggaggcaggccggtggtgaagacgtagacgcccaacaacggtggtgtaccaaccaaccatataggcgaagacaccagtcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtagttatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgctcgttgataggaaactcggcgcaacccctacctggcgcgccaactgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatatatgccccctagagggcctcctgcccaccttatataggatggggggcaggattacaagatagaaaccttaaccaatacggtatcggttttctaaatcaggactttaggccgttccgtaatatacaaggaaacgtaacacccaagtcatgatctgttacatattacatagatataagttatcccctataactagtcggataaccatgccgtgtgggtatggggtacccataatctccacagcgggggctgggtcgttccagcccgaaccgtcccattgtcattcctacttgggatctcgagtacaccggttttgtaagttgagaaacgtgttatatctagtattacgggaataacgtaatttgaagtttgcattaagatgagggaccttaagtgaacttattcctcatcgtttggagcgcaggctgggcctggcccacatagaacgagacccgagcctgagtcggattccgactccgactactaggatagggtttgcatcctctataaatcggagcccgccgctgcttcctcttcttcccacaattccccaagcatccgtacgcctcgacgtctccaagcaagggcggcaaggcgaatcgcggcggccggtcaggcggagcagcagcgcatcgagcacatggagaccaaggagggtgcgacgacgaccctgatgcccgcggctaaagctttcgccggggccggaggaggtggagacaacgtcgagaagaagcctcctgtagtgagcaagaaggtgccgatgccgcaggtcttgctcgactacatcctctcatggacgaggatgggaccatggccgagctccgacgaccactcggagttcctcctctcgccggagcatcgcaaccaggacgacgacgatggcttcgccgcgttcgaggccaaggtccgtgcgcagcgcgaggagctgtccgccttcctcgacaagaaggacgatgagttcgccgtgttccaggccaaggtccgtgacgaggtcgacgagaacggctgctacatggtcgatggcacctacttcgccgatctggaagcagcccaggctctctccaatgaactatttgccaagctgaacatgagtggcatcctgttcgaggaggactgactgagatgcatgccatcctgattgacaacagtcaacaggcttcttaactgtcatggtagtagtgggcacgactaattgacaacaggcttaatcgtaattgtttaatcaattatctcttgtttatattaactagaaaaaatacccgtgcattgcgacaaattagtttgatagcgcatgtcgatggtactttcttcctgtgcccattcaatatttattaagcttgcatgtacaaatgttcagtttcatatatcgaatgcaatgtattagggcacattaattatatctttgagcatgattctgttttgccattacctttatctcaagtcgtaagcatggcgcgacgtctcctcccctcccggtgtgcaaccacatctccttctgttaatttttcatatatatatatatatatatatatatatatatatatatatatatatatatatatatatatatatatatatatatattttctactggtttgctgaaatgcaaattagtatttttgttttaggattgttatacttaccctcgcaatatggtagataattggataggcaatatggtagacaagcagttttgtgcaacttatccttattgattgtggttattgttccaaatctgcagtgatgtaagaggaaacaatctcacagggaccattacagtgagcatatatagggagctgcactagctttgagattttgtatgttcgatcttgctaatatttcagtgatatttcattgttcatgagtttcagacaccatgacgcgaacttcttatatgcattgtagggacatttcatataaccaaaagtccaaaactctggagaaataccttacaaaagtctttcttcgagtagccacactataagaattccttagttattgcaaatcttctagcttgttatgtgatttttcgttcgtatcttctcaatgttatagatgcttacttacagcctctatgttgtgcgctttctattcgtgttacataggtcacttcaagaaatagaatgaccggaaaaattccagatgtgattggccttatgcgggttcttgctgttctatgagtagaccacaacattttaatccataggttcagtagtttctgtatgattagataatgaattcttatattcaaattttgattctcagagacctgagtgagaacgagctggtaggttctactccctccttccctaaatatctgatgccgttgacttttttaaacatgtttgaccgttcgtcttattcaaaaacttttgtaaaatgtgtaaaactatatgtatacttaaaagtatatttaacaataaatcaaataatagaaaaagaattaataattacttaaaattttttgaataaaacgaacggtcaaacatttttaaaaaagtcaccgacgtcaaatattttgagatggagggagtatttcttcaatactgggcgatctatcctagattgccaaaactgttagtatcatcggatagacttgctttttccctgagattgttttcttatcttgagcaaacttactggagtcataccgccggagcttggaacatgagtaaatttaaaattatgctgttaccatttgtgagcaaaatgagccgcaacatgttctgttaatttattatacaaccattttgctgcgccgtacaccccaatataccttcgttatatgattcttacttctagtaacaacaatctccatcgaaacaaccattgcccatatttacactacacatcaccaaattcagcaggtgttatgagccccggcgtaagatcgaataggatatggtaatttagcgacgagcagaggatgagaaacagagaaaggagatctgaactgacttaattgatttctcccaaagttggcctctaaataggcttacaaatcttaactgaaatgtctaacaaattatgagtgaaaagaggaaataacaaatctaatccaaactgaatatatccccggactgtagctgtccggcaaaacgacttgcgccggcttccgcgctccgctgtccacgccggctttcgtagacgataccgaccatgacagctagggatggcaattgtgcccgtttgcccgtttacccgcgggtaaaaaccctattagggttgggtttgttctccattttatacccatgggtatcttattggttcaaaaactatgcccgatgggtaaatgggcatgggtatgggtaatcactacccatgcccgctttacccgtttacccgcgaaatctaacttacatgtaggctaggagtaaaatccactagaatacataagccacgttctttgttttctacggtttcccttttatttcccttattatttctctcctcttactctatcgccgccagaggagagacacgacaccgaggcggagaatatttgatgttttaagttcgattcgaagttagtagcttgtagactttttgttccactgcttttgttgtggcgggtaaacgggcacgcccgtgggcataaggcgcccgcgggcaatgggcatgggcaaccatccttacccgtcatgtagtaatgggtatacccacgggcacaaataatctcacgggcatgggtatgggtaggcactacccgtgcccgtcacgcccgattgccatccctaatgacagcatgcaaaaaatatcagacacccaaatgatgaagaactcccttcttccttcctttttggcaaagacaagaggcacaatttgctgttcttcacatagaagggtaatgtatcaaccctgattgattgcatacacacacggtgtgctgaaacttcttcaatgtgccatcacacctgatatatatattcagataaaatcatgatgatggtgactacggtggctttatttcatcattgccttgccgatggcctttacccatagcttcttcctccaagtgctctttcagaccttctttgtaggactcgacatagttcttcagtgcatctgtgtagtttgaggcgcgagccatgtacatccgttgtaacgcattcttggctttctctgctccgccctttaatgcgccgacaaggtcttcaaccgtagtaggctcgcttcttccctcctcggtgttgatgtcaggttactctttggccttcttgtagttgtagtcatttggtctgatatcagggccaatgtctctgacccaagaagccccatacagcctggttgcctccttcagaatgcaccacttgtctttccaggagagctttggccgcttcatgcccatcggtactgcagtgttctctcctttgtgtggtccgacaatagattaacctgcaccacaatgaaatgttgtcaagcattaaattttttttagctcccgggctgca

SEQ ID NO: 67452 - DNA, 1162 bp, Oryza sativa
gaaatactacccaatcaagaaatggaaccctagaacatgtgagtatgggtacagccgtacaggaccactattacccataagtaaaactggtaaccaactggttactacccttgttatcaagcccgtacatctagtcacgactagtcatcagctagtcggccagggagcatgactcgatttgttggcggcagcagacacaataaaacaaagaaaacaacaatgaaccacctcggaggtctggtccatcaggcattattactgggtgaaagggagatggaggagagctccaccaggtccatcaagcacagcatgacgcagcagactagcagtaaaagcaactgctatgtaataatagtctgatagactagtcaactcaatgagtagtcttcaactagttgcgactagtcgccaagtcactagatggtaactcaagtagactttacaacttaaaaactatggtcactgctgcaatcttaaaccctaaatgggaccatgacacacaaatgggataacatacaatttcctaaatactcaaaacttctattaccaactagtatcatgtagtaaccaaaccttctatttacccacttgcttccttgtctcttttcgccttctattttttgtacttgtattcttcacagtattgattaaggatgattgaagagattacacattacaggcaaactaaattcaacaggtacatagtagttaatgttttgcaatattctaaacataagtagctaaaggttggcacataagtagtaattttagtcaagaaacttgagtaatacagaaacaagtaatatgttcttatattaccaaactgcaactttattacatatggggggctctgcttaattaaccagcatgtggaagtagtgcagaataacttcatttgagaaattccagataaaaaagaggaatggccctaattagatttaaaattatatcctagaacaatacttcctccgccccagaatgtaaccatttttggggtaggcacgggtattaagaaaatactgtagaaatgattgaagtagtattgtcattggtgaagaagagaaagtaggtgaagagaatagttgtgattgattgagatgaaagggtaggtggagaaatagcttcattttgggacaagttactgtgttagaaatagctacat

SEQ ID NO: 67453 - DNA, 673 bp, Oryza sativa
tgcttcaagtaagccgatgccacacgccgccgggtagtccaccttcatccattgtcgtccagtcagaactagccgaccagacgcgagctgaaaggatatgcttcgtcgaattcctaagcctctgctgcccatagggccgctgccaacattgtaatcctcctccgcctctcggacttctagcccgccgccacctctatcgggacctggccgagtttctctaggtctacacgaccgggatcgaggcgccgggggtgacgacagggtcatggcgaacttcttccccatggccctgaagggacaggcgcggggttggctaatgaacttgccgcccgtgtcggtccactcttgggaggatttgtgccagcagttcaccatgaacttccaaggcacatatccgcgcccagatgaagaagcggacttgcatgcggtacagcgaagggacgatgagtctcttcgctcgtacattcagcggttctgtcaggtcccaacaccataccatgcatccccgcacacgcggtgatctacacgttcaggggggggcgtgcggcacaaccgcatgctcgaaaagatcgcctccaaggagccccagaccactgcggagctttttcagctcgcggaccgtgtggctcgcaaggaggaggcctggacctggaactccaccggttccggtgtg

SEQ ID NO: 67454 - DNA, 2119 bp, Oryza sativa
gtcgtcgacccgaaggttcccgccgcttcctcctcgtcgccgtcgccgtctgttggtcttccgccgccgtttaggtcaccggtgagttcgccgtgttgtcctctacgtcttggtgccctccgtttgcgtcctcgcgccgccgttcgccggcgagcgtgcgccgttcgagccgtcttctccgccgagccgccgccgctgtcgctgacgtcgtcgctgatgtcatcggggtcgtccgccgtgagccgccgtggacccgatcgatctcggccgtccgttttggatggatcgatctcggccgtccgttcgcgtgaaccgccgcccgtgcgcccggtccacccaaaccctagccgctgacgcaataaatccccttttccttttcaaaaataattcattattgcgtcgtaattcaatttaaaccgatttaagtgttttaatccggtttaatctttaaaaattcataactaattcatcttagctccgatttagtcggttcaagtctctaattttttctaaaattgagatctacacattaaaaatatccacatgtactgttcatgcttgtttatgtgctgttttggtgattttgctcttttctgcttagattctgtcgtttccggagagtccgttttcgcagaagaagagtttgaagaattccaaggccagcaaggcaagtcacacagatcccaaacaaccctttgagcatgttgatcctatttaaagctattgtttcttttcaactattgcatttattttcgatgtcattgggtggaattaacctattgtttgttatagcccttttgttcttgattaccttattccttgataccatgggttattataatttgactagttgagctttatttatattggttcaactagatattagatataattgcttagccctgcttagaaacattagtacacattcgggataactaatgactcactattatttaatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtgtacacctctggccaaagtaaaactattcgaatagccgtgcccgcggttatgggcgggtctaacaatgtctttcgtgattagtctcacacctctcatcattgtaagagatgcttaaactggtaataatttgtttagctcctggtttggaatggtacattcctggtttggagatagaactgtgcagcggggtggttgttcagaatggttgggcctatacaacagggcatgttgtatagcgttggattaatattgtttaattacttaactgttttatcaaattctcaaaggtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaccgaccttaacaaggcatgtcctaagga

SEQ ID NO: 67455 - DNA, 680 bp, Oryza sativa
tgcaataaatcatggttggtcatccatggcaaagagccaaacatgaacaactcttctgcttatacagtggatttgatttgatttgattcactcagatgttgccatttcgtcctgttcattttccttttatatatcacatgtgttctcttctttgggcccatcatatcaggtcggtccatctgcacccgtgtgtgcgacgagcccaccaggccacaacggttgggccactagcctggatctggagccgtggcaaaatcagatcgatttcgctgcgctggacatgtccttaaataaaccgaatccaattaattgaacgaacagaaatggccaagataactgtgcacgacattgatgaaatgaaacaagcatggccttgaaacgacattgatgaaacaagcatggaaaccatctattgatggacccaaaaaaaatttaaaaaaagtatggagatcgcttaagcgcatgtgtcatgcgctcgcaccgtcactcgccggtggatttttgaattcctgaatgatttcggctacacgtgcattccacacgtggtcccaccacagcacgagtagtcgtctcgtgtgtatccgggtgtgcctgcattgggcacgcctcccattcggtcaacccctcttatcacccgtagcgcacgcgccaagctccccggtatgggactaaacaacaac

SEQ ID NO: 67456 - DNA, 9971 bp, Oryza sativa
ctgcaccccatacttatgtccttgaccaacatcgtatctcccataaatacgaatctctacattatcctcggtccattcaagaactttcacttaggaccttagttcatctagagtcgggcgggtggaaaacaaaatggtcttcaatgacatatcctcaaactcaacatgtgcaccaacataaggttccaccactctaccaccatagcaaacacgaacaagtctatccatctacacaaaaaaataaaacatgactttacaacaaaaattacatcatccttgctaaacgtagtccaaaccgataaattataacaaaatcataatttaaattgtcccaaagctactacttcacaaaaaatatttaatccacatccaaaggtaccaactagattactagtgtattaaacatctaagtattacaaatactccgtcatacaacatatcctaattctaattaactttaataaatttctataatgctaccaaattcgtctcctccctcatataattcatacctaaaaaaaatctttcatgtctcaagtcaatttttccatccatcaatccaaccaaacaacctaaaaatccaaattaccacatatatagttcaaaaaagagtggcaccaatgagtacattgcacacatgtagcactataatcagcaaatccccaaattgaatgctgaaaatcacaaatttgggcaaaagagggttgtagggttaccctccgatttacaaatttcaccatttaaaacggaaaaaaagaggggggaatggaggagtataccttgctcttcgatttccacaaaaaatcccgtgaaaaaagcctccaatttgagtggctttgaggaggagaggtgaggggggagagagatggagagcgcactgctctggcttgggctgggaagagttgcaaatggctggggggaggagaaaggggtggggcccgcgtgggttaagggcacggcccacccagtgggagcgcgccaggacgactggagcccccctcctgccacgtcagccggctcgcctacagggtgtcaccgcggcacgggcacgacgccagtgtacctggcacgccatgttggagggcagcgccagcctctctagcgcaccaaaaaggaccattcctgaaatatgtttttctagaggtctatttctacaataagttttccataaggagcaaaatataaaaaattcagtccatctcttatccatagctgatatttgcaatgaaatttcacatgtcacctaaattactctgtgttttagtggtgctttctgcatgccaagtaaaagtactcactattgtgctcatgagaaaaggattttatatatatatatatatatatatatatatatatatatatatatatatatatatataggacactcatatggggcaccatggtgcccgggcaccatggtttcaaatgcacaaaattactcaaatttttcaaaatttttaaattgtgagtatatacctagttataagaattcgattcatacatatatctatcaacaaaacaactcaaatttaactttatttcacaattcatgattacatacctaactaattatatgtatagatgctatatacctagaatcaaaatctaacaaaaacaagttcaaattcagtttaaacttgctttgaactagttagtaaagtagttaatgttaatacctaaataattgaaaaagtttcatactcatttgaattggttatatactcaatttcaacaatggtgcccgggccccatggagcaccaaacaaatttactatatatatatatgtatatatatatatatatatatatatatatatatatatatattgcacaggacaaatataacacgaggatataacatttcagcctttaagcatagtactcatgacaagctcgagggtactaaccgtggtacgatgtattgttcgagacctcctgctgggtagatgctcagcaacgtacaccttagatgatagacagctaggtcgattgcagtagaatcgatagtggaccactaaactgtaccaaaagccacatagttcatatttagaaatagattataatgctgacttaaaattaaatacttgctttaataatttcagagatttcccaagatatcgatctaggtacaaagtgctagaacatttcagtggttgcacagcaggagacaaaaaacccctcctcatgcacatttccagctcagcttaacattttaaccaaatccttatgtaggaataaaacaggtaaccattctcacatgactgactttcttgaaacaaatcaacatcctataaagaactatattcatccatgagcataccttatatgcaaacaaaattgatccatgaagacaaccaaattaccaacacattatatatatgccgggcagacatataacaaatactgtagatagggatgaaactatgataagttgtatatcatacactatatgtatataggaataaatatatctataagacagcagcagtagcagcacatgacctttgtatagtactagtataagtgtataactaactgacagtatatatgaggcaagacatgaatgtcaatatagaggcccctcttgcttgtttcccttcttctgtgatctcttctctatctctggtccccatgaatttgacattctactactagtacctactagtaagcttcactactctgtgcctgctctgatccatcttgttgctttgcattgccattgcccctgtttcttgctagctagccatggagacagagagctaatctatagtactacaccctaattaagtacatgttgaattttccgatgcacaatacagcaaatgcaatttggcaatacataggccaaccagtgcagtgtacttatatgtagacaaattgagtaaatcacagggcagacatacatgagccaaaaaaaaaaaaaacaagtcacagtcacagatcttgtataactgggagaattttacctgaacaaggggattttctcggtgcttcctggatctcgataccgagggcagtgctgaagaagaagaagaggcggtacaagaagaggtgcactaaactgcaccataaagccaaatagttcacattcagaaatatattataatgctgacttaaaattaaatacttgattaataatttcaaggatttcccaagatatgaatctatctacagagtgctagaacatttcagtggatgcacagcaggagaccaaaaaaaaaaaaaatcctcacgcgcatttctagctcaacataacatctaaccaaatccttatgtaggagtacaataagttaacatgcttacatgactgactttcttgaaaaaaaaatcaacttcctataaagaattatattcgtccatgagcatagcttatatacaagcgaaattgatccatgaagacaaccaaattaccaacgcattatatgcagggcagacatataacaaatcaatatatagcttgcatataaggtgcactgtacttatttgcagacacacaagatagaagtttcctcatgtgtataactttggctaacacaagtagttagcactaatgcttcagaataattgctgccatgatgcacatattcaaggagtgtagatgaaatctccaaattgtaaaggtctcataattgaggcaataaaatacagctgtccttacaagacagtaaacattgcgaaaactacatgaatatatatgtagacaggtgtaaaaaaaaatcaggttaaatttttgtagcattgtatctctgaatcatgttcacctactccttctatcctaaaaaaaaacaaaaaaaaccaacgaaatttctaggtttgaatattagaatagttggttctatcaggacagagggagtatgtagctacatattcagaacaaaaagcatcctatgtagtgtactgacatgccaactactgcagtggtacttataggcagacatatagtagcttataggcaggattgtaaaaaattaaaataaagtcacactcacagatctggcataaccaggatattttgacctgaacaagggggtgtccttggtggtcttgatgggtgctgaagaaagagaggatgagaagaggagggggaggcggcggaggaggcaggggtgaggagtcggcggcggcgtgcgggcggagttgacggcggcggccggcggaaggagttgatggcggtgcgggtggaatgggttttggcccatgaaattttcctgtgttgacgccgcggcccacgaaaactctcatgccaaaatttttgcgaattccagcaatttgatttattttctggcataaacaatctagagcagatcaaatgactagttaattattattactccctccgttccgtttcgtattataagtaatttaattttttcaaagcttttttagtttgatcaaatttacagaaaaaattagcaacatctacgataccaaattgatttttaaaatttaatattgaatatatttgataatatgtttgttttgtattgtgttagtatatttttctacaaatttagttcaatttaaagaattttgacaagaaaaaagctaaacgacttataatatgaaacgggggagtagtaatcattgcccgtagtgaatttccggcagatataatgacatttgtatccatccctggctcttgttatatttccagcaaataattcaacaacaaatcaatttttttttgttcgcgccaattaattgctaggtatactgagctatggtgtagtgatatcggttgcttacataagttctgtatgtaattattgctagagcatgatgaggtggcatgtttacatattgagctttagaattagtgggttataaatttatactaagataggataggattcttgatgctagaggggtagatatagctgttgtcagacattacacagagagttgtacatcaattaagtcaacctttcacaacaatgaagccatgcatgctattgtttgcggttttatcatagaggagccatgatttttgcaaatgctcatgataccctcttttagctagtagtagacctatttttagtttaatttgcgatactctagttactaattgaaataagaaattagtgcgacatgctggcggtatatggcattatttgtagagaaattttatagtttttaggaagtaccaaagaggtatatttagaaagctccgtacatgaggtatgggaacatactcaattttctggataatgcttctcgtcgaacgtccgaagcaaggagaaaaatcggacaacatcctctgacacacatacacatctccaaccatataacatgcacctttaacgatatttaaaacgaattttctcttaaattatttatctaatgtacaatccgatcataccgttgtattcattataattaaatctttacaacaagatgtcgcatgattatatttcgataaaatataatcatatgtttcaatccattaacactttttgtttcatacgtgatagggacatgtttcaatatgtgtctttagcgtgtttcacaaaattcacaaaataactgttagctagtttcaaaacgatttttctcttaaactaattattcaatctacgatccgatcacaccgttgtattctttgtaattaaattttataacaagatatcacatgattatattttgatgaaagaaaaacatatgtttcaatccattaacattggttgtttcatttgtgatagcgatatgtttcaacgtgtatcttcatcatgtttcataatttttttaaatgtttcagttactgatttttggtttcaccctatataacttgatgtttcactcgttagttaactggaacatttaactgaccgattcttttttgcatgctgcatacgtaggtggtgtaatgacgtgtaaacagttgggcgtccgatatttgatgaaatatcggacgtccgacgcagagtcgtctcccaattttccactgtaaaatatggtgctcccaaatacttgttgttgtcctaattaagatactcgattctacgattctctatagatggaacctacgattttcatgtatacgattttgtaataccgattccaattcaacatcgcgagttaacaaccttgtttttggcacaacagaaaaaaaaagaaataactatataactttcgacaaaaaaaatccctttgaaatctttcgaatgtaactgtagtgtaactatagtacagttacactgtaatactatagtataactcatatgtgacttgtatataactctgtcaagaaactagctagtatgacttggttggctagcaccgagagggccttcaggtgcaaggtcaagggttccagcgttgtatatcattgcgtcactcgcgtcagtcatgggtgcagtgcttgccggtgccggcttaggcttaattagtttggtaccctatgttcccaacacaactccctcgtgttctgtgcgcacgttttttcaaactcctaaacgatacgttttttgcaaaaagtttctagataaaagtttcttaaaaaaaatcatatttatctattttttaaaaaataaactaatattaattaatcacacgctaatacaatgctccgttttctatgcataggatatgtgttcccaacacaggctaccgaacacagccttagagtgagccggcgcatgagcagagcaggcaaccaggatagctgcccattgcaagtttgatttttgaacaccaaagaagctaaggaatacatggccggtcctaaacttgtgtggtggtgtcacttaggtctgtgaatttgaaaattgcacatttagatccgtgaacttggtttaatgtaccaccctggtccaaacgttctttgactgcgttcgactgctaacatggcatgccacatagacaatacttttgctttcaacaccctccatatcataacacatcgcatatatctccttgtagctatacagtgacactagaatccccaaaaaaaatcctcaagtcgttcttccctctcattcttctccttgcatgtatagaaaatacggcccctgttagcaattgccattgctctgcgctccaaaatgactttatccttgcacaacgggcacttgatcaacaacaccttttcccaacgacttcaaaacgaggacgagcttggagaatctatggggatgcctagcatgcaagacgcattacgctgcctcccgccgctaatccggtcgcactatgccaccgctaaccccgttgcattccgttgtatcctgctgctaatctcaccgccgaggacgccacagccgctacctcttagcctccttccgctaatctcaccgtcgaaaccctagccgattttagtgatattgaaatgcactggttagggcaagttatgtgcgaaggtatatatggagggggctgatcacaaaagtgttgcctagtggtatgccactttggcggtcaaacgtggtcaaagaatggttggaccgagctagggtggtacattaaaccaagttcacggatctaaagatgcaatttttaagttcatggacctaagtgacaccaccccacaagtttaagtaccggccatgtatttcactctttattttattttattttattttgtgttctctgtaagctttggcgtgtctgtgtttcgctagtcaaattgcatcaagagtaaccttaaaaccatagtaccacattactttttatcataggcacggctcttgtcaatgcctatttagtgatatagtcacatgatgtaccgaaaacttagtattgtgtttactatcgactctgttgattagccatacctcttttttttccgtcctccgccggccactggttcagcattgcattcagaatgatttcagagtacatctgaaggtgtgtgtgcagtgttctgagaaggaaactgtgcaatgctccgatgatgaaactgactttatgttgagatatggtggatttttttaatgtgggtagcgggattgcccatttacatcctaatgttgtccttgatgaggttatttcttctcggggttttctggacaagatacttttttcaattaatattgagcgattatttcttaatttgaatatataaacagattttgtcatgcactacctttgtgttaattagtggtgtaggagtatccggagggctttcagtatagaacagcagaatctattgtcagttatattgctacagcacatggacgtcttcagaacataagttgaagagttaatgcaaatgacactacagtagaatcgttagtctgcacacatgcatgcgggttaacatcaattcttgaaaagttgtaatgcctatttaacactcttaataatttgaaaaagaaaaggttatcaagaaaaaatatagatctcgtcgagttatacaattttgttatacagaaaatttaatttctccatccaagatattttggaaaattcaaaaattcgttttcaaaatatatttgaaaacttgtaatgcatattcagacatttaaatgatataataaaaaaatgaactataaagttagagatcaggttgagctcacaactttaatatcatatcactatccgagatcatttgaaaaattaaaaagtcgtttttcaaaatagatctaaaaacttgaacacatattcatacatgaaaacaattataaataaaaacattatcaactataaaaagttatagatcttgatgaactctacaattttaataaagtttatcttcatctaactgtcacaccccaatctgataccgccgtacgacggcacctgacaggagcgtgtcgtagggaaaacggcgcgaaccgcttcctacgaaaccgcgatctcggtaccagtcccaggacatagtgctcgtacccacggtgacaaatatgaatcatagcaatccttaaaataaatagaggacttatttaccttaacttaggttgcaactcaaacagcccgagaatacaaccgacgacacggacgaggcgaacaccaacaacaacagcagcagcggaaccaacggtctaacacccaataccacaggcgacggctgggaaccaggacgaaaccctaatcttcacttcacctcatcttcaacttcagggcggaggaacaatatatatttatatagagcaagggtgagtactttcgtactcagcaagtcacgggaatttaggtgtttaatgcaagcttggaagagaggcaaggttgttttgcaaatcctttgtttgaaatcatttttgaaatcactaagtgatttacttcttgttaggtttgggtcgaaaagagacttgcgtctcaaatcgacttaagaggtgcttttctacaactcaataggtaatgtaccgacctcccgggtcagatcattacttctcggcttcctagagccattccacttgattaatcggctcccagagcctttttcattttcagcagcacaacaatccgcttccactcgggaagcctagactatgatgcccatagacatcccgaatcacacagattcgtttcttgaccactcaggtcatccatctgccacataggctgattctggttacgattcccacaccacaacaacttttcacaaagcacaggcaaacaaatctacgcaacgggaaccacctcacatccgcccatgaccgtgggcacggcttttcgaacagttagttaacctctgcagaggggtacactttacccacaagacacgaacttactccagacactggccggtgtcagaggttcgcgacaaagcctttcccaagccgacctagggatacctcatgccacatagaaggatcaaatcctcacataaatataggccattttaggcgttcacaaatcaaactccaaccacctcgatcggtaattcagcaagcttctcgttcttgcattaccaggaacccggtttgtccgaccctgcccgggcgttcccaactattggcatgcaaggtttccttgaatggattagttactaagccagggtgtcccattccaccttgtggttgcactttgatatgttc

SEQ ID NO: 67457 - DNA, 3947 bp, Oryza sativa
ctccccgccggcgtcatccgcctctgtcgccgttttggccgcgagcgctgagcgccagctcgcgccttgaccgcccaaggtcggtttccaaaccgacatcgtcgtcctataaaccaaggcgccctccatcgattcctcctcccgtttcgctcgctgccaccgcgccattgccgcccctctgtctcgcctccgccgttcatcgccaagcaccgggagagccggtgtgttcgtggacgcggaaggggactccgggcgcttgccttcttcctcttccccggcccgaggccggagagatcactcctgtgccgtcggcctctcgtcacagcgccccacctcatctcggtagtgcatctccccgttctccctcctcaatccatctcttccccttagttttcggtagtagcatgtgtagcccccccatagctagccggcgccgccccgactactgccgtcgctcgccgtgtgctcgccgccgtcgccgcccgagctcggaagcgcctctcgtcgcgggcctccctcgatgcgattcctcctaatccggcgcaaggggtagattcccgtagccgcttagatgctcccaccgccgggaatcggcccctcgtgacctcgtcgtcgtttcccccttttctctccgccggttgccgccgccgcaatccgccgccgtcgagcatcccccggcgaatccgagccattggctcgtctcccctcgtcctgcgcaacatcccggtgtgctcgccttcgcctgtatcgccatggtttgctccgccgctcgccgctgtcgaccgccgtccgttccggccggcgtcgtcgtctacctcccgccggcccgcgtggcagccacgtaggcgccacgtcggcgccacctcggccgcgaccaggtcaagtagaccccggtccgccgcttccctccgcccctcgcgcgcgcggtccaccgcgagccgtgaggctgcgcgtgggcccgccgcaccgcgtcctccgcgaaccgcgcgcatgcgccgcgcctccctccccaaaccctagcacgccccgcgtgcacctcgctcacggtgagccgagtcgccgacaagcgggtcccacccgggaccacgagggatggacccggcccaccggctctctctctcccctccccgctcgcgcgcgcgccttgggccgccttcataggccagccagcccattaaggtcggccgagccgccccattctctcgggccgtgccctagccgcccgagggaagtctaatttccctccctccttcttttcttttcttttctttttcaaaaaggatttaaataaatccttttcctttagaccaaaaatccaataatcttagaaattcaatatctccccaaccgtaagtccgtttgactccgttcaacttccaaaattcctcaaatctcgagatctatctaatggcacgcttagaggtcaataataaggctttattttcgccgtttgctgagttgtcccgtttcgcgtgtagtttcggagcccgaagacccgtagtacgaggatttcgaggatcaagctcaagatctcgagcgaggcaagccacctttgaacatcttgagcctatatttgaacttaattatattgcttgaaaaatattatgcattgataggatcgcacttaatctgcttgtcccctctgcaaggcagattggcggacctacctattttgttgcatttgacccttccattgtaattgttacaccatgttcccttgtatccacctagttgcgcctcggtaatcgtgcactctgcacgggtatcgacggtcgccttcaaacttaaaatctgagaaacttcttgggtaaaacttgggttttacaaaagacttggaaaacccgacacctgggtcggtgcttgcgaactaaatgaatttccaaaatcgcggaccgaggaacgtaccgggtgtacggtttcccgctcttgcacttaaggaccgtttccttggaatttcattcgaacataagacaagtacgaccacatgggtggaatgggacacccctggctgagtaactagcttatcgggggagccatgatgccaagagacatgtggattcgccggggtggtgtcggggaggacccctgggcttcctggcacagtatggtctgggacataatctggtgttggtctgggatccctctcgttggcatatggtgaacctgtgtcggctttcgaaatgccttgtcatgaaagccttaaggtctctagtcgtggccgttctgcacgggctggatgatccgggttagtaatgtcgtgtgggaaaagtgtaccccctctgcagaggttattaaaacttttcgaacagccgtgcccacggtcatgggcggatgtgaggtgattcctatcgtagtttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaatcattgcacatactccgaccggacgagacgcactgtctcatccgtgtcgtttgagaagcactcccttagttgtttcagaaaagagtttaaataaaatcaatcgtaaaaacaacagcctttctttgaagcctgcattaaacacttgtttcccatggcttgctgagtactcctgtactcacccttgctctatataaataattccccccagttgctgaagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgctgcccagcatgactgtactcctactctataataaagagacctctgttgttgtgatattccgtcttcctgtgataccagcactgtttcctgggactggtatcggttaacaggttaatttggagcatcacgggctagttccgctcgggactagttcggggcgtgacactaatgctacactgtatcatatgctttccacacacaaatatttactcgcaagtcgtgcgtatttggaatttagatttttcaaaagaaagttcaaaccatttgcatacttgagatacaaaactcaaaacgaaaattgagatcgagttgtagagtttgacatatatatattataaaattcgacaaagatcaatgatcctctgggcttttcacgtgcaggcgcccccggttccggaatttctgccacgccgctttcgactgacaccgtgacacgaacccacaaaagccgtcagcgtcacaaaccccacttttttcaggtgcatcgccgcaaaaaccccaaccgggctgtgacctcgccggagtccccaaacctcccataccgctatgccgacggcggcggcggcggccacggcgtcgctgcgggtatccaacatcccgccatcggccgtcgccgcggagctgctcgccttcttcgactccgccgtcgccgtcgccggcggcgcgttcgcctgcgagatcgcggcggcccaccgcgggtggctcagccggggccacggcaccgtccagttcggctccgccgcggcggccgctgccgccgcgggcctcgcctcctccggccgcctcccccgcttcctcggcgccctcctctccgtctccccttcccccgtcgacctcctcccgcgcgcgtccgacctctccctccgcgcggccggcgcgggcctcgtggtgggcgaccgcgtcgccgagcgcgtgttcgaggccgccgacgcgtgggacggcgtgcgcgccgaggtcatcccggggaagcggcgggtggacctgtacctggagcacgattcccagaggtacaagctcgaggtgctcttcgaggacatgaaggattgcctcgggtgcaccctg

SEQ ID NO: 67458 - DNA, 654 bp, Oryza sativa
cagtgctgataattggcccaatgtgaaagacagatgattcgtaggcagaataagtttatttttcctccctcatgtcttgctctagtcgaatcgcatccctcaagcataaaactaggtataatggtctccctcaatttcaaaaaccggtacaaatcgacttctttctgtgggtttgggaaacgatttatgcttatgtgataggttgacttggtcccctgttctaacaaggtaacccattcattaaagaggttaaaaatagaagtgggatccatatctaagtgataagagtaaaattttttaaaaaatacagtgggacctacttttcagcctactcctctctcgagccccaaacagcggcacctccatgtgttgctctggcgtcgcctctactggaggggtccgtcactgcgccagaggacgcggtcgacgggtagaagtgggcagtgatgggcctgacacatagaaggaacacctccatcgagagcgtgatctcgttgacctctggtgacgcatctggttcctcccagagaggcggggagagagccacagggtatcaccatcgcctgtggcgacgacacccaccgctgtagcacatgtcgccacacgctcgtccttgaaagaggtcccccattgaagtcgggtgcagatacaatg

SEQ ID NO: 67459 - DNA, 1258 bp, Oryza sativa
ggtcattggtagcccgtgagggaaagtactccgccatgcctaggtggacctagaaatagattttaaaccaattcaatgatttggtcacccttccttacatcaccttattagggtgacaactagctaattggagggtggaaaagtgcttcacggagccttgcctgttgtccacccacatgtttcactcatagatggcgatgtgagccatggcgttggctgtcagtattaggagctcgacaacaaggaagaagtcgagcacacccaccaccaacgaagccatggtggactcgaagctcgctgcacataaggcctcaagcaccactatctcatcatcccggggggggggggaggggggcaactcgccgcgagacaaacttgtatccccgtccgtgcaatattcttctccgctacgtctagcttgtctacgtgccgctgcttggcctatgagcggcccggcatgccagattgcaaggggtaggtttggcttccctagtaaaagttttatgcattcttggcattcgtctcgccatcgtccccatcacccggtgccatggctaggcacactgccggcggttgtctgaggcgtcgataccatctcgttggcccactcgatagcatatgtataaactttatatacacatatatacaaagtttatacatacgtatataaagtttatacatacgtatgcaggaatagtagtggacttggttgacacgtgtcccgcgggccacgggttgaggagagtgcgcccaaccgttgattacaccaccacaaaaggcaaaaacattattgggaaccgctcagccatcgtctctcactagattgatctatctttctgtttttggctagatttttattttcggcatatgatctttctattttgagctacacacatgagagagaacggccgcatgcctggggccgatctcgactggaaacgcatgcagagcgacgagagtgctgattcgcaattaaagttcatattaggaaaatgcaaatcaaagtctattttttcatttgcattttaaatttgtttcgaacttatacgtacaagtttgtaagcatacgtacagacttctaattggtattattatttttttgaaagttaattggtattattattgccatgcattgctgtatgttttgctactgttattgttattactcatgaatggcccaaggcccaacgaaataaatggggtaatatatagttagcttttcaaccctttcaattattcatggcctaattgttagaaa

SEQ ID NO: 67460 - DNA, 9806 bp, Oryza sativa
aggtcaaaggagcaccacccaaggaaaagaaatggaaaaacaatagcgtccaccattgcgacgaactgaattttcttgcagagacctctaacttgattaaaagagatccatataacagaatttcaaatacagtactgtttaaggctccattagtaaaaattctaacttttcgacaatactgtctatcttaccctgttcagcgttcactactccagtagctaacatgccaacaaagcacagaatgaagctgaacgtgtcgtgaaatttcacttttgcacagatttatgtataaaagtaaatttattttaggattgagggtgtaatgatcaagtatgtcccttgcaagcgagcaagtactggcaacataggtgttcctggatacttttatagcttgaaatttaagcaagtctgcacagatctatggcctatggggactggagtcagcactgtgagatctcaatacgctgatagaaatttcacatggattcggtctccaagactgaaaacatctaggtgggtactataaaatagccgttttgattgattcctaagtgatccaaagcttgaattcatcttatattctatctaccacaccatcgaacatggtgtagctcacggtagtcccaataagtgtaggagtatcagtcaactttacaatggtgcaaattttcatacctgggcacctcttgcccccgtttcccttctacaaataggtgatgatgcaaactggtttaccatgatgcagtataagctctactatgctcatggctaagggaaaaaattctccaccaaatctccatggcccaaattacattcgaaatgcaagcgatgtatttccctgcggaagaaaaacactaggaatgatgctgctctcagtgctacttgtgcttgttctctcagcatattctcctgagcagattttcctttaccctccaatgccagcacacaactctcatcagacggccatcaacagtatgctctctcagtcttcatattttttttcggggggggaggggggggttaaaaaactgccattatagttacattttgtgtgccatttttctaccatcagttgattctttggaaagctattgttcatcaacatatggagtatttatgtgtcagattaaattttttttcctacactttccacctgtacatttggaacatgaacgaaagggcagcataataagatactagttcactctacaacatcaacttaaatttcagttctatgggaagttaaatagtactagtgttgtgaatcttgtggtttaaaatgcttaccaagcctagctgtctatgtagtttcgaattctttcttacctttcagataatctacatattatatttcagaagtgtatcagattaataattgggaaaagatgcaagcaccaaaataaatgaacaaaaggaaacataacttctaactctgcaaaatccacccccaaagagttatggcatatttccgatgtcgacaaataagatatgtattgatagcatatcagttcttttttctttttttttttgcggggagcatatcagttctaatataatcaaaagcagcaagcttgcctatccaagaaattcaagtgtgattttgtctttgtttaggtcctcatgacaatgcaaaagcctgcaatctgttcaatggaacatgggttagggattttggaggcccgatttacactaacacaacatgcccaacgataccagaggcaaggaactgtgcaaagtacggaaagcaaatggattatgtaaactggatgtggaaaccgcatggttgtgccatggaaaaattcgaaccccatctattcttgactattgtcagagggaagacattggcttttgctggggattcgattgcacggaaccagatggaatcattgctctgtttactgtctcaggtaaacaccttgtgttttagttcttctaaatgtgtaaccaaaggaagacttgcttttaacttgcgtaaacctatatcaccagtgacacaattacagtaacttgctttttaggttcattttggttctttaccctaccaaattgttggtagtgtaaaaatttaggcaagttttgccactaccaacaaattggtagagtatcacattggtttggcaaaaaaatagcttcaatccgaactctagccaagtactattgggttgccaattaattggtagggcacattttggtagcaatccaaaatggcctataattcttttgagtttttagcacaactatagacaggtattactccatatttgacaagttaagatagaaatggactggaagaagaaaatttgagctcttcccctttccactgaataataaaaaatatatatactggtgtaatataaagaataccttaaacaggcatcacacctgcaggaggccctatagatctttgcatagattcatgtattttctagaaagaaattttttaggttacaattatgaaataattttctccaaagaaatttgtaggtcacaattatgaaatatggaccaagcagctccaggcctggattttatttacattgctaacccggaatcaataatgtttataagttataacagagtgctttcatattttatgccaaaaatggggcataaaatttacactaagttcttccatctgctgatttatcacagcaattctacttcatgtacctttgtttctagaaattttatcagatagctgtgattaaagaccttgacacaactctacaagcttttccaggtagaagcaccaatcagagttagtagtgacaccaaagataaatttgtcacctggaacttcaggtctcataactttactcatggttctttggaccaaattcatagtagaagattctcaaagacaaatcaatggtacagtagttgaagagcatgacatacacttggataaacttgatccaagattagctacaaacttacaccagatcaatattttagtcatatccacctcgcgttggttcttcagaagaaactatctttacgaaggtgaggagctcattggatgcatatactgctcagaggataacatcacaagcttcagtgtccctatggctattcagagggtatttcgaacagcgctaaaaaatttgaaagagagccaggagtgcagattgcaattgacagtggtaagaacagcaacatcagcacattttgaaaatggtttgtggaatactggaggatcttgcaatagaactgaaccactgagagaggaagcaatgattgatcaaactgaatgggcaataagaaatgcacaggttgaagaggctgatagaacaaaaaagaacaacggcaagggaggggtgaaaatagagattatagatataaccaaagctatgtcaatgaggcctgatgcacacccaggtatccattggaataaccagtggatgaggggttacagtgattgttcgcattggtgtctgccaggaccaattgatatgtggaatgagctactgcttgctgtgcttaacaaatataagaacagcttggaagatcaatgacacaaggccctttgccaatccatcacatccacaataagagttactttttaccatgacaacaccaggcacctatttttctcatttgcaggaacttttgttagattcagacaataggacatacgaaatatgatcactgtgatgacctagacataaaactattagagttctctatgtcgaaggcaaaagcaaaggacccatctggggtcagtttttgaacaagcagagttttgcagtttgaaatcacttctgattagcgagagcctatgggctacaacattttagtggtttccataaccattttgtgctgggctgatggccacttgatcagcattagctagttttatcataaagatattcaacagaaaaaatatacacatgaaaatattagtggtgaaatagaaacatagagctatacagaaaattcaatcttatgaatacctgatggttctctaccatgctcagcttgtcaatttgttatcatcaaaatctttggctgtactcctgctgctaacagaagtttgcagtaattccttgctcatcaagtgcttgcgtttttggaggctcagccaaaccaaaatactgtcagtctggacaatgttatatcctgctttcctgtacatattgaatggaacttggtcgattatcctacagtgcagatatacgtgccttttggcatccatcttgataatcagatcctcgcatgccttaagaagttgttttccaattcctctcctaatgggaagaaacaaggcacaataaaaactttataaagcacataatcaaaacattatatagattaacaaattaatcctgatggcataaaaccataggtttcacaacttactcatctatctctgatcgaaaagagaatgagttcaaccattagatgtcacgtgcaagagccatgggccctagaactaggccacatgggtaactctcatgcatttttcctttttcaggaatctggttcataatgaacaatacttccaatcttctccaaacaaatactctctttcaagtaaaattaaatcatggccattgcattttatataagcaaagtatgacaatttgtatagtaaaaacccttctacactggttctcgatttaccatgtccacagaacaactttggttgctacttggagcctcaaattatttagtgcatatgcaataatcagcgaaaatgggaaaatgcttgatccaacgcaaccatatgctgctatgctaaggaagctcaattggcaactcagctctcgcctcaaaatctatcagcatagcatactccattttgatttgcagacaaagtggaaatggccctgatggtgtaatccattacctcctcaacgacgtcttgacagtcatgttgcaaatgtacgggaagtcaagcggcggcgtgggcgtgggcggggcaccgggcgcgcccaccgcgtccagcgacacctccgccgtgcacgccatctccccgtagtcgtcgtcgtcctcgttgccctcgccctcctcctcatccccgtctcccgtggcggcggggcggtagtaccccacgagcacggcggcgtgcggggcgaggccgcggcgctcgaagaggtagcggcggatgacgaacgcgaggagctgctcgtaccgctgcgcgggtgcccacctgacgttctcggcgaaggacgacgcgaggaggcggacgagcgcgtcggactcgtcgtcgtcgcccgccggggtgagcgcccgcacggtgaggcggccgtgcgggaaggagtgcgcgtagcggaaggcggcgagctcgtcgcgctgcgacagcgcgcgcggcgagaggaagacgcctccccctccccccgctggccccgtgacgatgccgccgtcgccctcgccatcggacgacgaccgagaggccgcgaggcgtgcccggtggcgaggccgcgagcggtagggggggcaggagaagaggaggcgcgggtgggtcggggcggctggggagacggccgggaggaggaggaggaaggccgcggacgcggcggccatggccggcgcggcggagcggaagcggaggtgggtgtagagattagaagcgatttctttttctttccttttttttttgaaacgggtccacgtggataaacgccaactgtgcgtcgcttagataccaaccctgaaatctgaatcttctgaaccttctctgtgctccacacaacgttctgaacggaacctctctatctgatcacccgttgccatctccgtcgcttcaaccacctgcaagctgcaaccgagataccaactctgaatattctgaaccttcctgccatgcgtagcacaccattttacatcattgattcaggtcctgtttagttcgtgaaaaagaaaatttcgaagtgccacaccggatgtttgatcaaatgttgtaagagatttttggacacgaatgaaaaaattaatttcataactcgcctggaattatgctcaaaagattcgtctcgcgatttctcttttaagtgtacaattagcttttttaatttatatttaatgctccatacatgtgtccagagatttaatacgatgtttttttagaaaaaagttttaggaactaaactaccctcagccaagcaagctagaaagcttatgccaattcacttggtatacggaagagagatggagaaatgcaaatcatggaattgagttcagctggttagttcagacagttactagaaggagtacttccgatcactgttacccgcatcactgttgccaacggcaaaccgaacaggcattattacccgcattttcagatcaagaatcccagtatcgcaccagcacaatcagtatcactctcactctcacactaccattaacgtactccctcattccaaccaacgttgttttattttgggacaggagtacccgttaacagtaataagtctctggctctctgcaccggccaacacgttcccggtctatcgttacctattcttgtaccacatcaatctgcaccgacgccataaattgtgtgctgcgataggtagctggatctcgccggagtgcatcaatggccagcagcggtagtagctccccacaatcaaagcagctgaccgtggctatataataaggctctaacgccatggccacacaacaaagaactcaagaagcaattaacattcgcattcatcagctggtaggtagtgtgagctagagattaagggagagagagagatcatggcgtccaaggttgagctggtggtggaggtgaagtcgccggcggacaagctgtggacggcgctgcgcgactcgacggagctgttccccaagatcttccccgagcagtacaagagcatcgagaccgtcgagggcgacggcaagtccgccggcaccgtccgcctcctcaagtacaccgaaggtaatatgcacttaaaaaatctcgtgtttaattctcaacacgttcatattgttttttaaaaaaaatgtttagagtgacgtctctccggccaactctcatttttacgaatgatgcctccgatcgatgtatgaactttattgaaggggtgccgatggtgacgttcgcgaaggagaaggtggaggtggcggacgacgagaagaaggtggtgtcgtacagcgtggtggacggcgagctggtcagcttctacaagaacttcagggtgacgctgcaggtgacccccaagggcggcgccgccgcccccgccgccgacggcgcggtggtgagctggaccatggacttcgacaaggccagcgaggaggtgcccgacccggacgtcatcaaggagaccgccgccaagaccttccacgacctcgacgactacctcctcaagaactagccagacagccagatcgagcgccgccgtgcgggtgcgtggcttatgtgttagagtccactatagcgtcctcgccgtcagtcgtcgtcgcacacggtcgcagtatcggggtgttgcatttgctagctctccggctagccactgtctcccacgaattagtgtacgtatcggtgcatgagtgaataataaagtgttcaggttaaaccgtttatcgtctctccggctctccgtttactgtttccttgtattgattttcggtctatccgactctctcactctcctttggttaggcctaaacatgtttaggttgagaaaatttttagatttggttgtcatattggatatacagatacatatttaaagtattaaatatagtctaataacaaaataaattacagattctatcaggaaactgcgagacgaatttattaagcctaattaaactgccattagcaaatgcgagttgaatttattaagcctaattaatccaccattagcaaatgtttattgtaacaccacattgttaaatcatgacgcaattaagcttaaaagattcgtctcacaatttacacgcaatatgtgtaaatggttttttttactatatttaatactccatgcatgtgtcagcgtgaaaatttttgttttgaaaactaaacagagccttattttgattcacagggttggtctttggttgtgactttctgttggaagttcccagatattttttaaaagaaattcactaaaacttatacagatagtatatagtttgttataaacatttttttctgaaaaagttggtagattagttttcgcaattgattggttgtattcaatatgtcttagccatataggagggcagtttttttctcgtatctgtatggaaattcctttaaattcagccttaaatatatgtaaaaccgacctaaactttttttagaaatcgcagtgtgaatttaaaaccaggagtttttaatccaacgcgaaaatcctgagtgcaactctctgtctcgaatatcaaatcggaagttccgttatgagttcatgtttgtccataaattttggacttaatgttcataaattttgggtgctaaattttgatctacgtgatatgaaaaaaaaatatagaaagacaaaaggacttcatctatagaaaaaaacatcatcttattccgataaaaagatggaaaagtttccacaaggaaactttcaactgtaataaaaactttctataataaaacttatttataaagaaactttaataacgacatttttcatcgtagattatatattacgaattattgggcctaactaactataaataaacctacttccaaatggcgcacaatagagaaatggcgcacaatagagaaaaaaataaatatgtcatgcacgtacgtaaaaataccgcgtaaaacaaaaaaaaattaacatatttctttacttacaaggaagatatacacaccacactcacatgtctaacgattatgttcctaacgtacgcttaaatagacgataccattagcctcataaatagagaaatgtatccacgagacatctctaattgtagcgcccgttccgtcgtggcgcctagcgggaaaactatctcttaaaaaccctatttgcaaaatccgtttctttgcttgttgtctagtgtccgtgccatctcagatctcaaatcctcgatctatcgtcgagttcaatcccgaatccaaatccttcccaaatcaaatccctccgcaaaagtctattttgcctccctcgggttcgatgggccgaactcctctcggcccatctccccctccctccccggctctctctctctctccctctcccccgctctgctcgtgcgctgcgcacgcgtgcgcgtgagccgcgccgagccgagcgccctccgccctcgctgccgcttctcgccgcgccgcccgttgcttcccgcgtgcgcgcgcgccatggtggccgaccgcctggtcgccgccgccgtcagcgcctgcccgcgcctgccgcccgtgtcgtcgctccgctccaaaccgccccgccgtcatcgccgtcgtcatcgactcggccttcccctctcctcgcgctagcctccaagggacggaggcagagctcctcctccctctgccgcgtcgcccccatcccctcctccttttcccaaagtggcaaggggcaagccccctttctcccttcctttttccttttcccctccccgccggcgtcatccgcctctgtcgccgttttggccgcgagcgctgagcgccagctcgcgccttgaccgcccaaggtcggtttccaaaccgacatcgtcgtcctataaaccaaggcgccctcccatcgattcctcctcccgtttcgctcgctgccaccgcgccattgccgcccctctgtctcgcctccgccgttcatcgccaagcaccgggagagccggtgtgttcgtggacgcggaaggggactccgggcgcttgccttcttcctcttccccgg

SEQ ID NO: 67461 - DNA, 655 bp, Oryza sativa
tttaattatcaattaattatcataacacgattaaccatcatgagctaccattaaatataaccataaataataatgtagtatgattcatcccattaatgagctaatgtttctaggcatggctaagcaattatatatatatatatatatatatatatatatatatatatatatatatatatatatatatatatatatatatagcttttagctgaaccaaaccaatatataaggttcaagctaatcaatttattacccaaggtaacaaggaatagagtaatcaatgcgaattggccattacaaaggaatatgttcacagttgaaataaatacacagttgaaataaatagagaatttaaatataggatcaacatgctcaaaggaactgtgtttaggatctgtgtgacttgccttgcaataatcggtcttcaattagtcttcagaaccacttccgacgcactcgcgaacctttcgcaacgacggaaacaacaagctaacacgcaaaatgggaaaaaagactaataaaaaccaaataaacagtacataaaagtaaacaaacatgtagatcatgattttagataattttagatgaattccaattaaacctattaaagaaaatactattccaaattaattaaaccatttacaaatgatttata

SEQ ID NO: 67462 - DNA, 674 bp, Oryza sativa
attcctgcagcccatcgatcaggttaattaagaaataagcacggaataagacaagcatataaacatcaactgtatagtggtggcagaagtattttaacacacaacgcacgcgcaccaatctcatttctagtttactccaaattaaagaccagtcagaattttcgcctttgcaaaactcctctcatttcatttcctcccaagagtcaagctagcccttcttgcttgctccgttcaacgcctcttccccagcttcacagtactccatgtctggacctggaggaggaggtcatggcctctacgaggatcatcctgcagccgccggcttcctccccttcgaccacgacgacgacgtggtggccagcttcttctttggcagatcggcggcgtccggaggaggagccggcgccggcgccggcgctggagacgatgatggtgttgggctcatcacgccctactccagcatcacggattatctgcaaggcttcctgcaggaccccgtgtacgcgtcgtccccgttgggcggcgatgctgccgtgaagcacgaaacggtggtggatcatcccagtcaggccggcggcgtggcggcggcgccggccacgccgaactcgtcggtgctgtcgtcgtccagcgaggcggctggaggggacgatctgcgccggtgcaagaaaggtcgt

SEQ ID NO: 67463 - DNA, 10227 bp, Oryza sativa
tgttggcatgttagctactggagtagtgaacgctgaacagggtaagatagacagtattgtcgaaaagttagaatttttactaatggagccttaaacagtactgtatttgaaattctgttatatggatctcttttaatcaagttagaggtctctgcaagaaaattcagttcgtcgcaatggtggacgctattgtttttccatttcttttccttgggtggtgctcctttgacctgcaactcttaatgcaagggactggaagctcaagatgataaacttataataaggaaggagaagataacaaacaaaaaatgttgttacagctctagtaccaaaacagagcactccagtcaatgtagcacgaactaacgtgcgttcccattttaatagctactttgtccatcctaaaatacttgttaggtagatataatttagtacataaacttataaaatacttatttcagtgaacaaatttgtctagttcgtgcgagctagaaccaaaatggctttgcaaggttgattttaccaagctgatgttgattggaatgtgatatgtatacgtggaatgagtatgcataagacaatctatatttataaatttatcctctactttatccttcatatatatctaaccacttatcattgcttgggtttatatatgtttttttaactaaatcactatatcacattctatctttttattgaacatatgtatatttaaatagcaacatttctttgatatatgtttacgcagtatcctaattagcacataaatcacatgaataatactttatgcataacttacctttttaaatttttttataattttttcaaaatgttagacactgaaacccacgaattgattttttttttaagaacggacgggagtatgtagccttgtacgacatggcccaggctccagagccgctctcccagagcagttcagcagtgcagtgcatcgcacgctcgcacatgcaacatgctccccagtccccctggcgccttccctctccctctcgcctctcggtggaatgcagctcagcacctgcacccgctgcgcacggatcgcccagccctctcgccccttctcccctctcgtacgctcaccggcgtgccactcaccaaaccccctacccgtacgctgtgtgtctgtcttccccgcgtgtcgcgttgcacggtgcgcgagccaatgacactcaacgcttgcccgtgctcgtgcctgttttttttttcttgtaacggacggttggatggtggagtgatttgtcctctgctctcttgttcaaaagtcaaaactgaaggatactagctttgcacaggagagtgtggtgcccgtgccctacgataccgggtgttttgtttagatgctacaatttgctaaacttatggctaggcattttcatcaagtaaaactagtgtttgatttgttgtcacatttgtaacatgcatcacaccttttcttacgcaaagtacttaaaaacttttaccataacacatcacacctgtggccaacagacgctataaaaacaaagggttaattagatctatgtcattgcaaatatatcgcactagaaaaataacattactattcatgaatcggttgcatgctactgcaatattttaaagttagaaccgtatcactccctcacgatttctctccatccccatccctcaattgccacctccacttcttcgtctttgatagcacgatgccggtcgactcatcatgctagtcgctagtcgtgtctctaatagcacaacgccggtcaactcatcgtgctagtcgctagtcgtgtctctaacaacaacgaggatgcgtagcgtttcctcctcaaccaagaggaggagcagcagcttagaaggctcttgtccacgagcaatgtcactacaacgatggcggtatcttgatcaagttagactagtgtttggtttatcgccatagttataacatgccatattttcttggcaaaatttgctacagaacacgcaaaaaatatgtaattagctgggagacaccaaaaaacgtgacatggttgatggccactacaaaatttgtgtaattggctatagaacactggtcgaattattttattatttccgagttccatcgttttctccttcgtcaggaatgcgcgtggtggggcgaggtcggcgtgagcggggtgagcgcgagctcaacggcagcagtagggcgggtgaggaagcactggctcgcgctgaggagcggggcgaacctattcatgcactcgctgaagctcgatgagccggaaaagtccgtcgtcaagagctggcggaagggcgccaacccactcccgcctcgctgcaccgtggtcgtcatccggttccgtggcaagtcccgagtcctcggcgagggcaacggtgtggtgactcctctgcatgtccctgcctccggttacccgatgatgagcatggacgagcagaccagcctcagcttcgcgctattcaaagacgtggcgttcaacgccagcatccgccgcggcgtcagggcctccgacgtcgcttgcctgcccatctccttcggctagtagggcccagtggaggaaaactggtgactcatcaagagccagtgcttctcaaccgagggcaccgccaacttctacatgcaccccatcgagggcctcaccgtgctggtcgacatggacacggcggaggtcctccatgtctctgaccatgacgccggcatccccatccccaccaccgcaaacaccgactatcggcacggacactcaacgccttcgccctgctcctcagcggacacttagcgtgagctcgacagccgaagcgggggccttccccttcccctcctccttctccttctcgccctgccacccgctgccgccgtcgagctcctgccccgctcgtgccgagctcaccgacacatcccccgcacgcacggccacggtcggcgacccctcccccaggcgcagccagtgaaacctcctgacctcccttaccgcggctgtggtaaagcggtaccaaaattaggtgtactccattatggagtgggcacgttataaatccgccggcgtggtctgtctcggtggctcagtcggctctatagccaagaaaggataagggaaagaggctcagttggctctataaccggtttttttaataggtgttatttttttaataaaattggcacttctaatataaatataggtgtcggttttaaaaaaatcgacctactactctgtaaaaaaaaacacaatggactttttctttttaaccattttaatgcacgaggagttttgtatgtctcagcaagaagagaacaaatctaccatctaaatagccaatacatataacaacataacaaacgatatgcataatctgcacactaatttgtacatctatcgaaaaagcatttatcgataatccataaatgtttgaggcgattttccattcgtgcatgcatccgtgattctcatcgactaggtgtgaacagagaaaacatgtgcaatcaaaatcgataaatataatggcatttataacattactataacatgaaaaattctaatttatatcaatgaaacagacatccatttaggattaatgaatcagattttcatatgtgggctaaaaaagttttttcaattcttaactaatttcagttgttttttcatttacattattagttttagcactatttgatccactaaaaattattgtaacttatatttagctaacttataacttttctaatattgaattatcgttccggacaaagttatttgtagtttcatattgttatttatacgtttttatttccttcatcatttatgtccaactataatatatagtttaggattttaatttatgtcaatgaatattatttagaacccgttgcaacgcacggacattattgctagtcttataatatgtatgagtaccaaaaacaaaatttataataaatagacaaacaatcctttcagatatcatgtctgctactccctccggattgataaaaaaaaaacaatcttcaaggtgcaacaaaacacctgggtgcatgttggcgactgttaaatgccaattttatgccgccaatacttacgtaaatcggaaaagtatgaaacatccaatatggtggtagggtttaattcaaacaatttccacgagtgttggtatatatttgtataccggtgacaaactaccaaagttgagacgaaatacacataaaactggaggagaatttcacccattgagtttgggcccacaaactcatcgaaataccacaaattaggcccaatcaatacaccaatggcccaaggagtcttttgccaaggcccaagaaaaaagccaccgtcaggggagctggccagaggtctcttagttcctattagcatactggaatattgtgcactagaaataatgtttactttagtgtttgatcgacattaggaatattagagtagtatctaaatagtgtagacttggtttctatatattatttaatacatgtatttgcagcgcatcccacagttcgttagaggtagatgtagaggcggtgaccgccctcgagatcacttaagttctccttatccgaatacggagtagagcacgatctggtagcagcgagcaagccagtgcctgaagtattgcaatatgattaaacataagctttctatagaccctatacctcactagaaattatctctaccttttgcctacatttttatattatgttcttggattaacagtattgcaatatgattaaacttaagctttctatagaccctatactcactagaaattatctctaccctttgtctacatttttatattatgtccttggattaacctggagaagagttacatgttccgcgtggaaatcaataacttgaatatgattttatctgtgatcgtaatatcaacagtgcagctcaaaacaaagttatttgttttctgtaaacagggggacccaactctacaactcaactctaagctgaaaattaatgtcggtgcaaaataaatcagttaggccttaatgcaaaagaatattttgtttttataaatgagaaaacaaagttcaaacaaacttaagaaaaacaaaccgtgacaaaaaaaagatatttgaagaattgatacaagaagaatgtaacgccccaggtaaccacgtacctagagtgccacatcaaaatactctcaaaactactaactcccaaaataattagaaattttggtagagtctctcctataaatatagacatccacgtcaggcagttatagattaaactaataatgacatcgttcccatagtgctacccatccatataatccatggaaagaaaccaatagatatttaatagattattacaagacaaaaccaagatatagtttaaatgtcattatggacctaagcagtatagtttgatagtgtgcaaatagatatgtatataagggtgctactttctgcccatgcatgccaatctcaatgtatacctaaaaaacaaataaacataagagtgagtacagaaatactcagcaagtacagtatgtaactagaaagcacatatacacatcatgggcaatagagcacgaatagaaagcttcctttctttgataagaaacacaatttcaaacaccaagtcaaagaaaatagtagttcccattccgggcagacatgaattgaaatagtaatttctatcccggacaattgtgaatacatcctagcatttgactttaaccttgatggtaacctgacgtaacactctccacaaaggatatttactaaaatcgtaacctagaacatataaacttttaccgatttgtattaaacaacctatagcagttccattactattttatacgtaactcgcaaaccgtttaacggaaactagcaaataatacaacttcagatatctagaaaaaattgtctacaactttcatgttggcaaaaaaatcagattaagccaatgtaggtctcagataagaaaaacaaatttctgtccctattttcagaccggcagcagtactgtttttgctgtttctcctaaaccgtttatcggattcgagcaaaactagcggcgttaaaaaaatatcaacgatgactacaaactttatttaggacaactgacctgaataccgatggtttaacaccagatttgaaaatacggtttcagcctagcgttcgaaattcgaactaccggtaacagatcgtcttatatatataaattagaaacaactagggactaaaacggattacctagcagtactaatttgagagaaaaacaatgaatttggagatatccacctaattccccaaatttccctcttctatctaatttccccttctctcctccttcctgtttttctctgcttccctggtcgttgtagaagcaacagcagcaaaccacccaccagcagcagcagctgcaacaaaagttggagcccaacgcacagcagccaaagaatcagcaggccacgcattagcaggagcagcagcaggaaacgcagcagcagggaaagtagcagcagctcaccaagaacagatcaaattggcagcgaaggacgacgagggctgcggcaaccggcgacggctgcaccggcagcggtggcgcagaggcggctggggcgcaggagtggtggcggctggggcgcaggacccttttttttttttctgttggttatatagagagaggttaaagaaaatcgaacagcccacattaattcgatcaccggaaataccttgggactccgattaccacaaacttagtctattttgcactattcagcgagctctatgcatccacggtccctgatcgcctattcaaacaacggtttaaaagttgaacttttgcgcgtttgttttaatatatcccgaaatacactaattcgaaactcggggtattacaaagaacatttcaaaaatcaaggaatccaacttaatgtacaaaatttaaacttatggaataaaagtgaaacgtcaacggagaaaccaagaaaatgttcgtgacaagcaatcttcgatttccgtaaaatcaataagatgcaaccaaatggagacgtctagcccgcaaccaacatatttttttcgataaacaaggagacaaatctctacaacttagttataagtcgaaaatgaatatattgagcacaaaaaagccgcaaggttgaaatgtacacaaatatattttcttttcacaaactagtaagcataagttcaaacaaaattacggaaattggcatttcataagtaaaataaagctttagagtcctaagagaagatcaaaagcagtagtacaagagaatgttagaaacaaagaaatccaacaaaaagtgtaaagtttgaacgaaaggacggaacacgaagtgtcaagagacaaacctaaaaacgttcggtataaagatattgcaattttcgtaaaagttttaaggtgcaccaaaatgcatggaaccagttcataacaaagtgttaatagcggaattttgcatcagattcggagaagaagaagaaagatcgaagcggatttggtgttgaaccaagttaaaattgaagtcggactgcgcattggccagcgtcgtatcggctgaaaacaggatataggcttaacttagccgatatggcaagtagccgatacgatataacttgggctcggtttgggcctaaattttgttggatttggacatagaccaccgtatatggtcttgtttgtattttatttttagaaaggtttgagtcgtgtccataatagacgaagtctgtacttggggtataaatatgaaccacatagcattataatctgagagacaattcaatacaacttctgcacattgccaccatttttgttcttcttttcggtgagttctctcgacaagaggtaacccgtctcgatggcttgtgctattgggggttattatgtcgttttagttgttttagtccttttatgatgaccatatgttatcatatgtcttagttaatctagccttaatatctcaatttagcactatcggttggttctcgctttagggttcctgctggtatcggctaaattgccttactagattagcttagctaagccatctaccatcttgaaaagtgattaattccttgattatttagaccttaggtttctctgattatttagaaccctaagaactaacatggagataacatcaaagtttcagctgatcttacctaatatacatgcttcttaactggttttatctatatttgccacttatatagacaaatcattctatataaccatatcaagttagatcagtattgactgggctatctgaaacactaattgatcatgatttgtttatataagtttgtactagagtattagctagtactttatcattatctatacattctgctctaaatactgctccatcggttattgtcatagtattgtcttgaacttctttatcaaaccaaatagacattattgtaaccgatgaggcattgtttagggtcttttattccttgatctatccagtcaatagccgatttggtctaaccacatcggctgagactactaccgatacgctattggctgactaactctgcttttgactttcttgctaattgtaggatcaaatcagctggcacgcttttaacacactcgaggctagccttagacctgcactggagttaagcagatctcccaggccgtcgtgtttcacatcaacacaaagttatttgttttcaataaatagggagaccaacctctacaactcaactaataagttcaatattaactttagagcaaaataaaacggtcaagcttcaatgcaaaagaatattttgtttttataaaccagaaatcaaagttcaaacaaatttaaggaagacgaactattacgaccaaaaaaaattggaaactccaaaaaaggagtgttggaagaatcaatgcaaggaagaacatttcaaaatcaaggaatccaacaaaaagtatataatataaactcctggatgaaaaataaagcctcaacggtgaaaccaagatatcgtttggtacaaccaaactacaattttcataaaatcaataagatgcgatcaaaaatatagttgtctagcccacaaccaagatacttttttcgataaacagggagacataaccctagaactaaattatatgtccaaaattaaaacgtcagagcacaataaagacgcaaggtttaaatgcaagcaaatatttcttttcacaaactagtaagcataggttcaaacaaaatttaggaaattaacatttcaaaactaaactaaaggtttaaagtccaaagagaaaaaaaaaaggaaactttgtaaagctcaaaagcataaagtttaaacgacaggacaaaaaaagaagggtcaagggagaaaactccaaaaaggatatttgaaggatcgatgcaagaagaacattgcaaaatcaagaaatccaaaaaaaagtacaaaatttatacttttggatgaaaaatgaagtgtcaatggataaaccaataaatccttcggaacaacgaaactatggtttcacaaaatcaataggatgcaaccaaatgtagatgtctagtccgtaaccaagatatttttttcaataaacaaagaaacaaaactctagaacttagttccaaatctactattaaaacgtcagcgggcagaagagctgcaagttttaaatgaaagcaactattttcttttcacaaactagtaagcataagttcacacaaaatttaggaaatatagatttcagaactaaaataaagctttaaagtgcaaagagaatttctaaaaagagaaagtttgttgttgaagaaagagtaaattacgctcacggtacataaacttgtgtggtgggtgcaaatagatacaacaacttgcaaattgctcatttcggtacaataatttggctagtccgtgtgaacctaggccaaaacgatccacacaagcaaaattgatctagcctgatgtataatgatatgtaattattattacacataaaaatttataattcctaaatgtgttgttattatccgcatgatatttttaagatttagattgataaaagaaccaaaacaattaaacatgctcggtaatgaaaataaactttcaataaaatggagcttctgaacataggaattaaaatgaatttcctggtgttatttgcactatggcacgccagaaattgtcttagttataaaggaacgaaaattccagagaaatgaaatgaaataaacttttgcatcactaatttctctttttatttggattgcaaa

SEQ ID NO: 67464 - DNA, 636 bp, Oryza sativa
aaatgtttggagggacgtctctcccctcccaatatcgtttttgaccccccgccccctcatttttcttttgcacaacgaacagattgctttctcttcctggctccactagaacaatcagaaaagttgttgatgtcataagatgaagctagatctacttctgtaaaacaagttctgtaaaacaacaaaagaaactagtgagatttggaaacataacatgcacattcattagagccaaactttgtaaagttttaatgttatgaatcatacctagatgattttatccttgaatttgctgtagttgtgtttagagaagcctcggcatcttcagaaagtatattctatctcgtcaaaaaaaaagtatattctagaatgttttcggggcttcctgacttgagcactgataaattgagattgatgaaaaacagaacataaattatcgttttttttgtgctacacactcaactattagatagatttgaaaaatgaaactaaataaaagctgtgcctcacagcgttctcatcacttccatcaacttcggagtgaataagtgacattaagtaactggatataggatttaggcctttaggggtcagcaggtcgctctgtttctctatcaaaaagttggattgaaaaat

SEQ ID NO: 67465 - DNA, 6870 bp, Oryza sativa
aattaggtggagggctcaccgatggcgacggacggcgtcggggcaagaggaggaggagtggatcctttccaccggcgcggattagggcgccggggtcggaggagggccggcgggaacggcgtccggcggtggctgtgagagcggcacggcgcaggcgcggagggcgaagctagcggctgcggcggcgctgggaatcaaggaggggagggaggccgatggccggggaggcacggtggaagtggccggtcgcggcgcacggccgagcgcggcaaaacggaggaatggaacgcggcgggctatgtcgagcagcggcgggcgcgatgcggcgagagggggggagaagaagggtggcgtcttcagtactatttcgggtaaggacggggaagaagcagacggcaagctcaccgacgagagaggagcagcgttggcgacgcggagggagccgtggagaggtggtcgcgacggcggggcgggggcgagcagctggcggccggcatcaatgtcgcgggtgtttcgagcgaggcgaagacgaaacaagaggggagggcacgggctttataggcgaggaggagaggtcggtttggaggagggaaaccgacattggttgtcaagggagctcggctggtgttcacgggcggcagcggtggtttcctgggcagtgcaaaagcggcgacggcggtggatcggacggcgaagattgaaacgcgagcgcgggctggcagcgtggagcggtcaaggtgggggcggcgagctggcgtggtcaaggtggtggcaggcggtgacgccgatggtggtcgggcaaaaggaaaaaggtggagaagaaagggagctctgctccttgctatttcgggataaaggaaagggagagggagcgaggccgagggctctgcctccctcccttggacgcatgcgcacaggcggggctgggcgacgcgcggtcacgggtggcgtcagggctgacgcggcggcgaccgagcggttggcctcgagcgagcgcgcgcgcgcgggaacgagcggcacggccgaaaatcaaatggcgacagcgggaaaaatcggcgatggcggcagcgctggcgtgggagagagagagatcgaacgagagagagagagaaacatagagagagaggaagaagacgagagagcgagagaaacagagagagcgagcgacggctctctcttggctcgcatgcgtgcaacgcacgtgtgggggggggaagatgatgggctgggaggggagatgggccgggggaggaaaatcggtccatccaaaaatacagggaggtaaagtagacttttacagagaaaaccgatttggatagaattgtagagatttagggtttggattcgaattcaaatttgatattcgaactcgagggtttagggatgtatcaagggaaactcaaggagaagccatggaaaagattcaaaaggaatacttgggtatttgttctcgggaacatagggtggagtcaaggaaatgatttggatgagaatcgattctctcgaaatcgggagaaagatttggcaacgagttcaaggaagggagagattgacttccggaattgggatttggatgagagggaggagtcgccaacgggattaaaaaaaggggatttgaatctaaattttgatacttgtacacaagggttcaaggagacgagtaaggaaacaaagtgggagtttgatactttcgggatgagagggaacaacaggattaaattgggatccttggcacaacttagactctcacacaaagaacgaaaattttcgcaattaggattttgccgagttagtttttaacgactcgcgaaaagcggagcgttacagatcgaccccgagattcgaaggtggaccacgcacacgaaaccaaaaagggatcttcagactccttcacagcttcagactctgctagtctttcttcaacttattgttgcatacttgccacaaaacggtctggtaacttgattcacttagcatttttcatcttactgtggctctgctcttgcctgtgaaacctgttcttctcctgctccttcaacttgctcgagattcacaacttttccatttgtttctacttgcacatggttcagacgaccttgtccaacgggcggtgaggttagcaggacagatccactgtttggtgacttcgaaccttttgatccaggtatgttgggaaggattgtcgttggttgaactggctttgtcttgactttgtgaaggcactttatcttggctttctgagggcaatcccacgaatagtgtcccatctcatggcagatgaaacattcgactcctgccttatgaccacgtctttttgaaggtgtagggcatggtacggagttgcttccttcatggctattactattgatcattgtggcttgctgaccaggttctgacatagtcgaacgagacgtagaaccggaaccatttgaatgctgagatgctttctgatagtattgtgctggcgagtttgtttttcgacacaaaccttcttttgcttgaatctctagggacattactttgcgtctcttgtattcttgcatctcttgttctgcatcttctagtaacaaggacttatcgaccatttgctgaaacgtcggaaagtcgtgagccaaaagtttcactcgcagtttcgcatccattccttttaaaaatcttctgatcttctttttatcagtgtctacatcttctggggcatatcgggccaatctattgaagcgactcaaatactcgttgatgcaagaggatccttgcttgatatttgcaaattcttccttcttcaaatcaattatgctttcagggatgtgtgctgagcgaaaggctcctgcaaactctgtccagacgatggtactagcatctgtatgggtagcacagtagttatcccaccaatctgcggcaggtcctctcaactgatgtgcggcgtaaagggtcttctcatacggagtacactataccagatttaatctcctttccacatctttgatccaatcgtcagcttcaataggctcagttgtttgagagaactccggtgggcgagatctcaagaaatcattcaattttgagcggccattatcttgaaccatatggggttgacactcttgagtgtgttgttgttgcatagcaattatattctgaatcactccttgtaatatatgggtctgcatggccatgagttggtgaaggtccactggtgggggtcggttacctcttgagacatcattaactgatccggaagcagccatatgatcactctcagcttcttgctcatctgtctggttaactggttgatcgggaatttctgactgaactagctcttcttcaacaccaaagcgattgggagcaagggtctgacgggtagaacgacgagccatctgcttcaaagcggctgagatctgactgaaccagaaatgggacaagaaaaggagaaaaacaaaaacactacatcaaaatggttttcgaaatcacagaagacataggtggtgtgttccagccggtaacccaactggtctaacacctaaacacggactaccaaacaaaactcacacacgcactagttcaccacaactcctaccgtgcgggtgacggtactaaggttagcctaccaacaagggcttaactaagactcctagaggcttgagcacacctttcttcaactgggcgtgaagacaggtttactctaggataaaagtcaaaacactcgactaacttctacctttttggacacaaagggatttttcgcaaaactagagcaaaaggggacaacgacaccttagctttcacaaatagttttttttttctttgtactcaaataatgccttcctattaaggggtttcgatcctagggccaacctatgctctgatacaatctcggtcacaccccaatctgataccgccgtacgacggcacctgacaggagcgtgtcatagggaaaatggcgcgaaccgcttcctacgaaaccgcgatctcggtaccagtcccaggacatagtgctggtacccacggtgacaaatatgaatcatagcaatccttaaaataaatagaggacttatttaccttaacttaggttgcaactcagacagcccgagaatacaaccgacgacacggacgaggcgaacaccaacaacaacagcagcagcggaaccaacggtctaacacccaacaccacaggcgacgactgggaaccaggacgaaaccctaatcttcacttcacctcatcttcaacttcagggcggaggaactatatatatttatatagagcaagggtgagtactttcgtactcagcaagtcacgggaatttaggtgtttaatgcaagcttggaagagaggcaaggttgttttgcaaatcctttgtttgaaatcatttttgaaatcactaagtgatttacttcttgttaggtttgggtcgaaaagagacttgcgtctcaaatcgacttaagaggtgcttttctacaactcaataggtaatgtaccgacctcccgggtcagatcattacttctcggcttcccagagccattccacttgattaatcggctcccagagcctttttcattttctcggactcccagagtccagctgcccagcagcacaacaatccgcttccactcgggaagcctagactatgatgcccatagacatcccgaatcacacagattcgtttcttgaccactcaggtcatccatctgcacataggctgattctggttacgattcccacaccacaacaacttttcacaaagcacaggcaaacaaatctacgcaacgggaaccacctcacatccgcccatgaccgtgggcacggctgttcgaacaattagttaacctctgcagaggggtacactttacccacaagacacgaacttactccaaacactggccggtgtcagaggttcgcgacaaagcctttcccaagccgacccagggatacctcatgccacatagaaggatcaaatcctcacataaatataggccattttaggcgttcacaaatcaaactccaaccacctcgatcggtaattcagcaagcttctcgttcttgcattaccaggaacccggtttgtccgaccccgccccggcgttcccaactattggcatgcgaggtttccctgaatcgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgattaccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaagggtgacttgccttgctcaaggtcttcacgaagcttcacgaatcttcgagaaaacccgcgatcgacgaaaattcgataaccgcaactatacgcaaacaatcgaaaacctaaacaaaggaccaaaagaaagatcctatttagactaattagtagtgccattaaatagatctcaattttacggaattactggaagtggaacggaggcgatcggagctacggatcgagggatatgaattttggaggtctaaatggattttctggacaaggaaatgttttgtcagaatttatggaaataatattctcaagaatattattgacagtcactgaccaaggaaaatgattcatggaattttggaataaggaattgatttctgaaagagggaaaaatgatttattgaatttatagaaaagagaaatatttgtggaatattggaaaagacattctcaagaatatctttgactcattgacaagtggggtcaacaagaaggtaatagagaataaaattgagagggagcaaatttggacttttagtttatgagtgatggatactgggcttgggcgaagggagtatatgtggacttttgtttgctttaaggggccgaggggaaggtgcgctgatgggccaagcccacaagcacgggagagagggggaggagtggggcgactgactgggcgccggcttgacccggtcaagtggggccgatggctgaggtggcgcgaacgtggacgtcacgtcggatggggaagggagaggaggccgggcagctcatcggacggcccacggcgcgcggcgggatccggcgaacggcggcgagccggaaggggcggctagcactggcggcaggagaaggagaaggggaactcattccacggctcggatcaggaagaggacgcgcgacgacggccggcggcggtggccaatctcgccggcacgccgacgtggccgcgcgcgagaagagcgaagggtgcgcgggctcgggcttagccgaaccggtatggtgttgcgacgcgcacgcggtgacgcgggacccgatggtcaccggcggcgcactcacggcgacgttatgcggcggcggaagcggcgacacggcgtggagacaaaggagaaggccgatggccttggggcagcaagggggaggtcaaggggatccccgggagcgtggcggcgagaggaatcgacgctagaggagccgacgacggtggattgcggcggcggcaatcaccggagagcaaaaggggaaaacacgacgagacgacgagggttcgattcaaagggatgggagcatctccgggg

SEQ ID NO: 67466 - DNA, 5628 bp, Oryza sativa
ggggggggaaaataatgggttggaaggacattggccgggggaggaaaatcggtccatccaaaatacaggaaggtaaagtagactttaacagagaaacccgatttggatagaattgtagaaatttagggtttggatttgaattcaaatttgatattcgaactcgagggtttagggatgtatcaagggaaactcaaggagaagtcatggaaaagattcaaaaggaatacttgggtatttgttctcgggaacatagggtggagtcaaggaaatgatttggatgagaatcgattctctcgaaatcgggagaaagatttggcaacgagttcaaggaagggagtgattgacttcaggaattgggatttggatgagagggaggagtcgccaacgggattaaaaaaaggggatttgaatctaaattttgatacttgtacacaagggttcaaggagacgagtaaggaaacaaagtgggagtttgatactttcgggaatgggaacaattatttggggaggattcaagggaagggattgactttcggaatttgattccagagactcgaatcggaagaggaatttttgaggtggaggattttgatttcgatgagagggaacaacgggattaaattgggatccttggcacaacttagactctcacacaaagaacgaaaattttcgcaattaggattttgccgagttagtttttaacgactcgcgaaaagcggagcgttacactaactctataaaaaatcaatttaaaaaaccaaaatgtatgccttgcaatgcgctgatttaggccatatttgttaatgctattactaatatgtaggtatgtcatttcacctaaaaatatatgcaggtatgtcacgcatttgtgatagacattagggacacttttatggaaacccatgtgtggtaatggatttcattcatatccctgtagctctgatgccaccgccaccgccacgccgcccaacactagctttcatgtaaacccacactatctacccccctcctcactagcagcggagctagctcctgggcaggttgggcggccgcccaggctccgccaccagcatctccaatgtaaatagcttttgatgcctgaaagaattagtcgattactgaaaaaggctagtactcgtcgggcttcatgacatctctggctctgccactgcctctcaccagcacctaatcttgaaaatctctggtggttcttgcaagagtttcaaagacgccagctttgagaggaactcgttgctgccgagtgcgcttcgtggaagttgcctctaacgtctcatgctgccatgtccctgtctttctcatgcctccccataggctggaggtagagggcttgtgctggccctcagatctgtgaccgatggcttggatcaatcaactgaatgatagcaaatatgaattaaataatagcctcaagaagtcaacaactaacttaatttgatccaagttagcatacaatagaaactttaactctcacctgcaaagtatgatttgttagtttcaagagattcagtactcctaaaaagaatgaattaatttttaagatggattcaaagggaaacaatattgagcacaatatttaaggtgtagtatgatcactaatacaggggatgactcactaaggaaaactccataggttgagttaggaaccaaggcacacaattagcaagacatgcaattttagctagtaattctcacaatttaaactatcactaattaatacatcctagctaggatacgccactaattaattttgcgagacttagttgccatctcgattacatccagtaggatagaagggcaagatgttttgaggcgaccatacccttcagtctccacaacatcatccaatctatttgatgaggcgataaatttaacacacgcttcttttaatcttccgcaattgtgctgatcagctagggcaacaattgttgccacattatcaacactaagactcatgcagagtgccttttcacaaatggttttcaatccttccacagcataacgatctgcagctacaagcagatgcttagccaactcctgcctttcatctctactgagatcatcattaatagcaggagagaaggagtccgtgtacataaaatgaagtagagccttgaacacaacaggttgcatatcctggatggctatccgctctcctctcttggccctcatcggcccgtaaagctccgccatgaacaccggtgatcgcgccgctagcaccacgctatgagcggggaaaacatctcctccaacctcgaagctcaagtcggctccgacattgtcctccagcaacttgcccaggtccctggacaagtttgtcggaggcacttggaagtggatgatatcacctggcatggcggctctctcctccgtcttcaccagtggtgtcttgatgacggtgagattgcactcaatcataagtcggtcgtcgcgcagataaaccgatccctccagctcactcctcctgatgaaattcttactaccccacacgagacatttgcttttgaaattagtcgtgccgaacactctccgtgtgttgttcgtagtcgagaccagaacgcaagacgagtcgtcggtatattgatccaacatcctgatgtcaaagatggttctcacctcggcgtccttggtcataagctcgaggaagacggagatgtagtcgtcgtcggactcgatgttgccgttgtggtagtagcggagacaccagtcgaatccaccgacgtcgaaagccgcggagcggatgaagctggctttgttgctgccggcaccatcgactgcttgcaggctgtatccgtgtatggtgaaaacgtgagttccccgtgctgtctctggcttgcaactcgatgccgtcctcgtcgtgctcgacggtctcagccgtgacgccgacgccaccatggttggagttggagaagaaagaggatcaccggacgaggcgacgtacacggcgacggcaatgagctataggctcgtttgtagttatcggatgcagctgcagggaagaaaaagttgcgttttgtacagctcgatctaatttaagcaactctctgctgtcagggagcatcgatcgggacgtaaactaggttaattttatgtcttggggctcccatcctcctattatactactactagtagtaaattaaattaccatgtagattaaagttcctctctccttattcggtccaagcttgccatacgctgcatatctctcgaatctctcgactcctcttcttcaccgatcggattctaagacgtcacaggaagtaattaagcgtcagcaatatggcatccatacattcatccatcctgcaattacacgacgagtaataatcctggttgatagacagaggtctctaattcgatggtcataatctatcactcgatcgtcagctaactgagctgtctgatctccatggttttgcagtgtccggagtgatttcagtacaaacatcaacagggtatgttctttgtcgggcattgggcatgaggttgatcagtggttgaaccccaattattttttctgaattttttctaggaacaaactgttgttctcaccggcgaggatgcggcggaagcagcagcatgcatggtctccggactccggtcggcgcgcgccggcgagatatggagatcggcgaaggtggcagacgaactcgatcgcgatcaaggacgtaacggggagatcgacgaaggaatacgggctagttacgcttaggatatttggcggtttcggtttgggctttctattgccgccgtccaaattaatcaaatacgttgggctagctgaaacaaattaaacccaaggattgctcatatctgttaaaccgattatgaccggcttaagtagccaagtcgaatcgcttctcaatggaaaaaggtccaatttgattacaagttggatttgattcgtatcactaattaaccgtaaaatcgggtatactactggcccctccagtgcaaaatgacccctcgtcttctttaagagcgtggttttccctggtgtggcatccacgtggcacgttaactgcctttttctaacgtggtgtctacatggtattacaatccgttaaaatataataaaatagtgggacccacatgtaagtccccaatcccttctctccatcatctccaggggacttaaaagaagttgagggaagtcgaatatcttgtgaggaggccttcaaaggaggagaaggcaagaaatgagaggaggtcattcacactatgcgtccgaccataattacctgccacaagcgcaagatagaaaattccttgcaatacctgtatgctacttccatttattacatgatttattagtatcattaaaattacataaaaatttaatgccaactccttttttgctataggttaataaatatgagataccccacagacatgtgtttacacccaaatttggcacctaggattaaaataggaaagattgccaaaatttggaagtctgccggtttcctccgagtgggccggtctgaccgtcgtgtgttgagcggtcaaaccgccggttgagggccggtcataccggcggtgtgtggccggtctgaccggcaggtccgagtccgactgtgtttcgtcgggtctcgaggtttccttgctcgagaaggcatgtttcaggtttcctttggtttctaccccgagctggacgtggaggagggcctgtagagggcaagaccaacccctatataagggacatggccggttcattgtaaaaaaccaatctacaatcaatcaatcgaatcgtttttcatattgcttttagttttctcttagtttgtccatctttgtcggtttgcgccgtaaaccatccgccgccgctgcgagagtgcgacatcactttataggtttgtcctgaaaaccttccgttttgcccacgagacgggtagttatctagaaatcggctccgctagccggttatttatcaaaacccatctaggtttagctctttgctagatcgaggtggttgacgactctagaatcaccgcaaggcttaaggtgctatgatcgtgcttgtcaatttgtcacaaaaagttgccaacacgatttttggcgactctgctggggaggagatccgttcatcgtcaactcaactttgacttcgccatgacgaagccgctatctaagacggaggtggagccatctaatgtgataccggtcgcattggaagacttcgaaggagaagatcgtaaagctatggaggagtacatcaacgagctcacacgggaggcgttgatgagagcaagtactaggactcgtcaaggcgtgaccatcaagcccggaccacgtcccaagctcgctcccgacgtggtaagcaatgatgaagtatcacaatctatccaacaacaaattacatctacaatagattcatttatagttgtttttaaagatcagttagatgtaatttttaagggtaaatttgatgagtttttaaggaataaattcggttctcttatggacgattagacattaaaagataaagcctctaccactgctaaccaacctcctatagatcaaacgggtggtaaaaccgacgggacggcgttcacgaccggtccgaccgggcctgacggccggtcagaccgcgacacagccgtcggtccg

SEQ ID NO: 67467 - DNA, 3061 bp, Oryza sativa
gatataattagtgaaattatgaggaatagattcgggattgaaactaggaatcgtgctagaacttacaaaaagccatatcctgattattatgataatgtgccgtttcctcgaaattatagagttcccgaatttgccaagtttagtagtgaggatggtaagaccacatgggagcatgtaggtcaatttttggcgcaatgtggtgaggctaatagtgatacttttaaattgcgcttgttttctttatctttatccggtaatgcttttacatggtttatttctttaccggcaaattctattcatacttgggctcaattagaagaaaaatttcatgattatctctatactggagaaactgagcttaggttatgtgatttgacatcggttaagcaaaagtataatgaatctgtcatagattatattaaaagatttagagatgttagaaaccgatgttatactttgaatataaatgatagagatttggctggtcttgcttttaatggtttagttgctcctcttagagaaagactagatggccaacaatttcttgatgttagtcaactcatgcaaaaggctctggctcaagaaagccgggttaaggataatagaaaacttgctagaccatttgacaaaaagcctaatgttaatgtggtcgattaccctgaggctagtgatagtgaggaagagggtgatcatgatatttatgttgccgaatggtcatggactaacaaaaataagccttttgtttgctctaacctaatgccgactcctcgcaaagatcggcaaagtaaggttaagtatagttttgacgtggccaagtgtgagaagatttttgattatcttttgcaagagaaacaaattagattacctaaaggccatgtcataccttctcaagaagagttgaaatgtcgagcatattgtaagtggcatgattctcattctcactctactaatgattgcaatgtgtttcgacgacaggttcaatcggccatagatgaaggacgattgaagttcaccgatggctccaagatgaagcttgatcatgatcctttttcggtgaatacaattaatttcaatgataagaaggtgttgattcagccggagcaagccaaatctgctaagggaaaggaagtgatcattggtgaaccaaggtccaagatgatagtgccaaagaagccggaggttggcgtttggaaggagaataggagtggagcttcaacttctaaggcccctaggaagaccaaggtgacttttgatatgcttttggagaaatatgagaagcaaggtggtgagaaaattcgcaacaaagggaagagaccaagatcacctcctagggagcgatttggtcattcaccaagatggtcgcattcaccttcgtatcattatccacaagacatgtcatggggttcttatccaatgccgccgccgggttatccttatccttgctttatgccatggggggcaacaccgccaatattcaatcatatgcctccaatgtgattcaaccaacggtggggaggaccacggaggccaattcatgagcgtttgtcttcaccaagcaatagctgatttatggtaagaatcgggctaatgaagaaaagagggaaggaaagcgcgtcaaggtggaggagaggacttcggaagtgattactattaaagtggggtctcatgatgtgccaatacctactggagatggaattggaatgtccccgaacagaaaatccgaagccggtaccagttcctcgcagtcggccggtctgactaggccttctggccggtctgaccgcggtcgtgcggccggtctgaccgggccattaggccggtctgaccgccgactcgatagcggtccgaccggcacctcaggctggtctaaccgtgcgcccagtgtcggtctgaccggcgcatctggccggtctgaccggtggtctacgaccggtctgaccgggctccagcgccggtttgacaggaggattgcaaagggcgatgtggagacttcatcatcttcaaacaaagttaatagagggcattatttacctcctggaatagagctgaatcctaggtggatgcctagggatttgacggctactcaaaagagaaggttgcaacgtctttggacccaagagttaagagagaaagaggccgaagagcaaagagataaaaggttcaatgagttgcgacccccactggtttgaaggcctaaatccatagagaaggcaaaactgattgatgtagaggaaaaggaagaacaatcggttgataaaagtgaaccatctccaaaagaagacatagatatcaacatggtatgtatgttgcctatggagttttgtgctatggatgaagccgaggttgctcaattctcattaggtcctaaagacgcggtttttgagaagcccgatgagtcaaaccgtcacatgaagcctctctatctcaaaggccatgttgatgggaagccggtctctaggatgctagtagatggaggtgccgccgtgaacttgatgccgtattcgttattcaagaagttgaggtgtgaggatgatgagttgaagaagaccaacatgattctcaatggctttaatggtgaaccaacggaggtgaagggtatcttttcggcggaactcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacggcgatgatgttgaaattgttcaagcggatacatcggccgaggttgcaatggccgatgctacttttgagtggcatcatgggaatatccaatgcttatcggggagggatctttctagttatgattttattagtatctctgatggcaaatttgtacctatctctgtaaagtcggctagtgtagcacgggtaagccatataaatttgtataatgagtaaagaggctaatttagagtggttaaaaaaagtgtgcaagaatatcggtttacaaagaacgatattggtgaaaccgttgaagattttgatga

SEQ ID NO: 67468 - DNA, 1421 bp, Oryza sativa
tgtgtactcagtttaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattacgcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgtggcccggtagtcgagatgtcatggcacagggccagtgtcctgctgctagggggctcaattctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttgtcctgggatggctagggacgagctgggacccagggtcgggttgccaggttcggtctgaat

SEQ ID NO: 67469 - DNA, 3153 bp, Oryza sativa
  unsure (1)..(3153): unsure at all n locations
tccaccatggcctccaccgagcgtcgcccctcttcgacacgcgcccacgccgcgtcgagctccgcccgctctgcctgcaggacctccatctgggcacttaacccgtccaacaccgtggtgttcgcggcggccaaggcctgcagaaggggctccgcgctcagtggggcagcggaaggcgtgggggagagccgcctcggtaaggatgccgcacggctcggcccaccgatcgacgtgccgaactcgggggcgtcccccgaagcgggctcgtcccgaacgtcgcccgaggggtcgggcccgagcggcgcgcccgcggcctcgtcgtgggcggcctcggaagtcgttgtcgcctcgggtggagtcgggtcgggggcttggcaggccgccctgcgtgcgtgtgccgcctccgtctcccggacggactcctcggcccggcggagtctggcctcctcccgagcggcttcctcagcctggcgagcccggacagcctcctgggcagcttcctcggcttcccggaggcagtttgcggcttctcgccggtcagcttcccgcctccgggcctccgcggtcaccgtctcctcggcctcagaccggccggacttggaatggcgggaagggcgcgacgggatctcgctgaggcagaagaaaaaccagaagacgaaaaacaggtgagtgaaaacttgccttgggagatgggagaatgaatacggccgcagtgggcgcggggacgaacctgcgaggaggtcggctaaacgaccaccttgggggggagatgaggtttccccggcatggttcggtcccccccccatcttgcggagccgctttttttttcgctccccctcgggctacgacgtcggcgcagcaccctccgggtgcctgctgctggcacgcaccgccccgccccctcggggaggagatggggagggggtatcctcctgtttcctcttcccccgggcgtcggcagggcggctgccccccgggcccccgtcacggggncccagaagcacgaccnccctcccgaggtagattgggttccacccctgcggctcccgctcgcgccatcgtggcctccaggaccccgctcccctgacgccccgaccgcctgcatgatggtcaggatgttagcgcgatctggatcgctgcagagggggagaacgcctgagggatgagggatgcctccacggagctgagattcagcacccgttggaccactatcctgaagtcctcagggtcccagtcccatttgcgcccctggtgggtcctcatgtagtcctcggacccggtgtactccccggcggaggaggagcttgagagcgagtgagtatggcaaggtagggcgcaggaaacggagtgtcagagcacaagtggcgaaggcaaggggaagagtggcgagaggaaggaaacaaatctcttcctcggcgtctttatacccttgccaacgctatgcccggctcctcgcttcccgctcccactatctcgccccctcgtttctcgcgcccactcctccactaatcccgttcgcccgtttgcggcgcacgaggcggatgtgcggccgtggcagtcaagatgggacatatcgtgcgcgcgttaactacgctcgctgacgatgcaccatcatcacacactaggcgaaacgaaccggttcgtcccgattcgcgcgctactcaagtaatgtagcggtcttgaagaggccgctcattattgtcgatcggtttctcccttgccgatgcgcgcgatttgcgaccgttgggtttctgcccgcctgtggggaccggccccacctgtcacggggcctaaggagtggcatctcgcccgatcgcctccctcgaggggggcggtcgccctggcgtgacgccggggctactgtcggtgacatggggccgggggtatcgtgactagaggcttgggtagccgcgatcactcacgtggcccgaccccccgagggggtcgggcccgacggtgacatggccacccctccctctgtctccccgaggggtcgggccgctcccgtttcggccccgagggctggggcgccccaaccccctgtggtgttggcgccacgtgtgtgggttaggtgagcatagcggccctcacctaaccacatttatagcgggttagacgagcgcgtcacgccgcattcaatgcggcgcagcgcatgcttatccggtttgtgaccagtcgcggcatgtgaccggtcacagaccggtcagatcgcgggttaggtggcaacaggcggcctgtcgcacgcctcgccccgtcccgtcggaatgatgagagcctctaggcactcgtccctagacggagctggcgtgggaactcctggagttagcacgtcggtcccggctagattcataccaggcttcatcgcaaccattccaagcaagtcattttatgaagaagggctaacgcgtggcatgctaaactgacgcgtggtagacaagaatgaccggtttgtgactggtctgacgccggtcacgtcatcagcaaacaaccgtgctcccacgttgcacctgcctccgtcatctggaggttggtatgacccatcccatcggagggtcattcggacagcagccattgcaaatctccgcccataaatgaaggaaggacagggttatcccggtgtgaggcgaaggcatgagccatgttttggtcaaagtagaatgggtccccacccaaaagaaggataggtagaaatggtgtatgtggtatccccttgagatataaaaggaggaccatgcctaccaagagaggagaaagaaaaaaaaggagaaagaggaaaagaaaagggagaagaaaaggagagctcgtaaaaggaagagcggagctcatagaggagagagagagggagagggtctctagagtttgaactctcttgctctccagctctttgtaactccttcatacacagatccaccagaacacaggagtagggtattacgcttctcagcggcccgaacctgtctacatcgcccgtgtcttgtgcatttgctctctcgcgaaacattccacaaatcgagggcttagaacctcacctagcgtccccggccgaaccggcaaaggggggcccgcgcggtctcccagtgaggagccccacgctccgtcagtgtgtataagtaacttaagatttaggatgctgattcgggatgtgcataaaat

SEQ ID NO: 67470 - DNA, 10410 bp, Oryza sativa
tttgagacgggtcaagatggagaattgcaagccaatttcaacaccaattggttctacagctgtgctggatcctgataaaaatggtgaagctgttgatcaaaaggaatatagaagtatgattggatctttattgtatctaactgcttctaggccagacatacaatttgctgtgtgtttgtgtgcgcgctttcaagcttctcctcgtgcttcacatcgtcaagcggtcaagcgaataatgaggtatttgaatcatacacttgagtttggaatttggtattctacttcatcttctatatgtttaagtggatattccgatgctgattttggaggttgtagaattgataggaaaagtactagtggaacatgtcattttcttggtacatcattgattgcatggtcttctaggaaacaatctagtattgctcaatcgactgctgaatctgaatatgttgctgctgctagttgttgttcacagattctttggcttttatctactttgaaagattatggtcttacttttgagaaaatacctctcttttgtgataatactagtgctatcaatattgctaagaatcctgttcaacactcacgcacaaagcacattgatattcgttttcactttttgagggatcatgttgagaaaggagatgttgagttgcagtttttggacaccaagttgcaaattgctgatattttcactaaacctttggattctaatcgctttgcttttcttcgtggtgaattgggtgtaattcatccttttggcatggtttgagggggagtttgtacctcgtggttttatcaagcaataatatgacaatgaaaaaattgataaaagagagctttgtttatgcatatggtattttcttgtgcatgctaacaatattttgaaggtgtatttgtctatagcatagcttgtatgtattctagtcttttcatgagatttagattttgcttttaagggagatgatgcataacacttaaattctacggcctttttttgggggaaaaaatttttaaaaacaaaatatgcaatgttgatgctagcatatggtttgatttataaatgctctatacatatgctttattgacttgttattcctcaaatacctttatttgctcattgtgaaaaagagaataaaaatataaaaaaatgaataccgaatccttggaaacagtcttgacgacaaggacgtattcgatgtgagcaaaataatgggtgccgaatccctggaaacagtcttgacgacagggacgtacccggaataaaagagaaaaatatgagcaaaaaggctcaagaaaagaaaaagttcaaaaaattctctggttattttgtgctaaaggttatttgagaaagagtgataaatgcaataggtatatgtgtttagtgtttcttcttcaacctatgtgcttgttaagatgttgcattataaatcgtatgaaatcatgaattttgattgttgattcaagcttcattgtaaaatctttggttcatggttatactttaatgcatgcttgttctgttatagatgggttcattttctttttattgcaacacatgacttgatatgctatatgtatgctaagctcttgaacattaatgaacataattcctatgcttgatgaaatcattgtcaaaagggggagacataatgtgaaaatttttggatttttggagaagcaaagtgaatttttgagaagagcatgtttttggttcaattgggaatttctttcttttaaaaagggagagaagttttcttttggatttttgagcacgatgtgtacatttgtacgaagtgtgctttttaccaccaaataccaaaacatttttatggatttgccaatgtgttcatcaagggggagattgtaaaatcaatggtgttttttattattattctgtgatgaacaattgggcattggaaattattggttttgttatttggaatttatttattcacgaagtggttttggagatgattggatttcacaggtgaatatacagatactgctgtgattttatgtagaccggtcagaccgggctctggtagccggtcagaccggcgtgtaatgcgccgtcagaccggcgcagcctgcggtctgaccggccgacactgtgtcggtttcggtttcgggttgtttatttggatatccgagtttattccatgattatgacttctagatggatactatacgcatgtaatactattgtttactgctaatgagtcaagttggagatagcttggtctcggaatatggtttctttgtttgtttcatgtgtaggtgactcgatgtctcgggagagtatttgcggtgatggaccgggagtcggcttggggataagacgacgtccgtggtggtcagagatcatgcgggatacttaggctagagttgatgcacgtggttgatggagattccatatggcatacgatggaggaattgtgtgcgtatgggatgcggagtcgaatttggaaagagtccaaatttggtacgattggttatgtaaagtttctttcttgtactagtgggtttcctaaggtgtttaggactcctaatatgagtttggttcatggctttaggctgcctacctcatgtataaatagagggggagcgtgaggcttcccggtatcgctttagagagcaattgagttaagttttgagttagggtttcgagtttagtcgaaatttttgtaaggagtgttgttggtgcactttgtaaacacagagagaagtaataaagtcgtcatctactttaagagttcttcgatttgtgtttcaccgggtttcggcggtttaaccgccgactcatcggcggtccgaccggcggcaaggcggcggtcagaccggcgggagcaaggcggttggaccggcggccgcagcaggcgcgacaggcgacttcggcggtcaaaccggtaaatctataccggtcagaccggcgacattcgagcggtcagaccggcagatcaatctcggtcagaccgacttccatcgatttcgagggtaacttttatttccgctaaaatttcttggtttttgggtataccaaccattcaccccccctctggttggcttagttcttgtgattcgatccaacatggataaggagtgtgtgttgggttgatgaatgatgaggagcgctgtgctcattaagtatcttgtctcctccagacaggatgccatgatgtaggtttgtgtgtattcatgtagcttgagtgattttcaaaggaaattgcaatctcattgtaatttgagtatgctaatggccaagaattgtcttaaaaagagggaagcaatggagtttgtgtatttttgaatggtgtgttctgcacttgtcacaaacagtgcatatacctctatagataccaaatattctagaaataattaaacacaacacttgcacacccatactcagttaatcttttaggtaaaataggctgtccaataagcaactctctccaaagatgtaccccaacaacagttctggcactcagtaccacaatgcaacaacttggctagtgataggtttcttgcttttaggattaaaagcgaaggccaacccaaaattagctatcgtaagttccccatcttcattattcaataatccctccaatttatattataagtcattttgactttttccaaataaaatttgatcatgattgtaaaaattgcagtgccaattttgtaaaagaaaatacatgtccatttttttagtaagtgatcttaaaaaagtgaaatcaaagattgcaaacaattttataccgtctatgagatctttcaattccatgctaagagcgacaagctcaatacaagtgaaaattaatcctatcaattgattttacgtttgctcaattttggaacttataaatatcaagacttcaccacagtttttttaagtagtcaactaggagaatccaagcaagctctgaaccatatgtaaccaatttcaaatcattagcttaaatatggttctatcgaagtataaccattgacaattttccgagaatgaacctttcttgttttagtgccatgtttgatatcaacaatgttcattattcgagaaggcattctatgttagacattaaggatctgtttgaaacacaagattgagaaagtgaaaatagaaaaagacatgattttgataggatgacaagtgtaaaaacataggattgcaaaaacaggaaaaacatgaatgaccgttacaatagaccataggaaaaagcaaaaacaattagaggagagataattaaagactcaaattaaagtttccatgaggatgaacctcactctagcttttttccaaaacttatgtggctccaagcatcaaataggaaaaatttcctataggattcaaatttgataaatttctatgttcttcctagaaatcaaggggctctatagctttaccctaggttgattcatgagccccaacataggctgcatattctatgttgagtcctattgaggttggattattatgaaattttgtatttcaaagtcaatcatttctaatgtgaataggtatctgatctttcaattggttcgatttgttgacatgaagatattcacattttgaggcttccgatcagacgatcatcacttgtaatcgctacaccccgcacttctcatcgttattgaccactctctcataattgacctcactaggaaggttatgtcctataaacattcaaagaaattcacaagaacaaggaaaagtgaaatctgaattgcagatgaacgattagcacttgaaattggggttgcacaaaccgaccttgcggcaaaactgcatagtgacagaacaatctaagcaaaacctaatccctaaatacgatgatggttgtctagcagtctgaggtcgtccataacaaaggctaactaaacatgactcaattagaacacccaagggctaaactatatttggaccgaatgaggtatgttagttgtttcgcagatttcgagaagctcaggtggaattttgacgtgagactataaccatctaaaagtagagttaaagacctatccaatctggagataatattggcaaggggatgatcataagaaaaggtgcagacttgctagatgggatattatttgccaatccaaatatcagggtggtttgggggttcataatctggagatacaaaataaatgttttttgagtaaatggttgcttaagttaataaatgagcaaggggtttggcaggacttattgaagagaaaatatctttataatcagtctataacccaagttgataggaaatagggtgattcccatttttggtcaggtctcatgaaagtcaagagtattttcttgaatatgggttctttgattgtgaataatggggaacaaacaagattatgggaagataaatggttaggtaatgtggcttttaaagataagtatccatcattatatgctattgttagaaggaagaattcttctgattgtttttcatggaactttaatcagaatggacggttctctgtaaggtcaatgtatctagttttgattaacaatggctatattgaaagggataagataatttggaagcttaagatgctgcttaagattaagatttttatgtggtacttgcttaaaggggtggtgttaactaaggataatttagcaagatggatttggaatggtagcttaagatgttgtttctgtatgaaaaatgagtcaacacaacatcttttatggattatcattatgcaaagtttttatggagagctgcacagttctctttttgtttatacctccctattagtatatctcatatttttgatgggtgactgttgggggtggacaagaaaaggagtaaacttatattggtgggagcttctgcaatatgttgggctctgtggttgagtaggaatgatatggtttgacaaatcaccatctatttcttatatgtaggtaattttcagggcaacatattagctccggttttgggcacaactacaaaggtgtgatgaatacaaaggtgtgatgaagacggtgagtttttaaaagttgtatgtcgtaagcttgagatgacggttatgcagctttttgccaattatggatggagattcacaaatatacttcaataatgtgttctcctgatcttgtattggttaaatttacctttgtgtggtcatttcattctatcatttttgaactacactcgttttagagtgctagattgtaataatgggttgtagctctttttgagcaaaggccaggatgtttattccattatctaaaaaaagacctatccaataattatttatgggcctaacaaatgcttctggattagcagctaggtccattttaatttgatgctgccaggagggtcgaattcgagtccgaaacatgtaaaatactatctcttgccttctagcaccttagtaatgtagtgacatggaaaaatactttggggggggaggggggggagaacttcagatgttcctaatcaacttcattgatcattcattgtctccatgtgtatgctcacctttgcttgataaatgctaacacttctgaaagggaagatacataaaattcatggtgcatcattctatgtccaaacatatagaaacaaaacccaatataaaacacatgcacattttatattatcgtgttgatgtggaacatgggaatggtcatatctaagccggtgatgttctcatcaattcaattctaggaactgtgcctatgccctaggacaaattttactggctatatttgtgcttgagtccatcttcctcctttctgctgcccattattttccaatggtcggaatgagaagtactataatcttcactagaaccattcttcaacacgacgacatacacgagactggtatggccatgttcaatttagattattgagcacattattgtcaaggattatctaataggctatatgtatcaattaaatatttcaataaataaacttaacattaaaacaagtggtctaagcacaaagtataaggaaataaacataataaatggcttaaaacatatttttttttgaagtgtggagcagatgatccaattcaataatctggtgaatattgttaagttaatgtatttctaccttgggccccacataggacttaagagtttagagaagtggttagccaaaaggctactaaggattgattgtaaggaaaaaaaatcataaccgctcaagagcaccatatgaggaaacaatgtgttattgagatagccttttccaaaaagaagcatatataactgttaacgccaaaatttggtaagcccaaagtcttcatcggcctagagtcagtatcgtcttcagagtcttggaatcggccaatgggagttgtcaagtcgccagcagttgtgttcttgatggagtcggatcaattaaaggaagcttatctagaagagtccgagttcaaggaggatgcgacatggcagtttatctattaattaggcagtatttgttagttcccttttatctttaggaaggtgtgtttagtgtccgataaggactttatgttttccttttatctctaggaaagtttctttcttgtcctataagaactagtatttacccatgggtataaatatgtacacccagggttattgtaatcaatctctcgatcaatacaactactctcggcgcatcgccaccctctttaccgaggtttttatttatcatctgacggaacttggcacctgacgcggggctgtatcggctttcgatatccggcgaaggggtaactcctacgttccgccagccctggtgaatttatcggctacgttggtgttgttcaaggctgcatcgcttcgatctcttggatctctctggtttggttgatatatttgcctacctgatatctcaattctatctctaattgcattgtgtttagagacgtatcggtttagttgggactgtctcggttaggtccgatcttctgtcttagccgatatatctctacaatcacaatgttgttgtaaatagatttgttatatccatcacattagacagatctatcggctcatcgagtattagattatcatatacaatctcgtgctgcatcggttaagttcgacctactagattgttgttgataatataaatcttgttaagccgataggttcatgctagtgttttatcggggtgctagccgataagttatctggacgttgcatcggcttataaggattacatacaagttgggtttagccgatcgtaacaaaggtttcactgtttaatctaatcttgtggattttatgacatcggacctccagccgatatatactttaaccttcggatcaatgcttatctgtcatatcattattagccgattggtttctattggattatattattgttatattttattatcatcagtcgattgtcttcatatcattatctacattgaacatatagcctattgctcaaaaccctatcgacattgactggaatcggcatcggctattatcggctatcggctggaactactctatcggcttatcagccaatcggctcattgatctactgtttacatatcttgtcagttgaaggatcaaactgactggcacgcccgcacctcactaagatttggacctgcacaggagctaagcagatctcccaggccagtgtgtgtttttcgcgttaacaataacacaaaagcttcaagcattacctcgtggattcaaaaccttagaatactttagggtaaaaactgaagcggtttccacaaaattgtgaaatatttcttgttgggcgtaagaaccaccaacattagggtaataaattctttaattctatcagattaattgtccatggatttcgagggttggtacctcttataattaatattcacagctcaaggaggggaaacaattcattgcagtacaaatcataagttgatttgtacatttattatgtagattttatatctatttccattaatgagtacctcttataactctttctatataatggagttccatatagagatacgatgctcctacatttcaagatgtctaagcataacctaggattatctatccatgttatctatatcatgtttgctgctcaccaaatcctgggtggaggatttcatctgaccaaccaagatgtgaatatggtaggcctatgtttattttactttttagtattttccattatgaactttgatcgttttgttttgacatgagcataattgcaaactcatgcccttttgatgatagaggaagtcaaattggaaagtgcaatttgtttcgatgtatcgatacatatatggcttccttttctaaatcttctactcctaccatatgtggtttatgatgaaatttaaccaagtgctaataagagtagtttgcttacttcatgctataaatgccttttcatcttcagacaaggtttggaaaatctttgcaatcaaaagttggtgatgccacaaagtcatatgtaagtatatatgcacaaccattgtgttttattttatccttatagaaattattttccatgattttttctctctatttcttttgcttgtttctacagatggccatgcatcagacatatgaggggacctactttgggtttgttgctacattggatgtgtatggatttgagattaattatagccaaagaatcatatcatcagtatggattgtcaacagaggtcccaatgacaacctagaagagaatgcaattaggattggatggcaggtaagcagttctccttgaaaaagtcagtaatcttatgtttatgttttgttcgttttcagcattaactatatcacattttttctaggtttttcctgaattgtacggtgactcacacacccacttcttcacttattggacggtatgattttctctacaactcaaaaattatattgcttataaaacatgtgtggccattgacctttttttttttttttgcatttgaaatagagggactcataccgaactacagggtgctacaacatgaggtgtccaggttttcaactcacacttggatcaaaaataactcctggtgatgtcataagcccagtatccgatgttgatggagcgcgacaaaatattacaattaaagtgtctagggtaattaactactccctccggttttattttaattgacgttttggacaatgacacggtctacaagatacatgtttgatcttatttttctattataatatatataataaataaatgcatgtttatttttattatagtactttaaaagaaaaatttatatatattgttctagttcctttaaactaaatatttttaaagttatcgatggtcaaagttataaaagtttgacctcaaccttgtccaaaacgtcaattaatatggaaccagagggagtaaatatatatactacaaagcataacttccatttatatactccccccttccctaaatatttgacgccg

SEQ ID NO: 67471 - DNA, 3500 bp, Oryza sativa
tacgctgtggtggtgagatcggtatgtatacagcacaaccgaacttacgcaaatgggaaatacttggaggatctccatgtactaactgcattggggaagtttcatgatatgcagttggtcgtagttggacaaggtcagcagtgtgcagaactgcatgaccccaacacgacgaaggtaatttgcaattcatcaataatggtcaagaaataagcttaattcttttgatcagcgattcagccaaaccattttgtgtgtggacatatggaacaaagtgctgaacctgaattcctaatgccatacaataatcatcgaaagcatgggatgtaaattcggcagcattgtccatacggatcaattgaatcctatgttcagggtaatttgccttcagccttataatttgtgacattaatttggcaaaggcatggtttcgtgtcgctagaagacacacatgagaccatctagtagatgcgttaatcaaaaccataaagtacctaaatggtccagatcttggcacaatagggccacagatatctccttgaatgcgttcaaggaatttaagtggttcggctctagttttgagataagatggtctcaaaatcagtttcccagtagcacatgcagtgcatacgaaattagaagatttgggaaatttgtcagtgatcaaatgatgaccaatagagttgccaataatttttctcatcatcccgataccggggtgcccaagtcgatcatgccaagtgtggaatgcatcaacattttgaaaaattactttgtatgcaacatgtgcaatgggcttaatgtatgtatagtacaatcccgatgtgagagatggaattttctcgcaaatgcgtttgccatatccgttttgtttggttaagagaagaaattcttcttgattatccatatgggtttcaatgtggaacccattttgacggatatctctataacttagtagggtacgggttgaatcaggatacaataaagcatcctcgattgtaacttgtgtacccattgggagtgtaataattgctcgtcctgagccaactatcacagtatcgcaccagcgatagtcaaaactttgccttctctctttttgagagtttgaaagtatttgatctccctaagtatagagtttgtggtactactgtccacaagacataattcctctccaatcggagcgatatccttagacatctataatgaaagaagaattacttgattaagaattctttatccaatatatatacatacatacaataattaaaacatcaaatatatagtatgacgtttacatatgttaaaaatacatactctaatgactagcaagccatacaaccttacaatataagggagtttgtacttatatacttattacaaccaatattgtttggcaaacttataggatatcaatatactgtttcaagcacactgagataagagcagcttcatctccaagtgggacgcaccgagatcattgcaaatctccaagtgggtccgttgagcagtattcgatgaacatatcgtccatcgtagagagtggagcgacatcttttgggagaacattgaggttgctctctgattcaacaggagcctagtgagaacttgcaacctcagggcgctcttcatgtgtaagattgaagtgggcttcaaatcttgggttctcagaagattttttttccttgaggggtttttggtacaagagaacaagatgtttcaggatgcggcaatctttagcgacatgagtgttagatccacacctgttacaatgcttgttgccattgctacgaggttgtggtgccttacccttcccttttcctttctttcgacccttgaatttgtgcctgttattgttgcgtttgcgctttccagtcagattcttaggattattcgaagaatttccctggaatcctttcttattctcagcattattctgtacattgaagtgcacctcaggcagtggagcagagcccggtgggtgctgttgggcattctttaaagaaagctcatggtgtctttctgcctgagtcaatgtatgtataagcagagaatgtttctggaaattgttagcgcgatactgttgagtcagtatcctgtcctccggaagcatagttgatagagttttctctatcttctctgcttccattgactcttgttcataaaactcaacctggagcaaatgttatgaacatcatggttgtattctgccacagttttaaagtcctgtaggcataaatgtacccactcataattagcctcaggccaaatgagttccttttgctgatcataacgctctttaagagctttccaaaggttgagagggctcgtctctaacatgtattcatgtttgagatccttgtaaatgtagagtctcaaaagaaaaaggttgtattgagcttcctgggctcaattgccggatccccatcattgggttcctcaattgtatttaaaatcccccgagaggcaaaattgattttgatatcggaagcccagatgggatagttagtcccatcaagggcgagttcgtcgaactcttttgttgccatgtccctacaatcatggttaacattatcaatttacagaggtaaattaataaaaacatgatattaaggttgtaatctcaatgcgtaatgtaaaacttcatattttgtaatgtttcgaaaaatgcaggtaatagacctggcaattttgagttagaattcgaaattaggtggcacaatgtggataatctccaagtaattaaacagtggagtagatctcttaatagtgggcaagttatacttgctacctaaaacacggtctccaggcaaatacattcttatgaatataccgcagccaatgtttgggactccactaccttgtgttcaaccaaattttaaataatctcatttttcaaaacatattctcgaaaaataacacatgtgggtaatcatcgtgagatgtagacctctgtgagatgggcgaaatgctcgctgcctaggttatgaccagtgcggtcaatttgtaggactccatcgggtaatcatctcagaatgtagaccacttgatgattggcgagatactcgctgcctaagttatggtcgatatgaccaaagtataggactccatcgacatgtgattaatttccaagtcaaagtgtgaagtggaacatgcattaaatcctccattaattatgttgtacataattaagagaatttgctaaatcaaaatacaaaatttatagaattttgtaaattaataaagcgagaaagtagagcgtgtcttgaaataatatgcaaaaggcatgttattaagacaacaaataaatttagtgaaacagggtatttaaataaacacctatgttaataaacacgtaacatcagtggtctataggaccattacataattgtttgtacaactgataaactgcttcgactaaattacataaaacatagggactaaaatgtaattgctgctaaaaataaaattaaaaactaaatttaaatgataaaatgggtggtggg

SEQ ID NO: 67472 - DNA, 15129 bp, Oryza sativa
gttaggaaaaaacaggaatattatttgtggaaaatgattcaggctctgaataccatggtgtgtgggtaaaagagctacctggaattctactacaatcaattgacaaagccccctcagtaacaaaggtctgctataggttatttatccagtatagagttggaatactcagattgggcattaatgaaaccttttcaataaatagtgtactttatgatcatatgaattatcataggttgttttggagctacttctaagaattggacagtacttccccacaatggagtttggaaatctgcgttccttcattaagttatttggtgttaaatgtaagtataaaattactggttgaagatcttttttatcctctatgatttatcgctttatgtgtaattccatttttcttggactaatgacattttgctaatagcatcatcaggaaccatagagcttggtccattcgttaaccttccacgtgattgccaagaacttgccatttcatgcctttattacttctccaacctgcttcccgacacaatggagctgttggcttcttgttgcttaagtatgcatttttgcttctctgttctgcgtttagtgtcgttatattctttcctttaaggattacaggtggtacataatttatggaatgcaggtgatgtgctggaacccaccatattgtttagaattattgaggttctacagtcaacatacaaggctgggaatttacatataacagagcaactcagtttcttgtcattgctaatggcacgattcagagttcatcctggtgagtacttttttttttggaaggcaaacttttcttagtttaagtggcttactttaggtgaaaatttcatactatgtgttttgctctttaagttttatcctctaatggttattttatctgacatttttttctaacagctttccttttgttttgttaaactagggtctttctctacccaggataattcccagaagggctcaaatatgaatacttttaaatcattgaaccgcctaattttaaattctctatctgaaatgggtgatggctccctggttcttgagttaatgtgggataatttatctaaagagattgtgaggattcaaaccatgctatgtttttatgttttcacccaaaatccattgaactcatatatgtttgttttgtgcaggcacagataccatctttacataacatgaatggattgtttagaattattgtcacacttgatgcaggaacttgtaagctcatgaacgaagatgctataaaaattatagctggctacttgattgatgctgctatggtgtgtactcttctgaattctaaagctctggactctggtatttgcagtcagtaatttggtaaatttgtacgctaattcaggagaacgtagtcgaaaatggcagattagtcgaaaatggcagattggcgtattttgatgttagaaaacctattgcctatagatctgatataatcggatctaacattattttatgcatattctttgaaaactatgagagttcactaacagagcatatttacgtggtagcatagggagagtatcgtgagtaataagctcttcacatcacctggtgaagcgcagagtgtcagattgaatgcattacggcataaacgtttttttcagttacactagcttatggatggtaattatgagtttgacacctgcaaagcttttggcaaacaggtgcattaattcattgtcatataaattagaagcgcatctccttgattagttcataagcattgctttatcgctgtacttttttgggttttgatgagaattgatttcacccaattttattgtgtacatgcaggatttgtctaaaaccattgagcttggctttcaatctgataggacaagactatttcaatactttataaagccttgcataatcatattttgccagaacgagaaggttctttgctgcgcattggagatgcttaaatctttcgcaacaggagatgaccacgtgctttcatctgcatccaagttaaactacccaggagagctttcacatcgaatttgtgttgtcacaactatactcatattcttatgcaatgatggaaaactccataaaaacctttctttgggcaaatgtgttattaaaggtatcctgcaacatacaaggcatctcatggtaagtggtgataacataaatgcctttgtttggtagccatattaactgatgagatttcagtttcctacattttagtcatttttcatattaatcttaaattcagggaggtcagaatatcaagggcaaaattgaacatttgtgcatgtgaatcgtatgtagactagtttgttgaatttgttcctactatgagagaatatttgtcctgtgctgtacctagatcactatcactagcttgctctattatgcctaaatgtcgttgttgtgaaactggccttcctaatgagtttgctctattcaatacttgctgcaggattctaatgttcttgatgtaacatatgaggacaagcagaagttaagatttgcatttgagcaactaaagacgaaagcattgcagttgaactgctgggacagaagtgagctggaagggttttcaagcaccacgtaaatagtaccaaatactaatggtatgtgggctccttcgtcattgtttgctaattatgttgatttattgtttttttttaaaaaaacgaatgaacttacttccatcccatatgataggtactgccgtaatgtgaaaccttactctgcacgggatgaaaattttgacgaactgaaggtgaagatggagagtggacatggtgactggtgaggggcagaaggatatgtgccatccgacctgcgtcagactccagtatacacctctgctgttcagctgttaccaacactttacgaaggtctgtactttacccaaagattaatttcacacttcgattctatcttaatcctatgtttcccaaacggtctacgatttgccataaacacacgagtttctcaggagcactaggtagatttgtcatgtttgacaacaacgtgcctgacagtaatatcttgctattgcaggtggccggaaaatgcattgttcacatgttgggaacgaggtggtccactggtccatgtatcattgtggtacagcgcttggttttgatgcaacagaattgcagtttagactgctcaatagaccataggttatttcaccgaaaggtttacatttcaacctacatgtccatgtaagaatcccgatgtaaatgtagaaattttgttttggaagttcatttcgggcctctcatgtcattgtttccacttcctgcatatatacttgtttcaccgagacagcctcaaagccattttcatttccattcgcctggtcaacgttggcaaaggccataaggcagtttccaacgtgcttacactactgcaacttacaaccatatccatcacgctggtgcaaccacatcccctacacacaagctcacaaatcacaatgtttgtctgcggccttattctatcaactcattcatttggttttgggtaatctatcaattcattcatttggttttgggtaatcaatggtgtatgatcgggtcgccattttgggtagcaaatgatgtagcttatcacgaattcacgatagggcatggctgctatagtgccatctactccctggacatatagtactacgaatctggactagtcccatgtccaaattcataatactatatacgcagtatcatctacgacgggcgtacaggctgctgctgcgtgatgcagtgtatgtttccccctgccagcacgatctctcttgcgccttccaccatcaccacctgaaattcacgggttccgtcagaacacccagcacagttttgagttctgacgtcgtagccattgccgagtaacaaccaacagccactgcttgcttgagctgtggtcgctgacagacagaaatcacagcatcgctggataaagtttcgaagtgaaatgggtcagtgaagatcacctcatgatcaggaaatgccttctgaagaacagcacacgcttcttcgtcccacttgtcgccaaaagctggtgctacaattccgccattggctatgtagaagtttacgtacgaggcagccaatctcgtgcctggttccctcggtatagcatgctcctagaaaaaaaaaggactattcattcttagaaagggatgaacacgctcattttcaatggattgaagttagtaatgaatatgacagaaatactgactgtttttacaacaccctctgactcttcctttgtcatgtacagaggccctgggacgtggattttcacaacttctatctgccgtcctttcgcatcaacggacttggagagagttgagagtgcatcaacggacctttggtactgtgggtcgttctcatcatcggtccatgacaagaggaccaccccaggtttaatgaagcagcatagattgtcaacatgaccatttgtatcatcatcacctagagaaaccattgcaggcctatttatcagtagaatggttgaagaagcagggaacagaactattatggttttacacctttatgtgacagaatgtttttggtggttaccataaagcccatgaggtatccagatgacctttgcgactccaagaaaatccttcagctcattctctatctctagtttggtcatgttggggtttctgttaggattcaacaagcattcttctgttgtgatgcatgtacctgttggaatatggcaattcattagcaagataccaacaaatatactgaaactatatgcttgtcagcaaagattcaacacatgaacaaccttctccatctacatgaatgcttccaccttcaagaaccatcgtgtgtggaaatctagggatcctctcaatctcaactatctgaaatcaatgtccaaaacagaactagttctcagaccagatggagactagcaaaagatctttttgaccttgaaagatgtcaaattttctttaagaaggttattctcttcttactttcttggcaacatagctgtcaaggctccaatcaacatagcaaccatcagtggctcctgcaggcattagcagcacaattcactgaatcttcatacggagcaggtgcaaagaaactagcatgtcttgataatgtacgcttttcacactgttaataacagacacaagcacaaagatttaatttgtgaagaaaaatgtttcatcacacaaacaatctaattgaaataaatagcatgagaaagaactgaataaacatattactcaatataagaacaacatacctccccaggcgttaaattcccaatcaattcctgctatatttttttctgtgattcctaaccctggtgcacctttacgaacaataaactaaaaaacagggatactgttagcaacccaaacactggagagcaaatttggaataagaaggcttgaagtagcatacagtgggaccaatatcacggaaccagcaatcattcatgctcatctcgaccaccctgatgtttggttgatgtagcattagctcatggacatagggatactgcatgaaacaaaagtatgaattggtaccactgtgcaatcagacatgatcgtgcaacaattcacaacacagatcataggaggcaatgtggagaaaatctgttacctgcttggcacttgcacatatagtaacagactcaaactttgaaatggcaatagcagttcttgcaaatacttttcgagctggaccagcaagctctcgccaattgtctcgacgctcctgggattcaaagtaaaaagaacaatgctcactgttaaccaaatgctcactgtagtatagaacaaggattggggaagaagatagatgaaatggatacagtctgcttttcatattcaagaccacagtccaaaatgacaattattgatattgtcaagtggatattccacctaaccactccctttcggagttacatatactaaacagcgattagacaagacaaaatagggcatgtacagggtagagtagtccacagatgtcactgcaatgatcaaacgatcattcatgattataaaatacatatatgtagaaaatgtcaatgtgccagtgtttaagcaatgtgccacagcaacgtgaaccaagacaagacaggtaaatatctctagaatcgtacatcagaaaaatcagacagcaaagaaaatgatggtcatgacttatagattgagtcaatcagggatagggaacagtagagctttaatagcgtgatggtcccaaaattacaactttatttatgcgtgaggggaaatgattcattcatttgtactaaaaaaatgaaaaaaaaaatcattcttgaatagttttaagacaaaaatgatactgtcgtttggacaaccaatgtagccgcctacttaaaaagtaatccatgtgcttacaaatcaagagtaataaagttgtggatgttccggtgaggcggtgatagaatccagcctaaaatatgctcgtaagctagtaccgattcagagattccaacttgacgagaaataaacaataccccaaattgctctgtgcactttagatgggatggattgatcccgagaccgcggcgcgcggccatccatcaaatccattcacttgggaggaaaccaaattctacacgacgcggtaggatttacttgtttcttctttctttttttttttggttggcgataaaaatcgcgaggatggatccatcggaattcagaatccaaacggagaagcgaagaacaattaaacagaaaaaaaaaagatgaggaaccagagggagagagatgagggagaagtacgtacaggccagcccatccagcactgctcgtgcggctcccactccgccggcatccggaaccccatcttcgccgggcgcccctccatcgtcgtcgccttcgccatcctccttctcctcttctacctgatgaaccacctctcctcttcctcctccctaaacctaaatatccaaaatacccgcctgattagcgcccaattggcgaaggatctgcgctcagcaaaagcaaaagcgatgggaaaaatggggcgtcccacgactcccacccgcatcagttgctttatatacgtaggcggcggggctaggcgccacgtggctggaggagagaggggagtggggacccttcccaacagcttcgcgtgaccaagtttggccacacgaacctcagcaacttttgtcagaaaaaaaaaaaagcaactccacgagaaacaagaaagcgagaagccgtcagggagctcgccgtcgctgcgtggggctcgccggagtagggggcgctcggggagcctcccgagatccgccgctcggcgccgccgccgtcctccgggcggagctcccgaagctcgcccccctcgcgcgccggtggcgttggcggggcccgcggccgggcagctccggtgctgcgcctccaccgtcgacgacggcgtcgtcgccgcagccgtcttccgccgcgccgctggacgccgccggatctgccgctcgtcgccgcgtgggcccctccacccggttggaggaggacggagagaccgacgaggaagaaggaaggtcgcgatgcgctgccgcgggggccacatgtcattggtggggcctacctcctcagatgcgctttggtgctgtgcaaatgtaaccactagatatttttttacactttggtctctataaaactttattttgtaaataaactcctacttaaacttaggttatgttcggatacgatggttacttaaaacaggacgagctattagcatatgattaaataagtaattaaaataaaattgaaaaatgggttatatgattttttttaaacaacttactagcactttggtaagcgtgtgtttgaaaaaacgagaaagtataagttaggaattggtatatctgagcacaaccttactaagtgggcatttttctcgatgctaccggggtgaaacatttcatcgttaatgatactagcgcagacaccctcgcttccttagcaaccaagcgttcgagatgtagagccgtagagggatcagtgttagcctctttagcaccgatcctctccatgtcaatgaaatggctaccacggaggataaaggggtgtcggtgccagtgttattagtgacccaataatgttggcactgaggaaaatagtctattttaaaattagtttatccacagatctactctctctatttctatttcatgttataagtcatttcatttttttctagtcaaaattctttagatttgattaaattatataaaaatttagtaacaaccacaacaccaaattatttacattatatataacattgaatatattttgacaatatatttattttgtgttaacaatattattatactatcttttataaatctgatcaaatttaaataagtttgactaaaaaaatcaaaataacctactatttgtaataagttttcaagcagagctaaaatgtaaaaaaaaaacccacacaggaaactggggattggggaaagacggcgttgctggtttgatggtttctgttgcactgacctcccacccttggggtgggggcggggaggttgtcagtatcggtgtgtggggtggttgggggggggggggggggcggtgatgggtgtggcgagcgaagatgcagccagccacgaagacatcgatacgtgaggacggaaggaaggaaaatgaattgtgatcgagaccgtgtcgttgagaaaactggatgtgtcgccacgtgacgcggaccaaatcattggcttgaaagaaacagggcgctataattcctccaagtcatctacacaatgtacagcaacatatatacttgcaacgtaatactctctctctctccgtttcaaaatgtttgacaccactttttttaagtacgtgtttgaccatttgtcttatttaaaaaaaactaagtaattatttatttttttatattatttgattcattgttaaatatactttcatgtacacatatagttttatatatttcacaatttttttaataagacgaacggtcaaacatatgctaaaaagtcaacggtgtcaaatattttgaaacggagggagtatgtgtaatggaggagggttgctcttacttaatttactttactttagatcaagtttaagttgatgcgtgtgcgtaagtttgtattgaggggatatacacatggtgaaaatcgatgagttataactaaaaaattttcttgaccgggttcctgggtacccctcccatactctacctccacgctctgctaaggaatgggatatactacatgtatggcattaagcatatctattacggagtagtaatcaaccaatattattattctctctcctctgtctcttactagttatttcatccgttcaacaaagaatcaactagtattggatgtgccacatctagattcattttttatgggagagggagtaccacttcatcattaaaaattccgtgtggcactttttaatagattatgatgttacatcatttttttattgtcagatatatagagagaaaagtataatactatttagtactacgcactccctccgtagaaaatatgcacgggacccattcatcattcacacgaaaataatgtgggacccacatgtctatcctctttccttcttccttctccctttctctcacttctctctctctttctctcctctttctccttgtctgcacgccgaggcagttggctgagggccagagcgacggcagcgagcaggagggcgggcgccgccttgagacggagcggcgacaacgcggcatcgaggcggagctacctctcgtcgtcctcaaggcggagccacaacacgtcttgcccttgagacggtggcgcgaagcgaggagtggtctccagcgacgccttccactgacgaagtggagcgataacgacgagcttcagcgtggagcgttatccccatcttacttgacgcccgacgccttccaccaagccatcatagacgagggggacctgctcatcccgctggtctatgtctggaacaacaccaccttcgatgattccatgtcttctagatcatcttggctgccccaataccccgtcgtcacagctgtccgcaagggcgacaaggagcatctccgtcccaaggttgatgtagccatcggctgcgacatcgatgtcgagattggccacattgaggtggatgtcttgcgcctcacctcctagctccaccaccgcgccctcacccttccatccccaccgctagggtggagctcgccactaacgccgctggggaggaacccgctaccaccgccgttggggaggagaccgccgccaccgctgctgggctaagaaacgaggtgagaggaataaagggagtggtaggtgaaggacctgtggacccacatggcagtggattccatattttttttgtgtgaatgacaaatgggtctcgtacatatttttttaattctaatacacataagcgtcacgtcaacttcacgtggaacggagaccgattcaacattgccacataggcgccacatcagcgaaaccgttacccacaactgctgatggagtcaaattgcgctggttttaatagttgggggttgaaatatcggtattgcggtttagggatacgaagaagattcgttcactagtaaagaaagtcaaagtgaactaatcctcccatccggcatccccaaggccccgaaggagcttgggccaaggccacaagcacaaggctaaaccgagcctgtagccgcaatagggcccagcacagcaccgcagcccatccagtaacatcaggaaggcccccataacctccaactcgtggataaaaatgaaaaacaaaacaaaaaaaatattttcccctctaatcttcctcaccattcgcgcatcacccagcagacgtcgcggtcgctcaagcctcaagtgcgcaatccaatcaccgcagccgctgcaatcctcctctcttctccgtaggtaattccttcgaacacctcgcgcgcgcgcgtcctctccgatcgaatggcgtagcggctgggttttcccgaagagagcttgattgattggcatggctgccgtggtggcggcggcggcggcttgcttgtcccccgtgtgcgctgccgctgcctccgtcccgcgcgctcgggtttgcttcgtgagcccccccggttcttggagctgcctcgccgcgagcaatggccgcgggttgcttcgcggtgggaatgggatgcggttgcggtggagggcaccggtgcgcgccaaggtggacgaggacaaggaggccgggctggggttccgcgagccggaacggaggaggatgcggctgcggctccggccgcggctgcgcctgctgtggtggcggctccggcggctgtcgccgcgggacctccccggggacgccgcggccgcgctgcggcgcgccgctcgacgcgtgccgcccgccgcggccgcgcccatcgtcctcgcggtcctcctcctcgccgcccgcctcgcgctgcccaagaacgcggccaaggaggtggcctactcggacctcctggctggcctccgcgcgggcgccgtcaccgccgtcgcgttcgaggaggactcccgccgcatctacttccgcagggccgcggacgacgggggcggcagcgacgacgccggcgcgggcgcgggcgaggcccgcagaggcgccgcggcggcggcgaggtggccgtgctacgcgaggagggtgccgcacgacgaggggttcttgctggggctgatgcgggacggcggggtggactaccggtcggcgccgcggccggcggggaggctgctggtggacatgctgagcacgctgctcacgctgtgggtgtcgctgctgccgatgatgtggttcatacagcggcagatgtccgccggtggcggcgcagagaagcggcgccggccgaggaagcagcgagtggggttcgacgatgtccagggcgtcgatgaggccaaggaggaactcgtcgaggtgaatctggattctctggctactgatttactcatgattttgatgagtgtgcatagataacaatcagtagacatgatacaatgtgggggatgaatgggaatgcaaattatttatacccaaatgttgggactgcttatctttgcttgacttattgaatggcttgctattgataatgcagatatctaggttgataatcgaggtagctatggtttgctcatgattcattattatacatgctaatgctactgtatctacctcagtagtgccatctgaactagcttctctcttgtggggtggatgggaaatagaaaaatgggtttgggatccatgtcatgttgttctactgatgagaggaagttgtggagtgtaggacataggaatgtgtcaacaaggtgttttgaaagcttaaatgtagattcaagaatcattttgttgattgtgctgcaaattttacattgtttttgttgtaggaaccatatatctgctccattccattatctgaaaatatatctgctccatatttgttttgtggatcctcagttgaaaacaaaaatactgggactgggaggatatctgaaatataaatacatatatatgatagaaagtggaagtataaaacagtaatatacagttggatagataactagtacttccattttttaactctcaactctgaagttcgtgatgattgcgggaatgttaataactaatgcatcagtttcaattaatatccatgttcttaattttcctcgctagaaataattgagtatgtattaaatgtgacagattgcaattttctaacgcaggtagtgagttgcttgcatggttcactgaactacaagaagctcggagctaaattacccaggggtgttctgcttgttgggcctccaggaactgggaaaactcttctggcaagggcagttgcaggagaggctggaattccctttttctctgtttctgctagtgaatttgttgaagttttcgttggaagaggagcagcccgtgtaagggatttattcaaggaggccaaagaagctgccccatctataattttcattgatgaacttgatgctgtgggtggaagtcgaggtagaagttttaatgatgagagggaccaaactttaaaccaggtaggattctagcaccttgattttatctatcctctgattcaaatgatactactgaatgaagaactgcttgctttctctatcaacagctgcttactgagatggatggttttgactcggacatgaaagttattgtcatggctgctactaataggcctaaagcactggaccctgctctgtgtcgccctggtcggttctcaagaaaagttttggttggtgtgcctgatttggaggggcgaaggaatattttggctgttcatttaagggacgttcctttggaagaggatcctgaaataatttgtgatctggttgctagtttaacaccaggattggttggtgcggatctagcaaacattgtgaatgaggctgcgttactagctgctcgaaggggtaggttaaaatttatgttgtacatttgtacttcacttatcaccttaatgcaagtaatattattgctacattgaacagctctttgagttacaaggtttagaaagctagaccatatatgccttctttattcttctcagagactacaactgaaatgttttccctttaggtgccttgacttaattcaccatattttgatattttactggagaaatcataataaacatgctattgacttttatctactttcttgttgttttaaggatggttaattcattctgatggaaaaatctgctattgaatatactgatcttggatttttacaggtggcaatactgtggctcgggaggatattatggatgcaattgagagggagaaatatggggtcaatggtagacaagagaatgctgattctgaaaggcaaggcctcactaaattgtttccatggttacctaaacctggaaatagaccaacaaacccagatgatattggaggagttatgggatatcatacattaagctaactggaggctttgcaaggtatcatttgagatgttcatcaaacttatatttagtaggctttgcttaatcccccatcagttgaatctactccgaattctttaattgaacatgaaatatgtcttgttagtttctttagcaagtccttactccttagtagagaccagcataggtttgcaaacattacatttgatggatcacaaacaggtgtaaagtgcactcatctttagcttgtgaaattagagatagaatagatgggagttgaaaaccttacgttctggtcatttggctactatatagccaatctagtttcaaagtttaagttcaggatttatcttgcacatttgttgcagttgtaaggtccagtaatgaggcttggaggtttccagttgtaactcgttaccactaaccaaggactggccagttcccagtccactctgtagctttcaggaggatattttcaaatatgagcatgccctcactaccctccagcaacttaagattatgcatgggtgagttggtgctcaccatcaaactatctgagtctcccaagtagctgagaaatttaagagcaattaggaagctgctggagaacctcctgtttctttgtagtatgcgtccttaacatactctgctgtgtttcatactttcattaatatgtagatttctgtttatgattgtataatgtggagtattaaatatcaattcatgccattattaatatattctgtggcattgcatagtactatccttttcccttagacaaggtattagcaagtgaaaaattcagcacattaaatgtttgctgtgaaatcttctcagtaagtattaggctacaagctttgaattccttttgacatgctcctccttttgtccctgcaatcttatttaaactgcaacatccttatgtggccttttgtttctgttgggcaggaagaaagaagttaagctgcaatcaaaatggtgtttgaattgccaacgtacatgggaacatgtcggttatagtcgtgtaggagcaaatatgcgtctctactgtacatgtgaaggatactgcactcttctgagttttggggctgcaaatttaggtgcttggaggagaaaactgccaccaaatcagaagaaatcaagcttctgaatgtgaaacacg

SEQ ID NO: 67473 - DNA, 713 bp, Oryza sativa
gccacggccacggccgccgcgaaggccagcgcggcgcagagcacggtagccaacaccttcgccatcgaagtagggtgggaggactagcaaaagtagaacacgagagcacgagaggagggaaacaggggaacgaggaggaggagatgatgctgtggcggccatgggaggcggatataaatagggtggtggagtggaggtagccgttggggtattcgaacgttcgggaggggaggcagtagagtagcatcgggtgccgcgaagacgcgtggcgacagcattcactggcattgggatgggatgggatgggatgggatgggatgggaggagtggcaggctgttgctggcttgctgctgctgcttctcagcactgggaaaggatgcttctgttttggaccttaccgttgctgttttggccttttgaggaggcactgggctggatgggatggcactgttctggtgtagggctgtcacctatggcccgtggggctggggaggcttgggaccagtggagtggggtccacagggaagtgagtgagaattgtgtgaaccttggagttaatattcctcctggaagaagtgtttgtgttgtggcaataaaattatcattttttttaaaaaaaaagtcacatgatcgagtggactgttgggttcagcctcgttatcaaaaccctcaccaaattagaccctgtttagatgggactggctgcaggaat

SEQ ID NO: 67474 - DNA, 608 bp, Oryza sativa
gctcgtgcgtcccacagacttggtggcgctcccgttggatgtggaggcacccatctggtcctccctgcttggggatgacgctcgtgtattggctactatgatgagatcaatggagctaatggagctgcaatgtgtgttggcctagtaggtgcctccctctgtccttgtttcttgttgggtttgttttgagtaatcagagtgcccttctccttccctcaggccatggtggtcgtcaaagcactcctcaagcctgggggaagtgatgcaccaacacaacacgcggagaggcttcgtctagacgagattatagccctaggtacagcggaggccagtggtgcagcctcataggtggaggcaaaatggtgacggtgcaactggccctcttgcaggtggaggtgtctcggtcataggtggagaaatggttgtgggatgttcataccgaggtggcccgcctgtccccggagaagaggcgttgtcttaggagattagcatggccaagggagagtcggagactcattcgcttgatgcccgcacactagatgagaatgccgtgcatgtgccctagcggttacgtgggctttgggctccgacttcgtggattgtggatc

SEQ ID NO: 67475 - DNA, 9398 bp, Oryza sativa
tatttaaactgcaacatccttatgtggccttttgtttctgttgggcaggaagaaagaagttaagctgcaatcaaaatggtgtttgaattgccaacgtacatgggaacatgtcggttatagtctgtaggagcaaatatgcgtctctactgtacatgtgaaggatactgcactcttctgagttttggggctgcaaatttaggtgcttggaggagaaaactgccaccaaatcagaagaaatcaagcttctgaatgtgaaacacggaggtccaaggatttcacttgacaacaatcttgcgctctgtagtctttgctagaagcactacatctggttttgttccatagacaaattgttaatagaacaattagaattagattacaggataaggtcgctccagtgttctgctgtatacataccatcagccattcagctcattcgtgcaaaccagaagttatgctgctgctgggtccgcgacaatatgtaagtttgcaaatcacaattagagacgagcactccttaccatttcaaattgtgcatcgctttgctttacctaagcactagtctcttcacgttgttcatcatttttcttcaactgaactttctcctactgctacaattctataaatctgcaggtatcaaagtatgaatagattatacacctttcaactttcaaatttgaacttctctgtagtactcattgtcctgtgttatctatgtgccattttcttctgcatttgcttggtaaactctgatgtgtctgcatgacttcagcattactgctaaacctgatcacaaacaggggattactggtggattgccaagtgggttccatgacagttagtcggagaacgacccggcggcttgacccagaaaaaaggccatctgctgtcagagacacacatcccgtcctgaagacgacatgaccttaataattgggaagccatgcaatggctgcagaatcaggacatatacccttgagacaaagatgaagcttctcccagcaagaaaaaatgttgtgtaaagggcagagctttggcatgtagacctcgacctgtcatacaccggaatgaagggtgtggtttggctttttgtgttctttcttctgggctgcttaaccaaccatgcttatctctgcaggatcaggtcacagggatcaaaggggggaataaaatggaaactgatgggaataaaatggaaactgatttgtagctttcaatgtttcgttctcagctttgctattagctttctcctgatgatttagaggccatggtggtctcagttcatgcatctatgacctgaatgaatgaagcttgtcctgcacttcagatcgatcggagtttctgtgtgcatatctaaactgctgagttttgggcttttggcctgacactgttctgcctaaatttttcagaaatgccttcctagctactagctaggtcatgagctatagccatcagactgttcgagtagtttagttagcaaaaaacaagactacagaatgcctactgacaagttgccacaaaatataatcatctggtatatataatcagcttcatgttaatatttgagaacgcatgcttaattatttagacgatgatgacaacggcgtgtaaactagacagctaccagtttcagaagtacgtatatatacaggaatcacaaatcgatcgatgacatttgtaaaggtgattcatgccctgtccgtcttgcaccatgtacgtttgtattgctcgtgctttggaattaggactaaagggataatacgatgaggacaagacacgcatatgctgagacgagagataagcagactacattttctgcaactttctcaaggaattggaacaatctaggggaagctaccaaattgatgagaagggcccttacctaacatatctcatggatatacagtactgaagatattttgtatgtgtacttcctccatccaagaataatataaacacatctggagtataatggccgaatacccgtgtgcagaaacaaaaaaggaaaagcccaccatatactttgaagcctagataaaaatatgaaaaacacaacgagaattaaaaacagaagcccaccgtacactatacagcctaaaaatttaaataaaattattttcattgtaaaaatcttcagataataatttttataattttttatcttatttgatagcttatggtgccttactatttggaagattcacatgtgaatgatggtggtgatggtagattcacttctcaccataatcattggggtctttaaaagagtatatgttgaggttgaagtgagtgtgaaagtagatgcgaaaattacatagaagttagttggggtaagaaagtaagccgggatgtgtttatattattggataaatttcaggcttcatatgtgctattcttgggcagagggagtaggtgtgttaaggatagaaaattcagggtatatgtaggtgttaaggatagaaaattccagacagcaatttttgcctaaccttacaatatatgcaactgttatcccattgtttctcataacaaaaagatacttgtcaatatcagaaggaagatttatatcagatgctaactgatatcggaattattgatgtacagtgtgcgtataaattcaagtacgtactgaaccatggatgcgcatatgtacggtatcagagatgagattgatgagaacaggagagagaagacaagtgatatatgatgatggagaataatcttgtagtagacaagaagagaaaagcaagaacaaagcagcactgatgagtgactttcagttgctaaagacctagagctctgagccgaatagttcttctaggcttccagttgagttgctttcccaacaaaaagctcattcctctgtagaagccatttcaagtgcagtgcaaagcttttcttcgtcacatcctgttggttgcatgcaattacaagtaagctcatgcatatgtactttacgttttaactgtgtgcttaagcatgaagcatgcatcgcacactgtaaaaaaaaaaaaacgtcctcggtattcggttaattaattactgtggcgttaatatctcctgaccgtcgaaagaacagcgtaatgccagcactactgccgacgtatatatgagaaaaattagctgggtatataatgttctcaactaaacaaaaacagtctagtgcatcgatcatcagccaaattatattactattacttgtttgttgtagtagtggtagaattaatttaaatctaactatagatcgattttcatgagtacaggaatattttattcaaaactttggtaaggtatccttaccaattcatccattttaatgtgccatatatataacatgtgaattgatcacagtgttatatatttgatttttagttttaaccttacaaaatttctactacacatattatcggatatagtataataaaataatattcattgcatctaattaaagaaaatggatgactcacaatcattcgagagtacctaaaaaaacctattgatcaatatgtaatcatacctcatactacggagaaatttaatatcatggtcgtataaattttaaatcttgaaaatgcttatattcttaaatggaggaagtagctacagtactttatattctagaaacttccacatctatccacatgctatccacaacattaagaaatatcctaagggtaaaatggtcatatctagaaaatataataatggatatatagcctaattttgcgtgtatagttgaaagtatcaattaaaagaaaatggagagagtagtattcttttaaatgtatgatagttgattttttacatcatatttgaacgtttgtcatattaaagttactatgtacttttattctattgtggttatatcactaaagttattttaagcatgacttatattttttttccatatttacactaaaacttaaatgaaatgaataatcaaattttatgtccgaaattcaactgtgtcatacatttaaaaattgggggggggggtatttgactactcatggttaattttacgttggattaatccagatgcacatctgcttaattaaacatgcatgtgtggttgtatcatgtaatatcagttataattaaggtgtgcctatcaatctagctaatatactactccctccattttaaaatataaatatttctagaattcaaaatttataccataatatatggggcaccggttccaatgcatagaaagctatacattttcatatagttggaaagggaatctaagcaattcaaaatttaaaatttgatatcaccgaagtgactaaaagatgatattttctctctaagttaggttttgctaaagagctagaaatgcttagattttggaataaggaagtagctagcttttgttatggaattttcagaaaataattaaattgaataagtatgtgattatatggagtagctttaaattagcatatatatctttgatgacgataatttcttatggtacaattgtttatactaattatatttatcttaaagccccgtgtgtttttcttgtatatgtatacgttgagataataaaggaggtaactactcaaattatttctttgtaaaatgtagaatgactagttgtgtgagtagacaaacattgacaggctagcatcttgttattgaaacggtgcaaactttattcatgaataggctagttcagaacgtttgagtactgatcagcaaataggcatatcctgtttcagaagctgatcgagatatttgatccttcctgacgtaactcagatattttgaatgttttaataatgttttagagataaacttctgatttgtaatttggtctttctctggcacacatgtgcaaactataagatgtaagggctaaacaaacccggcgtttaataattaacttcaatctgcgtttagtttaattaattgccaccaaataccgtgacatgcatgcatggttacaatctatatgtccatatacatgcatggagatcgagagatcagagaggggtgaccacaactccacaaggccatgcatgcatgggagacatactataaacaatatcatacatatttattcattattattattattattatatatcatcagcagtgctaattaaacaattaaaactatatttgtacattcatacatagcagttccggccctcatctcatgtcatgcatgccctagctagctagccagctgcatatatatatatatatatatatatatattgcacacacacattacaacatatatactatacatgtaataatatatataataatactacatctagctagctagctgcggtcctgtatcgcgagttagctagctatatcgatggagtagttcagacgacgaggctggtctggtggtggtggaacctggcgatgaagtcggaggccttctggtcgacgtcgcgctcgccgatccaccacccgttgtcctcgtcgctcgaccggaccttccgcagcctcgtcgccgccggccgctcccagtcgctcaccgccgccgcctcgtcgtcggcgtagtaccgcctcgacctcctcgagaagctgaagatgcacaggaacgacctccctcccatatactagctttctccccttcccttttcttctaactaactaactaattaagctacttaataaaagttgtcactgattgagattagttgaaattagctatgttaatctagggcaataagcttatagctagtggttggtgagttgctgtctctagctcttggtgtttaggaaggtgaggagaggcctcacctcaatttatagaggaagctagctcagctgtgctccaggctccctcttgcatggctgcttgcagctgcagcttagctcttgcattgtgtactatccagtagtgaacacacacacacacacacacagtagagctatgctttaggccggtagttgcgagctaccttagccagacagctagggttcttccggtccagatacaagagctaaaggcgcccgatcggggagatcggcatcggacggcgccgatcgcgcgatcgggataaaagccgagatcgaacggcccggatctaccgatgggataagatgctaaagccgacgtggggtagcgtgtagatgttccatcatctggagcgcacgaccacgatggttttggtgatcgaaacgatcgaccgtgttcgtgtggggaaaaagggtttgcggcagcagcagcagcagcaaagcgctcgcggttttgggtggctttttcgcgtttttttgacgatcgaccggggtttggggggtttggtcctgcaggctatgtagatagctatagtgttgtgtatctctcaacacagcactgtcaatgcgagtcccccacgagacgtactacctttggtggtcacactaacatgcatagctggtcatattgcaattgcaaacgacgacgactcatcctcatcatgtgagatgtgtccacaccgggtgtggtcatatgcgtgaaaatatcgtgaaatatcttggggtggtacggtgcaccgtgcatctagataagatgcatgaacttaattaagtgttctgctatcggtagggcgcgcggtaggccttcagctattataagccacggctaaatttaagtattttaatattattaaggtagagggtttattcgccgcttctttgttagtgattttactccctatgacttaaaaaagggcagcctacgagaggatgtgacatctcctatatttagattcgttgtactaggaggcctcgatcctatgtcgactctttttttttaaggacagatcgaggaacaaagaagcggctaaaagtagaagtataaaagtttgacgttaaaaagaacattttttactactgctttcgtttataaatagtagctcaaccaatttgatattttttactgtataaaaatttggacattaatagcaacatggatgcatgcatcagagctgtttagcgctggcggcttagtagccggaatttatggccaacatacatcgagaaaaggagtctacactctaaccctgctagtttcctgggaagtttgaaacgaacgaaacaaaaaaaaaatcatttcaacacaaagagctctcgacgaaaataggtctcctagctatatgatcaaagaggaaggaaagctttggctcttgctggggcaaagcacctttctaagttaattaaccttcttacatatgtatagtttttttttctagtttcaccctagcataggggatataaaactcttctatattatattcaatgaaattggtatagtctcgcgccggttcgtttaaaaaaattgacactcttttacttggaaattcatgttgttcatttgcctcactacacatttattcatcattagaatatgtatgcataattcttgaagacaacgatttgttcgtggtgagcttgtattatatatgtggagtgattttatggtctttaaggagctattataatttgtagtattaatctgtggtgccacctcttagtaccttgttattagataagtttaaaaactatacacttcttcttcttcttcttcttcttcttcttcttaaaatatgatatcttctttatcacggtaaaaacactctgttaattgtgtataacgggtaagacctcttttagaaaattgttttcctgttataaagtagttaattaaaatatattacgatttaggaagggaaaatcattttacaacttagtggcatgtatgtgtcctccttaattttatgcatacatccaaatggttagaaaatgttagaggtgcatgcctgcagaaaagtatgtaatggtgtaactctacaaacatgcatgtaaggccaaattcatctaaccaagttaatttttggttgcgtatattggagaattctaaaaagctggatttgatttatctttcccttgcatgtgtcgattgagtttagccattcatttttgcagtgataaattaaagaataatctgtattgtcaaaataaattatatttttttcacaattatgtagatcgtattaattatatgcacataactaagtcacccctctcatttggcttacatcgaaggaattaatcatgtatgtatatacactgacattatgtttggtactttggtgcactatatatgctgccccacatatgagccatgcaaggttagcttgctccactttcaataagagcagtcaattaaaggtgtggattagtggatacctttcatcagctagcatttctcattgtttacccagtataaattaaacatttctggcttatcatcacattggtatcaaaagcaggatatctcaagcatgaactgctccatgccctgatcccgttactatgttcaaaaattttaattggttcttagaaaaaaattataatcggaacgacgaacttcggtgtaggttcctgtgtacaaggtaaccgtgctttgaggaacaacaaatatttggtcaaaatttgtatatggcacaagccgataataacttcacaaaatctgtagccaatagcccaatagaaggaggctattgatgaatctaactcggtacgtaggagtagataccagctgaacagctgaaggtaatagcgaaaaaaaaaatcaaggctagtatgctgtactattctcttgtttcaggttttcctttttctgcccccaaagtagttggcaagtagtgaccaactgtgggcaagagttttgaaaaggaaaagaaaagggcagctttgttttcttgggctttacaaacgaagtgactatacgaagctgtgcaaataatactactactacttttagcatgcacaagaatcgatcgttttgttaaattaaaataaattaacaagcccaattgcagaacaggttttgccaataatcatcgatctgaaattagacatatgtatatcctcacctttacttacgctgttttagtagtccgtacgtacatgcttagtccctaagcatgatgctgctatccatctcccgttgaaggtgagattgttcatacccataattggcagatgtgctgttgcatcacaaaaggcgaagggagaaaacctttggggcgtattgtctttgtcgagtctgcatcccaggctgcgcagtgaacacttgccgctcatttcaaccgaggcttgtaacgcaatctgaatttgcatcttgctagttgatatgatcatcaggcgactgtcagctagctgtttcctggaggttccatccatgctatcctgtgctcgagatttatctgaaagaaaatgtcagcatgacatgagatgtgtatgatatgtagcatgcatgggtcaggagagaactatggcttatggaaaaccgcatgagaagctgggcacaaaatattgcaagaagttcttagaggcaagggcttttaaattttccagctatttgctagtgataattttaacag

SEQ ID NO: 67476 - DNA, 636 bp, Oryza sativa
aagcgtaacaccctaccctgagagcccgaggggtgtgacgtggcaccccgagccccctcagccacctcagcgctatccgaggggcgggggaaggcgaggcgcatggctacgtgactaaacgggaaggatacttccctttactgtgtgtacccccgggcctatatcaccgacaattatagtcacacttttgtgcaaccacaaccgccatctatatttatattatttagcttgatttatatgttgtatatgataacaaatcacccaccataatatattgggaactttaaattcatatgataatttaagtttacataactttatcattatttttcactgtcttcaccgctgcaccagtcgccgccttttcaccacctccactgttacatgacccttattctccccttagtttccattggtgtctgttttatagcttaagcacatagatacatttcatcctgtatatttcaactaatacaatacatcaaatcattagtttgaaagtcatcctcaaaacagagcaatttgaatggtatttccaaacattggttctgctctttaaataccaagcaaatcaaactgactactaccaggcctagaataaagccaatcaaattggtgtcacaggctgtttgctat

SEQ ID NO: 67477 - DNA, 6908 bp, Oryza sativa
agcttgcgttgaatcgaacttgtacgcagcactgatgtaatgcatactcaggatgatgagattaaaccatgctattgctaaggaggatgtttttgtatgtgtagctaaagaggatttcgtttaagtttgacactgtgttgtgtgtgcgtttagaggcatcaatagcacaagaaatctgatcacaaggaaaagagatggattgatttgattcaaagaaaagtgaaatacatttttgaaaaaaaaaatatattcggttgccttcgctatactacaagaaggaaaaaagaaaagtaaaatacctgaacatattagctagtagcccacaagtatcacaatgcacacaccaaaaatgatcaaggatataatcactaaccaaaaaaaaaaagagaactgaaatacacctgtctctatctctatgttcagagcaggtaaagacggggcagcaagaggtgtgttcatcggtaatttttccttcaaaaattggttgtgtgatgttgacaattccctcggattctggtggaatgattttagcatgccaaacataattaggttgctagaggatagcaatagggaatgataacctgagataaaaaattaccttgtagtcatacaatgaggcactccaaaccactatctcaggagggtttcccgataggtatgatgcattagagagagatgattcaacactggccagaacattgcgcactctgtactcaacttcctcttctgtgaaaatgaggcccgcttgtacctgttatgctccatcaatgcatgcaatcaggagatctggatatgttagatggctagcagtgaaggtttgcataaactcttaagctcaattctcaacataaaccttgcatagtgacctcatttacaagcttgagaacaacatcttcagcatttcccaagcctatgagaagatcagactcctgagacttcaaaaccatcttaagatcttccaaagcaaaaagtagcagttccagcatcgtgtctgagtaacctgcaaaggataaaaaggctaatgttaaagccaactgccagtgtgattacttgcgattcttgcactacataatacagattacagtataatttcgcacgatgttacttgtatatgaatgttaacaccagattctaatacccatttccacagcataacttgataaaacacacctcgatctcatcccttccaattaaaaccttcatgatctgacacataccacataagtaaaggtgcaggtctcctcaagaagttgggactgaaaggcagttgttctttccatttactagcgtctattttaaggcaaaccatatgtttcacttttctgaatcagcagaaccagaaagtaccatcccgcactacaaccaatccacagcttacgctttgattcggcagccgaaaaaaccacgacttcggtttttactgcacatttctacaaaaccacgaatcctggcatcaaagctttgggctttggcagattataagatctgcgaatgcagaatctgggtgctgccgttgcagctacaggaaagcacaattgaagaggcataagaaaaagtaaatgatctactcgattcagagtaaatgtatttgaaaattactactagaacagagtatggttttaactaacaagcatcagaaattcagaatctacatacaaaatgtactaccaaaacagtgctagaactcaatatcaatagcgctacatgcttaattaagggcaatagcttttttttttcttgaaacaggatagtgtaccttagttgaagtcaaacaatatctcctaacctgcatataaacaaataaactcaaatatcaaattagctgcatacgatgagaaaaatggttgcggtccacattttgcacatcatctactgttttctttcaaaactgattgttacaacacaccagaaaataggtgttccttgcatccatgccacatgatatcatgtccaggtactccttgaatttatgtttgagcggtgctttattcctttcatcacttgcaacaaaaccacctcgacattatcctcatcactacaaacactcctgatcactgaactccaggtctcagcatgtggaaccatcccaagatcaagcattcgagtcatcatccctgcagcctcattaaccttcccaactgcacagcatcccttaatcactgaatgtaacacagagaaatgtggtagtaaccctttgcccaacatatcatcaaggtatgcctctgccttgtcatataatccactcacacacaacctattgaccaccgcagtatatgccaccgcatttggcgcgcacccactctccctcatatctctgaacaccttgcaggcatccagtggccgtccctcacggcacattccgacgatgaccgtgttgtaatgtacaatgtcaggtgagacctcacggcctcgcatgaggcacagcaagcggtaagcctctcgaagctgcttcttacggcagagcgcgttcagcacggtggtgtatgccagtgggtcagcagggatgcccctgtggagcatttcgtcgagcaggttggctgcagtgcggacctggcccctgcggcatagtgactgggtcaggatgcggtatgtctcggcgttgggagacacatggagggagcggaggcgatggaagagggagattgacacggcgaggtggccggagcgggcggcggcttcgatgagcaggttgtgcgaggcgaggacgagcggctcggggaggggaaggcgggtggagacgtcgcggaggaggtgcagcgcgcacgggaagtaggaagcggtggaagagagaacggagaggaggcggaggagaagctcggggtggagcggcaacgggctggggccggagacgaagagggagttgaaggtggagaggaagaggtgaggctgccggcggaggcggagcgcggagaggagcagcgggaggaggatccgcggggagggcggcgacgggaggcggcgcaggagcgcgagcgcgtgggggaggtgttcgcggcggcgggagaggcggagcgcgagcgcgtggagcgtcgacgggtggggcgcggtggtcggcgcggtgacggtgactagctcgagcgcgaggagcgggtccgactgggaggtcacgagcttgtgcagccgcgccggcgagatcggcggcggcgccggtggcgacgggagcatcggcgaggccgtgatggcgtgggctcgaactgggagacggggaccgaacgatgaagatgatcgtgtactggcgtaggctttggcccaacaaaacatgggcttggccccaaagtggagccttatagttaggagggctacttgttctctcgggccattcatatgggctctggaccatgtcttgaattctttgcggcctcgcacttcaacccaactacccaattagagcaagtacaatagcagactatcagtcacctataaatatattttaaagagataaaagataagagagaagaacagcgagctatatatctgtagccagttgcagcacaacctccaagacataatgtgtgtatgataggtgggatcatgcattaattgtatagtaagcaactattacataatgtgtgtatgataggtgggatcatgcattaattgtatagtaagcaactattacataatgtgtgtatgataggtgggatcatgcattaattctatagtaagcaactattgtataaattagctattaaattggctatagatgatttggagctagcagttggctatactattaaacttgctcatggagagtaggaagagagaacatggagtgaatagtgatgctggcttcaaatagtttcaactttcaaaacacccattttacacagaatttatgtttgttcgggagatagcgtacaggtgagagttcgtaatatctttttcaagacatcatatggtatctgaatttgattgatcacataagaaaatcagctagagcggcacatattttctattattatatagttgtaattcactcaatattaattattaaaaatgagctttcatatataagtggtgtacacacgtaaaacgataaaaccattaacgcatgattacttgagttttaattattaactagtaaaaatatcaagttttaattattatatacttaaaaattattttatattttataacttttatatagaaagtttccgtacaaagcacattgtttagtagttaaaaaaaatgtggtaacaaaatctaaggtataatttacatattaggcttagttcggcagcctgtattaacacatcttcctcatgttccgcgtgcacgatttttaaattgttatttcaaaatctatatgaaagttatttaaaatatcatattaatcgattaatcaaactgacagggccgtttcatggcctttccaaaggctctggtgattggcagcttgcgttgaatcgaacttgtacgcagcactgatgtaatgcatactcaggatgatgagattaaaccatgctattgctaaggaggatgtttttgtatgtgtagctaaacaggatttcgtttaagtttgacacggtgtgttgtgtgtgcatttagaggcttcaatagcacaagaaatctgatcacaaggaaaagagatggattgatttgattcaaagaaaagtgaaatacatttttgaaaaaaagattcggttgcattcgctatactataagagggaaaataaaagtaaaatacccgaacatattagctagtagcccacgagttttaaactgttcctacaattccacagcacattacgagtccaaacaggcagtacagtgaaaactatggagtttgttatggtatacaaattgggaaaagaaagaagctcaaaggaactcggcaatatctcaaaccacacatcatttttagccagaaaatttgacatgactaccctcaaaaaaaaaactgaagaacatacaccagaatgcatgcactccagttcagcgtttattgaacccctactacacccaaaaatttaacccaagcgaggcactcaggattccatggcctcaccatcaagaatacatctaaagaaattccttcgatggaaagttatattaattcattttgctggagaatagtttagtagggtgttagccactggcttgaaaaacaatttggaacagatgaaagaatgcacccaattggcatgaaatattagttcattttgtacttctatctatgtcgagccatataaaacaagactacaagagagtacaaatgtggcacgattagacattacttgcacgatggggtcaaaagtttgtatgattagatttagacaactcttgtaatgtagggttcaaggttgattttgagctaggtccataaacaaaaacagctttaagaaccaccagaaagttcatcaggagtgcgaattgcatctcatcttcttgtgccgacttgctatcaaacctgctcgatgctgtttttcctttcattcaacatatattgcatttcattttgaaattccagaaaatgatatgaagattaagagtaaataagtaatctacacatacaattctgtacagtgttcaatattcatctcctttttgccacctaagacatgaagcaaaaaaagtacagaagtgtcaacgggcacattgggatcaagttcttagaaaaaaatgcttccaacgatcaagttagtataatcgagaagtcagttaatggataaggttaccagacatctaagtaggatggaactccattgctggctaagcgccagtctctttgatccattcgcacagcaaggagttcacttcatcaggaacttcatcatgtggagcatgacctgacacatttcagtatgagaagaaaaaaactaacatcagtaacccctaacccctgaagacgttcatgaatgagaacttgcgcacaggagagagagagagattcacctgcatctagctctctaatatggaccttgctgcaatgctccctaagcatggaaacaaatgacttggattttgtaagtggatctttcattcccttgtttccccaaaaaaagcacatgaaggtagtattagctatccgcatgttgcagtaactaaattaggtaccggtatgaatccacaccatttttttatatcagaaaatacctgaacaattaagatttttccaccaaaagaatcaaataaaaagttgagaggaatggaaagattgaaactgaatatgctctcaataacggttgctgcgccaggatcatatgactgaatttgtctgtcaaggaaaaagaattgcaggctatactgcatatatcaacggttaagtctatgataaatatactttgtgatctgaggatacagctcttattatctcatccacaagtggcttgtcaacccgttcagttctctgcacaggaatttttcggtattgcttagtaaccatgtattatttaaatatttgaggaagcaataaccacatcatacacgtactgtaggatagtattccttaagaatgcctcctgctcttgacctcaagaagagcagaaggaggcgtgcctgcaaactggaaagccatgaagtccgtccttcctgtttgtatttttcattcagtagcattgagttaatttgtagcggaagtaatatagttccagtgctaaaaattcgatcctaaatagtacgatttatttttgctgctgtcagattatcattcccaaacactggttgatataagcacaaaagatatgtatctgaaacattaaattgttagccttatctatgctactattcagagttttaaatgctttaataattccaacaaactagaaataacatgcacattgcatttgaatgatacaacagtttctacaagagaggagcttgcgctaggttagccaaaaagaactgctgagattttagtgtgcatattttcaatcgtcctaagtctaaagtaacacgaaaatgtatga

SEQ ID NO: 67478 - DNA, 555 bp, Oryza sativa
gttcacgaaaaggaaactttttggtgtcacattggacgtttgaccgaatgttagaagaggtttttagacacgaataaaaaagctaatttcataactcgcatggaaaccgcgagacgaatcttttgagcctaattaatctgtcattagtacatgtgagttactgtagcacttatggctaatcatggactaattaggctcaaaagattcatctcacgatttcccctataactgtgcaattagtttttttaaaaatcaatatattaatgctccatgcatgtatccaaatattcgatgtgatgtttttgggaactaaacatgccccaagataagaatcctatgcgcattgatgtgaactggaatgcattgaatttaatgagatataaagctaagatgaaaggtgcatacattcactgtcctctggatgactttggctctcttcttgggcctctgaggaagcttggatcctttgaacacccagaagtcctcttctttctctttgttcgtcagggcgactgcaaatttgggccagatcgacccctcgctccctgacgacga

SEQ ID NO: 67479 - DNA, 10953 bp, Oryza sativa
gggatttccgccgccgctaccatgcatttcgccgccgccctcgccgttccgttgccaccgcagccgtggggcacgccgccgacgccgccgtggggcaccacgccgacgccgccgttgggggcgcggccgacgccgccgaggtgcgccgccgatggggggcatcgccgacggcgccgttgggggcgccgccgactccaccgccgtctccaccttctaccgccgccaccgcctccatttccaccgcagcctcacgcctccaccgccacctcccatccaccaccacctccaccaccgccatccaccatccgccgccgccgccgtgtccccctcatcggccggcggcatgccggccggctttaggccgacgatcccgactcctcatcagagtcagagaccggccggacccgaataccgttcccccccccacgccatttggtatcgtgcggctttgggagccatgggaaacggcgatgaacgtatggcggaggccgggacggcgtgcagcggtggctccagcgtggcgacatgttggagacggtgtaaagaggggcggctcccctttgcgcgccgccatggttccggtacggccgaatcctggtggcgcgggagtggggtagcgttgaaagcttggcgttggctgcgacgttgatggaggtggggaaggagcggttggtggtgacggagtggcgacgaacggggccggcagcgactccatttccagtgggagttcacacggctcgccgggcattgtcaccaccgccgtccatccatggtgggcacagtactgtaccccttgcacaaggatccggcgaggtgcttcggcaaccggaggcggaggaggaggtgcgacagggacgggcgggggggggagggggggtgttgtgagtggcggcggccaccaaccctagccctgcctccgcgggatccccggcgcgtcctcctcatcgatcgacgaagaagatggcgaagccggcgtgcgcgctgatggcgagggaggccgagaacggcatccatgatccaatgaaaggtaggcatcgtaccttctctgatgattcttctgttcgcttttctgttagatcaaaagcaatgtttcttccttatttcactttgcgatctccttcgcgagggcaaaagtgctgataacgtgttgaatgtggatagaattgattgagcgagagagagaattgaacacaaatagagcgaatcgatagatttctcattgatcaacttctgttcgcttttctgttagatcaaaagcaatgtttcttccttctttcactttgcgatctccttcgcgagggcaaaagtgctgataacgtgttgaatgtggatagaattgattgagcgagagagagaattgaacacaaatagagcgaatcgatagatttctcattgatcaacagtacatttatacaatgtgaagcggtgtcaaccgcaggggatacgatgtttgggaacatcatgtcggttgtcgagagggacgctaaagggagagagaggagcgatctcctcttctctaccggttagataggaaccgttgttcctatttccttgggtggatgagatcacccgtagtttcttaacacaaacatggcagctccaggcctccagcgagcggaggcggcaattcaattaaggagggagctggtgtccttttgtttctcctttctagtttatggcaataataaaaatcacattggttgctcagttcaaatcatcaagcggcgtgaaaataattggctgtagattcgttgaagcaaaaggccggatttaataccattatctaaaaaaatcaagcggtggaaatcatgatattgttttgtactcatgttggttgcccagtaataactagcaggataaattggaaactacaacgatctgtctagtctctgtaagcgaaaacaaacagaaatattcaaccagttggtttttatataagacttggaatggacttttaaattcaagtttggtacaaattcagaagtaaattaaaatgtaaatctattgatgccatactgtagcagtaaaattaaatacaaagagccatactgaagcagtaatcttaattatatcaaaattttattacgtttgccaaaatttgggttaaatttaaaacatgggaagaatcagtttgaaacatgaccaaagttcatgcgcaaaattatgtatctcaaaatagaggcaaatgtgaaagtggagtaaaaaaaacataagaaaatatgaagggtatacttgtctttttacctcacatttaacaccattagcaagagttaataggacgctgattcgtctaaaaaatttagggaaaaaaaccgaaaacactaaagcacatgaacaaaattaatacaccaaactagggttgcagacttacagttaccatcaaaagtagtgctagtaaacaacaatctcgctgtttgggccgtttacactattaattgggctctcagagtttgggccgagatgtatgaagtcatcatctttcttcttttttttttgggcaaactacacaatttcggatttcagaacaatcggagctcttattgtttcagaacaattcatgagagctatatctcaattccaattaagttcacgaatttcaaaaaattttgtgtttcaaaactttttgtgaaaaacgcatatgtagttgaaagttaaaactacaagcatgttcattcacccaaaatttacgccggtgtccacactatctgaatattttgtcacctgttggtaactagagcttgattgcaaaataagcccctgttccagcaattgcacccagaggggtagaaaccatgtagacccatatctgggtgtaattccctgcgacaatggctgtaccaagtgttcttgcagggttcattgatgctcctgtcgacggcctgtcacccaaaattgaggacaaaaatcactaaaccaagaaaactctagagacaaatcaaaggtagtttttcacacttctatctagtctaactacatgaacagctagtactagtgaatgatgaataatgacagattaaattggctgtttatccatttttcttagtgttacttaggaggtggaatacgaattatatgaaactgaatttcagcaaatctgtgtacttgtaaatgcacaataggatttcacacgcataccctgcgacaagaacgttgtaaatgcacaataggatttcacacgcataccctgcgacaagaacgttcatcatcgctgtaccaccgactgccactgctatcaactctttaacctgaaaatataatcatcctaattaagatcattaagtaataacacaagataaactcttagataacaagaagaaatatgtagttttgtttaacgaaaatagggtgacgtagtaggaaatctagctactccctccgttacatattttagtcattgtgactttaattcaaatataatatatatatatatagcaacctagcttttcaacacaatacaaatactacctccattccaaaatataagtcacaaccactcttaagggcccctttgatttggagaaaaaacataggaattacagaggatttcaatcctataagaaaatttcctatgaagccctttgaaacaaaggattgaatcctatcaaattctttgaaattcctatgtaatggacaatcctatagagattttggaggaaatttaataagagcttcaacctcctggtaactttcctttgagtctatctctctcatccaattcctgcatttttcctccagttcaatcaaacggtcattcctatgttttttctgcactttccaatcctctgttttacacttacattcctactaaaatcctatgtattttctatttctacgttttttcaatcctgcgattcaaatgggccctaaacccaaagaccaagaaataattattatcttgtagcttgaatcattctgacaaatataacgcatgcatccaataagattagataatatgagagtggaggatttaaaaaagtaataatttaatggagaaaatgtcatagttaattgtatatttgcacgcatgtcttatattatggaacatctaaaaaaagtggttgtgccttatattatggaacagagggagtatatgatcaaaaaaatggaagtggaagagactacagatcgggcgctcgattcggattgggaaaaatcgggcgctgacgtcagtgccacgcatgcatgcaaaaccactttaaactaatttttctcttaaattatttattcaaatcatgatccgattgcaccattaaattcgttgcaattaaatattcaaaacaagaccacacatggatctattccgacgaaatttttgttggcttattattgaattatttttaaatgttgcacgatgttccaccaagtatatcggaattgtttcactaagtatatcgaaaatgtttcaatcgtttaaatcggatgttgtttcaccttattaaaaacaatgtttcagcaaatagcgaaaaaatgtttcagttcactgtaacattagatctatacgtagtgaaacattgtgagtacactaggtgaaatatttttggtggaacaaaaaatgaaaagaattcccttaatatagggtttccaaaatatgtgggtgatttgttgtaaaagaatgtttcattcacttcaacattaaacctatacaaagtgaaacatcatgagtatactaggtgaaacatttttggtggaacaaaaaatgaaacgaattcccttaatagggggttttctaaaatatgtggataatttgttgcaatagagttgtgtgtgtggacacgtcgtaggctagggaggagcgcacgcgccctggcatgcacgcacgcggagggcagggggagcgcccgatttctgctcctttcgccggtcacccgacgataatcattctcgtcaaaaaaaaatgtacaatatcatatttaatgaaactaatttagtgttgtagatatttttttatataaatttgatagataaataatgattaagataatttataatataaaacggaggtagtaattatactgcgttgggatcggcagagacagcggtgatgacgaagaggagaacaaacgtggtgacgaactcgaggaagaacgcctccaccgtccccaccttgggcacgctcaccatccaccctcggctcgccggatggaagatcccgtcgacggcggcggcggcggcgacggcgccgaggacctgcgcggcggcgtagggcaggaggtgcgcgggctggaggcgcccgaacgcggccatggcgacgctgaccgccgggttgatgtgggcgccggagacgtgggcgagcgacatgacgagcaccgccacggcgagcccgatggacgccgccacgccgacgaggccctccacgccgccgcgctgcgcgtcggtcacgatggtggagagcatggcgaagatcaggatgaacgtgcccacgaactcggccgccgccttcttcgcgaggggtggacatggccgccgccgccatgatcgacgacgaggtccatgaccacgagaccgagaggccggtggcggttcttcgggattgacgacgaccagctcgattggcgtgatcttggagctatgacttctgccgtcgtcgaaactggtggactccaaatttgcggcggcggcggcggcggtggccgaggtggacgccggtgatgaaccttcatccattttctttgaagcagaatgggttttggagcccgacatgcacacgcatgtgtaatatccaattccaatgtgaacggtgatagctagctgtattttttttttctcagaattagtgggctttttatttttcatttttttaaaagtttgagtctggttcaagatggaatatgctgtccctacatggtatcttgttgtttagaaaaaaacattctactaattcttttattacatagatgtaaaagcagaatatgattttcagaggttggtggtggagcaattcttctccaagagcaaagaaagccaagaggaggagttgacctttgagagttgacaaaaacgataattaaattaagaatttttgtagatcttcgaaatcgaaatcgtcactggtgttactatctaggtgatgatttcccacactacaagaattactaaatactcatcttcaacatgttttttttttcaacaatggagctaggagtaaaaagaatattagttattaacaatagataaaactggttagccaagcaattggagaaaaataaaatttagtaggctgtgtagaaaattgtagatgaaatattgggttgttggctaatatttgcatcgcaagaatctaaggtaggaaaaaatgataaaaagttaaggtttattaatactaatcctgaatgatgaacaaattaaatgatatcctactcttttatgcggaatatatagatgaatatatatcaagaattataaaaatgataaatatatatattgatatattgtggacataatgtgagggctaaggggtgatggttggatatgcttacttttttttttaagaacatatgcttacgttgtggacatatgtttttaagttgctaagatcatatataaaaattgtacacacaaattactttttgtcgctaataagccgttacgggttataataagttctggataaccgatgaggcccctcattataccgttgattagagcacccgcaatggtaaagtaatgtgctatctataaaacatgtacatctcagcaatagactagattaatagtaaatcacttcaatggtatgtctacatgggtatctatagctctctaattcattgcctcgtttttctctatagactatctctaagttagtagataactttgctctctctcttcatttaatctcttccaagtaggaaaatatgctgacatggatctcttgtagatagcatatagataaccattgagggtgcccttattgatggtacgagtgtatgacgtgttctagcagcccccttcaaattttcaacgaacacagatgaagagacaccaacaacactgctacagcaagggtattaatttgggagctctagccagattgaagtggagtatatctgatgaagaagaacagttgagcagacgggtggatcaatattaacaaatcgttctctagctcactcggtttttggactttcggtagagaacagcagagaattctctgaagattgttgaacttgaacagtaaactgaagaaacatgagagagacagagtttggcgctgcaaagcagaatgcaaaaaagctaattacaagaactataaatatatcttctctcaagattatcagctcataatctgacattgatgcacccgggcttgtcaatgcacacattcttggagtattaatctgacaataatacgctgtgacagtatgcgaaccttttcttggagtaaccgcgaacgatgctcgtgatgtgtgcgatttgctcagcagaaggcttactgcatgtgggcatagccaaagcatcccccgccattaaagccaccgttggatagagaaccgacccgtgaaccttccaccagttgagaatatcaaaacctgatgttggatcatggactagctcatccttcagataacggtcgaggtctgtttgggcttctcctcggcagtgctcatcccatgcttgttgcagtggatcagtgctgctaacggccaccacattcatggcactaccatgatcttcaacatagtcagagtatagcttagtgatattttgtgttaccttagagatataatcggctgcagcctcggtgccgaaggctgtttggaaaataaattttgtgcgtgcgagtttgtaccgaggatcaagtacaagtggtatagaccagaccgggtaggaatcttgtatagccttctctatagcgaccattgcttctccaagaacgtctgcaacatagttgccatctttggcgccaggaaagccattagattcattgtaagaaattgcattctctccacttgcccgtgctttttgatccttaaaaacttccctcagcttaaataattctatgagacagatttgatgaagtgtgacaatcgggggcagaaatcctttgaatggaacggtatatttctctccaaagcatatacgatagttcttcaaacactgaatccgttaatgaagagactttattgcgaagaacttccaacgaacagtattccgagtaccatttttcatcgtatgcccataggtgataatctagaccaagttgtgaaagaagctgatggcgctcttgtctagtcaaatctaaatgcagcaagttagagataatatcatctttgaatccttgatgcacaataagcagtctagcaatcgagtgaatcacactgtccatgtaggtggtacaaattagctctctcctatttggattggtatagttttggtttttctctatttcattcctcagttcatgttcaaggttaatatcgttgtcctttgtttcccataccatcatgaacagattatttaaaacctcatcgtttgaaaaacgaaccataactttcttaattgcaaattcacggatatccggatcgagacaaacttcatcaactcccaacaacgggccatggtagtcaagaaaaggaacaatcacgtaagcatccatgattaccttgtgaagattccattcatcatcgatgaagtggcacgccatatacagcacattcccttggatggttctgaccgtacccaccgcgatactgaccttactagggaagtcgtatagcctggagaagatgtccttccttgtttcgtcgaatatagcatcgcacatctcctcaatggcaaggcgcgagggcacctcgaaattggggttgaggcggcgcaagaagcttctgaagtagtcgtcctcgacgagcgacgggtcgtacccgtgcagcgcgatcatccgagcaaggtctccgctggccgccgcttcagggccagaagaaggcggcggtggtggtgctggatgttgtgctgattcggcggcgccgggggtttctttgcgttgctcgtggcgtttccagtgcgccccagggtgctcgtgccgtgattcttggtgtctgcgcggagcaccacgggacaatacttacaccgcgctttggcttgcccgtctccgtcgatgaaacaggtgaagtgcttccacacgtctgaccgcggggctatcttgctgatctgagcttgcgatcgacgccggtgggtgctactgctcgcctctgccatgtttggtcttttgattaactagaaagtaagcccacgcatctgcgcgggcactttatttatttattgtttgtaacaaataatatgaaaggtactcgtcaaatttatttatttattgttttatttatttatttattgtttttaactcatcaaatttactaaaacgacagtagactatcttataatcttcagaaaaataatctatgtcatgaaataaactatagactttgatatactaaatgataagaatgcctctcagagtgaaaaaaaacatactttttatcgattgtatttaaacttgccaaccaatactatttattatcattgtatctgtaccgtcaactgaactcaatacatctttgaaaaaataaaattcatctccgctttatattgaattgtctttgtctcacttatggccaaatctatgtataaatatttcaaaaattcccttatattggttaatggacatagtcgaccttagctgtcatggctttcttctctaatgtgttgaaacatggatcccgcattaacatatccataccccttaagaccaacgtggtgcatcattttaactcttagttcatttaaaaagaacaacatcggtaagtagcccaattgagctctattgctaatggtggcctctcattggagccacttcaatttaaccatatgtgtgaacgtacgatacttacgatagcatagcaatcttggttttctatgcttggtgcttagagagaagatatagatgatgaaaatggtttttttaattaagttttgagttgatttgtagtataaagtagacacattttgatattaaggtgttaatcggtactattatgtaatatttcttcttcattcaacactattaaaaaaaacactccctctgtccaaaaaaactaaattcttgagtttccgtgtctaacgtttcaccgtctatcttatttgagaaaattatgaaaaaatttaaaaatataaatcatgcatgaaatattattcatattttatcatctgaaaatactaatcataaaaaaatttcatataagagacggacggtcaaatgttggacacggaaacctaagaattgagtctttttgggatggagggagtatttctaaagaaatgtaccactttcatcattattatttactctttgacaacataatagtctagtacctagttcattatcaacacctgctatttattatcaatggtcaagtaagcagggtgtatgacatgccaatcagttaagcctgacatattaatatttaaggggttatattatagcaagataatttgctaaaatatcacatccatatatgtatcatgtatatttcccgctcctaaaataccaaccaaatattttattaacaatttttaatttgagaatttggagaaaaaagtaattttgttggtatgcacgttttttcttctcgcctcctgtcgtttacgtttacgtgtactttcactgtgcacgtatgtacttatattcctaatgaatagtcgtaggatatggaaaaaatcatgttgtctatgtgcattcctttcacctagtattctttctctcatgcctctgtatatatgtacgtttcttctggattttttcccgataaaattaaagaaatccctctatttcaggctataagacgttttgcctctagtaaaagtcaaactgctttaagtttgacaagtttatagaaaaaatagtaatattttaaacccaagacaaatttattatgaatatatatattcaattattgatttgat

SEQ ID NO: 67480 - DNA, 3028 bp, Oryza sativa
atagatgttagtattgtactattggtaagtgagaattacccaagccttattttgttggcctacgaattacttatatatatgacattgttgaagctgcaaatttgattagaactctactgggtttcaagttagtccataggtgcaatgaaataaggttttgccatcctatacaacatgctttaagatattctgacatattgttagtcgtggaactgtttctgtgattgccgcctgtcacaatttgactccatatttatgtaaatggatgaagcaattatattttgattttgattttgatttagttgcttggccattcaagctaatgagctatatgattgtttaaggatttgtgttgcccattttccactataggtgaagtttatctgaaacttaattgctttagtaccatttccaagtaggttgtttgggccatgatctaattctctttccaatttgttgataagccagtaaacaaaaacaatcagaggtctatacgatttggaattttcagccatgttgagttgaaatggtatttttctcataaattgtaacgatgtcttacaacatttaaatgttacaatagaattgtgatatgtgttatatctcattagtttgtttgaataccttaagcttattttgattccttctttatttacacgcagcgtagcgcgtgcctattgctagtagatctaatagatgacgcgcacatatataaccatatatatggttaatttctgccatttgattagatttttcttcaaaaaattgagaaaaggaaggcccacacccacccgtcctgtacgtgtgcacagacataaaaatataaataaattaaaaatataattacatatcacttacaaataattatagctaaattagacttgcattttcaaaaataaaaaacgactctatttgtgagtagcattctcaaaattatggtgcatatcttttgactaacttaattagattagaaaaaaagaaagggagaatgagagggtgtactacgtcggctgggggcactcctatatacgtaacagagtataaggaattagtttctttaaaacaaaatacatctaacctaatggtttaaaatatcaggtccaccgatttaagtgaaatataatctaatggtctaaaatattgggtccaccaatttaagtgaaaatcgacggttggattaaaatattgggtccaccaatttaagtgaaaatcgacggttggattagatagagccatgtggcggcctaatagcgtttataggagtctcacgtggtggcttgagagcgtttgtaggaagtttaatggacttttagtatataatataatataatataatataatataatataatataatataatataatataatataatatatataatataatataatataatataatataatataatataatataagattcctcagggagaactgggtggaaaaatggataacaagatataagttttgcctacgagaagcaaaagaaatactactatcaagatttcacgtcaaataaaaaggtactgtcaaaattaattactccctccgtcccacaatataagggattttgaatttttgtttgcaacgtttgaccactcgtcttattcaaaattttttgaaattattatttattttatttgtgacttactttattatctacaatactttaagcacaacttttcgttttttatatttgcaaaaaaaatttggataagacgagtggttaaatgttgcaagtaaaaaatcaaaatcacttatattgtgggacggagggagtagcaatcagaccacagaccatatgaatgcacagggtaagcatgcatatagctagctagatcgggatctcttcacgccaacacaatttagcccaacaagtgcgtcggcatcaataaaaaaaacaactgggaacaaatccgagctcaaaagattaagatgaactcacaggaggattgcagctgaagaactacggccgaccacgcccaaacaacgcaacgaagccgatgggccgatggaaccgaaagtctcgtggatggatggatgcaatacagtcgtccaacctgcaaagtctagtagtctacccttccacgaattttctactctgaccggatccgttgctgtcaattttcgtatacacctaaaaggatacaattcgagttagttaccatgttagttgcacttaatttcagtccaagcatatagagacgtttggaagctttttcatccaaaattaaacaacttgcgatagattttttagatatgcccttaaaaattcattgattttgaatagaaattttctgactatatttaattcgtttggaatctcctctcaaaaaatgtctatgcacaaaatttatgcattaaaactttgcaaagtttatttattaaaagtttgtatacaaaggaaagttccaatagagatcgtctccatcgataaaggttttctaaaaaaaaataattccgtattttgatactccatggctagggctttgattgcagtggaagccctcgtcgattctcgatggcagaaaaaatgaaaagtttgtagcacaacccgtgtcgttcttgggtcaaagccaacatgacagtccaaaatatctaagcctggtataaagtgtaaaggatggatactcttctttttcgagggtaagagctctgccgatttcattaaggaaatagtatgaattacctcccgaattatcgcggtcgtccgaattatcctctaacaataaaactggacattcttcaccctccaactatacaagccggatgaattaccccccaccccccgacccaatccgcggtggttttagtctacgtggcgcacgcgtggcagcccagtcagcattttcattttttttaaacatagtggggcccacctgtcatatactctctctctctccaatcttcccctctctctctctcactctctctctctccctctctcggcgagcacggcagcccgcggcggatacagcgtcgtcgacataatggtcctgcgcgggggagccatccgatgtcg

SEQ ID NO: 67481 - DNA, 7209 bp, Oryza sativa
ttttgaataagacgaacggtcaaacatttttaaaaaagtcaacggcgtcaaacattttgggatggagggagtatattgttaggcatatgtaaatgctatgatcagtgctagctagtgaactaaaaaaacatatataaactcaatttacttttttttaaaaaaataatgacaggaaaagtctactggggattggtggatatactatggcttcaacagtgctccaacagttgtgggttatttcccagctaatctatttaccaacttatctgaaaaggcaactagcattttatttggtgggagtgttttagcagtagaaggtgcttcaacccctccaatgggcagtggattattgccatcgatcctgtctgacaaggctgcatcaattgaggatattttattagtcgatgaagatggcaaaatcgcaccatttgatgtgaagacgatcaaagacgagacctcagacctttgttatgccatgacacctatttttggtgaaagcacttcaaggtgcttatatggaggccctggaggttgcgtcgtcggttaggcagatttggcttcaactaatttttggcctctgttatgtatacatgttctttttcattgttgtcaatggaaccagggagttccatatatggagaaagataatttgaggccgcaccattggttgtgaattttaaagcataatactaattttcatattgtctgatcataatggagtatatttttgcatgtctaattcggtcgtttacattcctcacttattttaaaccaagtagtttacttgtagaaaaaaaaatcaatactagtcagcatgcacgtggatcctacgttgacatatgagaatatatcaacgttgacagttgttaagtaccgatttcgaccgtcaattatcttaacaaataaatatatagaactagcatttttacacgcatatttgtttcaaataatttcccttggagaatattataaatacatggattggctaccaaatgaaggagaatgagccaacatgcaaagaaacatatttccggctaatcacaagagtgcacacagattgaagggcccatttagcacatacttgacaaggaggaagagcatgggagacaggggatcgccctgctagagcccccctacagtgtaggaaatggtggctcggtaccccgttgaccagcacctgggaagaggagcaacggagaatcagggagatccaatcacgccatcgactgctgaacacaagataggtaagcaccttgagcaggaacagccaactaacttgtcaaaggccttcgcaatgtccactttgaggagcagatggggcgtgcgcctagcatggagtgccttggccgcaagctggacatagcaaaagttgttatggagtgaacggcctttgacataagcacttcgattaaccgccaccagctcgttgaggtggggagtgaggcaggacgctaggaccttagaaaacagcttgccaaaactgaagatgaggtttattgggtggaaatcgttaacttgaacaacctcatttttcttaggcaagagagagatgagggcatcgttgagggaggcgagaccatggttgttcgccagaaagagggtgttaagggcaaccagtatttccacttgatcattggccagcaagatttgtagaaatggcttgtgaaaccattatagtcaggcgccttatctaaaagtagctgcttgattaccgcccacacctcatcctcagagaagatgttgtctaggccagcaaagtctaccgaatagagaccaagagagtgggggtcaagacaaaggtctcgctcgatgaacgtccccatgacactgcaaaagtgagtagaggcaagcgcgctggcgcgtgatgcagttcctctgccgcctggccttagtgtgaagatggaaaaacttggtgctgccgttaccctccttgagccaaacaagacgcgaatgctggtgcgcaatggtatgctcaactgaagcaaggtcaaggcacttcaacttaaggtcatgccataaccaggactccaatggagagatgggcgagactcttacatgacctcgagccgaaatataagctcttctccattagcaatcgaagatagacattgcccacgtgctggtagctctagctctgcaagcacttagctgtgttagagaaaccccaagcgagtgctgccattggggaagatgggccggtagttgccactcgtcctacacgacttggaggaagccgtcgaacttaggctagatcgcttcaaagtgaaagcgatgtgctttcgacgagaatcgcaagagtaaaggagtagagcacagtgatcagagataatggaggaggccgcttgaaggagacaagatgggaaaaactcctcgcaatccgtggaaaagaagacatgatcaagtttgacgatcgtgggggaatcgcgctctatgcaccaagtgaagcgacggccatggagtggcaattctcggaggtccagctcgtcaatcagccgtgaagcggcccatcatgctacaattgaggttcatgttgttcttgtcctgggcctcaagaattagattgaaatcactcgcgacaactcatagccccatacgagaagagcacaacgaccgaggctcgtcaagaaaccaaagtttgtccatctccccctgtggaccatagattacaaagagccaccagggggtaccgtcagagtggtgatgaaccaacgctgtttgaagaagtcagcatggtgaatgttggagatagactagacggcggtccgccaagcaagcaacatacgcccactccaaccgatcgcatgcaaaaatgaatggtgaaagtccaggcctagcatttccaaaataattcagggcgagattacatccattttggtctcctctagatagagtagcaagacacattcatcacggacaacaacttggtgggcacgtgagttcagaccctgcatgttccacaccaacacattctcattgcatgatcccatagaggaggagccatacacagagagagagagagggggggaggtaattagtcgtagctagagaagagcgaatacatggcaatgacgtgatcctgagagaatagtgcgttgtaagctgcaaatgcctcggccgagacaagaccctccttcagcactagccctagcttgcgtatcaggttgcgctacacacacgagaccgtgttactgggtccagcgagcatgagcttggccgccatcctcttgttgcacttctgcgctacccccacgactgtgacaacaagtgctataggcgtgggtggtgggagcagcaccgaaggcaggggcttggagaagctggcgaggaaggcacgctacgcggtgttcgccacgatcgagggtgggagcaaatgtgtcatcgaccggccgtcaaagtcgaggactaccacggacacgtcgaacaggacatgtcacaacctgaatttccgttttaggatttataaattatttaataaattattaatagaatttatattaaatgttcattaatttacaagtgaagttaaatgtgggaaataaaatttcctaaatgtaaagcatggttggatttaatttttattaaattctccatgattaattatactctctgaaattttctcggaattttcggagctcaattcctaatgttaataatacaaagaacagtttagcaattatttaaataataaattaatcattaaatgatctggatattattatattaaatactttgagtgtccaagtatgttcaacatttttgttggaattatttgagtattggaagtatttttaacaattgaaagatcatctcattggttaatttatttggaaaagtaaataaaagtcctcctcatcagcttgggccgaatccagcccattccctcctttcccctctcccttcctctcagcccagacaaagtctgtttaacctccctggcgctacagtactccatcttcctcctccagccgactgtctcccgtgccgtgcacagtaccgccgattcccttccaaaatccggccacctcgttgctcctttttccaaattagttgcgggaatggaattctctcaatctcctcttccttttccccaagaaatacccaaatgtttctatggaaatcctttccaatttcgcggttcaacctttcctttttccggcgaagatctaaactttcccgagtttttcccgtcgttgtgggctcgataccggcctcccatggctatataaaggaccccctagtcgtcctctacctatcccctcaagtcccgtccgccgtcgtcgccggaatcgctctccccgcgctctccctctctctccacctccggccgccgctccagccgccattcgccgtcgccccggccgtcgccctcctgtgacgccacctccctcggcttcacagtgaagagctctaccccggccacccgttcttttgcgccgaaccccgccggaagtcgccgtcctcgtgaaggccgaaccgttgccatgttttgatctccggcgaggccctgctgctcatcccgtcgtcgccttcggtcgccgtcgcctcctttgggttcgcagctgcgaggtgatggccgtccacccctccgttgtcgccgcacatcgccggaaagtcgtcgccttcgaggacagtacctcgccacccttcgaagctcgtcgccggccatctttcgttgccattcgtcgtcgcgtaagtggtggtaagggtcactttgatcccctcttcctcccagtgccctccgtttgcattattgtaccgttgttcgccggcaaccgccgctcccatgccgttcgccagtgtaggtttttccctagggtcttaatccaatataatctaatccgtggtttgtctagcgttgtcgtctccatgtgttgctatcggaacgttgtcatcatccctccctctccgatcgttttggatcggtgagacgtctatcattgtctcattggtttagatttcaacccatcggccgcgcttgccaagccgcttcgtcgcaaccgcagccgtgcccgttgcgttgttgttcgccgcgctgctgccctagcctgtgcaccgtcgctaccggttgtgccgttgttgcttgccgtcgccgctgcgctagtcgcctagtcgccgttgtgccctccctgccacagtcgtgttgctcctgctgtgcgttaccgcttgaccgctagctgttgtttggccgttgctcgtgtgtgccaagttgttgccgtcccgctactgcaaccactgagccactggtcgccgtgctgtgattgtgtcgtgccgtgccgttgctgctatagtgtgtcacggccgtgcgtcacttaaatctagccgccgctatcccgcgttgtcgttgttgtggtttgttcgatgccgttgcccggtagccgagttgcaaagcctaaggtgcatccctaaattcctaccggcctatcgtttgccataccggggctttaccatgaatcgtgtctagcccaccggtttagtcgcagccgttgttgagttgttcgctcgttcgttcgtccgtctggagtcgtcctttagtttagagccgttcagagccgccagtttcgttcgccggtttcggttgatcatttgggtgatcccgtgtcacgtagaattgactcgttgagtcggtatctcgtgaggttcgcttgcaagattaatcttagccatccaaaatcaatataaatcatttcctctcttttcagtggcatattatttctttttaatatatgtcatctaccaaatatagtctaatctatttccggaggttgctttaatcttttatctcagttataaatcttttgtaaattgtttaatcaatttggaatagtcttttctttaataggcattaattggaattaatcttgtaaaattcataattaattcatatgaagtcagaatgaggccgttcaagtctcataattcatctaaaattatgacctacatgtttgtttactttatatgtattgtttatttggtttttattagtcttttttctcgttttacgtgttagcttggcgtttccgtcgtttcgaaggatcgtaagtgcatcggaagtattcaagaagattaattgaagacccgttattgcaaggcaagtcacacagatcccaaacacaattcctttgagcatgttgattctatatttaaattctctatttatttcaactgtgtatttatttttgaatgtcaccgggtggtgtgaacctattcctttgttatggccagtttgcattgattaccctatttcttgattatctcgggttataatttgactagttggatttatatattagttcaactagatgtattagatataattgcttagccatgcttagaaacattagcatacaattgggataactaatgtttcactactacttaatgatggacatgataatggtagctcacgatggtcaatcgtgattggttaattaattaatgtgccaactaaaacttgataatggtgggttgtgagcacatggttttgatggtcgtgctcataacaattaaggaccggttcacgagtttcggttgtgaaacattaaccgtgtcaaccacaagccagcgtgggcaacggctttacctattgtatagcatggttcattgcggggcaccagactgagaagtggcggagataagtccacgggggtcgctggggagtccatgccttgtttataagggggtgattatgatccaggaatggtgcgctgtggtggattgtgttgtgcgtggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttcttaccataataaatgatgctataactggtaataatttgattagctcctggtttggaatggtacattcctggtttggagatagatctgtacagccgggtatggttgttcaggatggttgggcttgtgcagcatggatgtgctgttcagtgattgattaatattgatgattaattactctactgttttactactcttaaatgtttgctaaatgctgcttttgcaaatgagccatatattatgccatcctttggtatccttgtgcacttgcatatttgctgtgtggcttgctgagtatgtca

SEQ ID NO: 67482 - DNA, 5219 bp, Oryza sativa
tttgaccgtgagagagtgagagatagaagagagagaggaagagtgagagagaggggggaagaggggagagagagtgtgtatatatgacaggtgggctcactatgttttaaaaaatgaaaatgttgactggactgccatgcgaacgccacgcagaccaaaaccaccgcggattgagtcgagggggtaattcgtccgatttgtatagttgggggtgaagaatgtccggttttatggttcagggggtaattcggacgaccgcgatagttcccggggggaggggggtaattcgtactttttcctttcattaaaggaggggagacagaaaagtgttagtgaaaatattgatttacctctagtttattgcggaaatttagctaataaagatggcttaaagtgaaatttactctttattttcccaatttattgttcttgcatcgaaatcgagcgagaggataatttgttaacaatggtatgagagcctaccacgatgatatggagagttggcgactatacgtcttcgacggtggtcactacgctacgctcagtcgggacgtcgtggcgatatggccgcgcaaattaagcatccaccatgctaccgttgttgtctcaagactcaacgcaactacgcaagcgatattagcaacaccagtataaaaagaaatgcacataaatagtttggatttaactgttctcacatgcaaataaaagttcttaaaacgatgactctcaaaacacgaaattatccaacctaacaaaacgtaagtgtttcaccacatcttgttgtctcatcaaccacctctcttccaatgttttcagccatcacaaaagttcactatggcattttgctcagcgtctgagtgaaagaagacggcggtaaaatcaccgagagcttctccatcctctgcatctccggtgtcgcgaacgcggacgaacacccgtacacggaactccccttggcgagctgcaccgacgaggcgcgctgctgcccgtgcgagctcatgccggcgagcacgcacgcgcgccccgtctgcgcgtactcccgctcgtccgccacgcgctcgctcagctcacgcagctccgccaccagcgccgcgcacatggcgtcgtcgtcgtcgtcgacaacacgtactacaatagcaaggatatttggggaaaagataacaaggagctagccagattgaagtatctgatgaagaataacacttgagcatacaggtggatcaattgtgcaaatcgttctctcgttgctcggtttcggactttcggtggaaaacagagaactctgaaaattgttgaacttgaacagtaaaatataatgaagaaacatgacagaggcagacagagtttggcgctgcaaagcttgcatagttcaaaaagttaattacaggaaagtgaaatataaatatcagcactcaagatcatcagctcgatcataatctgacatcgatgcacccggagcttgtcaatgctaaatacgctgtgacattacacgaatccttccttggagtaaccgcgaacgatgctcgtgatgtgtgcgagttgctcagcagaaggcttactgcatgtgggcattgccaaagcgtccctcgccatctgagccacccttggatagagaactgacccgtgaaccttccaccagctgagaatatcaaaaccttgtgctggatcatggactagctcatctttcagataacggtcgaggtctgtttgggcttctgctcggcggtgctcatcccatgcttcttgcagtggatcagtgctgccaactgccaccgcattcatggtactatcatcatcttcaacatagtcagagtatagctcagtgatatttcgtgttacctcagagatgtagtcggctgcagcctcggtgctaaaggctgtttggaaaataaattttgtgcgtgcgagtttgtaccggggatccagtacaagtggtatagaccagaccgggtaggaatcttgtatggccttgtctatagcgaccattgcttctgtaagaacgtctgcaacatctttgtgatcttcggcgccaaaacagccattaaattcattgtaagcaattgcattctctccacttgcctgtgctagttgatgcttaaaaacttccctcagcttaaacaactctatgagacaaagatttgatgaagtgggacaatcgggtgcagaaatcctttgaatggaacggtatatttctccccaaagcatacacaatagttctgcaaatactgtattcgttattgcagagcctttcttgcgaagaacttccatcgaacagtattccgagtaccacttttcatcatatgcccataggtcataatctagaccaagttgtgaaagaagctgatggcgctcttgtctagtcaaatgtaaattctccaagtcagagataatatagtcatctttgaattctggatccatacaagcagtctagcaatcgagtgaatcacgttgtccatgtaggtggtataaaatagctgtctcctgtttggattgattttgaatgggttatcctctatttcattcctcagttcatattcaaggttaatatcgttcccctttgtttcccatatcatcatgaacagattatgtaaaacctcacgcgctttaaaacgaaccataactttgtcaatggaaatatcacgggagagatcccgatcgagacaaacttcatcaactcccaacaatgggccatggtagttaagaaaaggtacatccgcgtaaacatccatgattatcttatgaagattccattgatcatcaatgaagtggcacgctgtatacaacatattccctcggatggttctaactgtacccactgctatactgacctttccaggaacatcgtgtagtttagagaagaggcccttcattgtttcatcaaagatagcatcacacatctcctcgatggcgaggcgcgagggcacctcgtactcggggttgagacggcacaagaagcttctgaaatagtcgtccttgacgactgacgggttgtacccgtgcaacgcgatcatccgagcaaggtctcctctggccgcctcttcagggccagcaggcggcagcggtggtggtgtctgttgtggtgattcttcgcctggtatttcttcgcgttgctcgtggcgattccagtgcgcccaaagggtactcgtgccgctcttggtttctgcgccgagcacctgggggcagtgcttacaccgtgctttggctcgcccatctccgtcggtgaaacgggtgaagtgattccacacgtctgaccgaagggctatcttgctgatctgagcttgcgatcgacgccggtgggtgctactgctcgcctccgccatgtttggtcctgattaattcctcagggagaactgggtgaaaaatggataacaggatataagttttgcctacgagaagcaaaagaaatactactatcagaatttcaccgcaaataaaaaggtactgccaaaattatttagcaatcaagaccagagacaatatgagtgcaaagcgaagtatatactagctaatttggtcatatagctagatcgggatctctttacgccgacacaatttagttaagcaagcctgaatccgtactcaatcaaaaaaccgtcgcgaacaaatccgagctcaaaaggtatcgaagaactcacaggagggttacagttgacagcagcagttgaacaactccggccacgcccaaacaacgcaacgaagcgatggagtcgccggcaacgaaaggctcgtggatagatgcaacgaattattatttatatacacagttgaccaaccctctacacttgctcaagatgtatcgtatgaccagatcagatccattgcgctgtcattttccatataatccgaaaggatacaattattactaaaaacctcatgaagagttttatttacatatgttcaatacacttttatttcatcctaaggctatactctgtcccaggcagacaatgtcgggtttgttagaattaaaatgaccatgtccagattaattctaataaatcccatgtccagattatatcgcattgaaaatcaatgaaaaaaaacctcaacttaaatagtctataatttgagtgcacctattaactgggtgaggtgatggatggattgtcagactcccacgcagggcatgtgacggagacggagcggcgggctgttcgttttctcacatacggatgttaccactatatcatgcggaggccatcaaaaggagtaaacaacacgtaccccttgccgccttctactaccggctgttctcctttcccacaaggtagaaaaacactatgtctctcgtccgaaagaactctctagcacataagctctctcttccatcaagaggagtaaacaacatatacctcttccactaccggtgtctgttctcattccctaaggaggtagaaaaacactgtctcttgtccgaaagaattctcccgcacataagctctatgttccttcgtcttgttctggttctctctggtagatacatcatgttcttatgcttctaagttacttcggtaatccccggtcctaagtacctgcacgcacaggtattcgggacaagcaggcctccggaagtgtatccaccatatatagtacttaggtggacgatcaagtttttgggtacgcattctttgtgcaactgctctctgctttgtcaccgacattaggaacatcaacaccaacaccgctattggatctgaagtattttttaggtatgttctctttatttcaatgttaaacatgttactaaatgatgttattattgttcttagcatattcatatttagcactatcactagaccaccatattatacacaagttatgtttagtatcatattttctggattaaaatatatcaaataatgaccaaatatccaacgggttcccggttatgccacagggaactagggaagtgatggaggagcgtatagaccaattacaacatgccctcctcccatgttgatgaggaccaattacttgaactggttacttctgatttttttcatttttaaatttttttcttttaatatttacagaaataatccatcggcgcaaaaaattacaaaaatagaccctgccgccctccactagggcggcaagctgacatggcaaacgggggaggaacgggcggtgacggcagacgggagagggagggtttttttgcatgaaaacccttgggcccctatgcaaaaaaaccagcccgggcatagtactttttggct

SEQ ID NO: 67483 - DNA, 14957 bp, Oryza sativa
catcgacttgcttcttgacttccgccaactcgctggctcccattctgtaaggcctcttgtggatcggtgcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactgatccttggcttctgcagcactggagactggaaggttaccacctctccttttgcattggtcaacttgatggtgcggctggcgcaatcaatcactcctctatgccttgtcaaccaatccattccaagtatgacatctaggtccttggattcgagaagaatgaggttggctggaaaaatcaacccttgaatttcaactgtcacagctgggcagtagtgagttgtggtcatgccacctccaggagtatgaactcgcattggtatcttaagcttcactaaagataacccatgtgcaccagcaaaacgcttagaaatgaaggaatgagttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggttggttacaattgaagcagagttcgggtttttctcccaacctcttgggctgttctggcagagctggctgagctggctgatctgactgagctggaatcattaatagacttggagtcgggttgaggctgctgtgactgccactgttgttgttcttgttgaaattacccgggtggtagggacggtgctgtcggataatcatggtggaaggtccaccctgacgtcccatcgtgaaacgaggcttctgacacttcccctggggagtcctgaactgggctgccttcctcttacggttcattttgctacactgctcctcttgacggatggccttgtggacctgcttctcaaagtcctcataatctctagagatcaactggttagtcaattcatcatcaagaccagacaaaaacttctcctgcctctcggcatcggtacgcacgtcctcaggggcgtagcgcgcgaggcggttgaactcatgcaaatactctataactgttctggttccttgttgcagggagcggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcataggcctcgattgggttggtggtgcttgagaaagtgggcggcttgacacgaaggaattctaacagtttggactgaggaggtggaggaccaaactgcaggttctgttgctgctgctgtgcttgctgctgcacctgttgcaacacctgatggtactgttgctgcatctgttgcatcatcattgtcatcatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggaggcgactctgaagctcggggcggcgcttgcaatcgagtaggactgacatctaaagtagacaagggataggaaccaattcatgctcaaatccaaattaaacgaagcaacaaatgactcaaacgaataactgaacatgatgatttttatgcatagaacatttttcatgaacccaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaatatttttttaaaaaaaaaaatccgatccgaatgaacgaccaagatttttcccgcaaaccaaagaggcaaaactccaaattttcccaaaacaattccaggagcaaaaaggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacgataattgttgacatccagatccacgtcttacaaaaatagaaaagattacaaatgcagcggaaaagataaaagcgagctaaaccgggaagcttgacttcagcagcgagcggctccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaagctaggggttcttttgcataaagctagcatttaaaaacagtagttgaaagcagtaaaacagctgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaactatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcacccacagcccaccattcaatgtattttaattaactaacaccattgcggtggcaccaatctaaagctatgccaatagacaaagtctatgtaaaaatgtgatccccattagtgtactagttgaactaagcatggctaagcatttcctaaaccaacatctaatcattttgatacccaggttatcaatggcatatggtaaacaataaatggttgagtaataggacccatccctcattacattgtaaaagaatgcaacatttaatagaaatgcgggatattggtaaattgggtacaatatgatcaaaagtattgcatgactttccttgctctcgcactgatgagacctcagcaaagtcttcgagaaaccgcggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaaatcaatttattgcgcaataaagcccagggctgacgtcagcgaagggggggggcggcgccgacaggcggggcccacgggtcagcggttcaagagaggggagagagaggcgccggcaagcgggcccactgggcagcggctcaaaggggaggggtggtccaccggctggtgggccccaccgggcagcggcacagggcgggagaggggcgtggctgctggcttggcacggctcaagccggccggccatggcgaggcgacgacggcgcacgaccgccggcggtgcggggagacggcggcggacggcgcgaaaggcggcggcggacggccggagcggcggcacggccaaaggcggcggcgcacgcgtgaaggggagaaaagggagggggagggaggcatcggccgggctcagctcggcctcaaggccgaccggggcgaggcggcggcgaggcacgaccaccgacggcggggaccggcggcgcgggaagcggcggcgacggccgaaaggtggcggcgcatggccgaagcgcggcgatgcacgtgcggagggcggcggcaagcggtggcgctagcggcgagcggcgtgggctcgttaggagacacgggaggggacggcaaatggggaaaacgagagagggagctcgggagagtgatttaatgggcgaaggaggggaggacgtggccgggaaccctcccgatttagccggcgacgtggggaggagagagagaaagaggggtgggattcgaaatcgaatcccgccctctcgagcgcgcgcgcgggccgggagatgcgggggaagaggcggcgacgtggggaggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgttccggagagagggggaaagggaacgggccggcccacaaggggaggccgagcgcgggcgacgggtggactgggccgacggcccaagaagaggaaaaaggaaaaagaaaaagaagaaaggattttcctgggattaaaattgcactttggtgatttttaattggttaaaattatttccaaggctctgaaaattccactaaaaatcttgttaatgcattggagcatggggaactcaagaaaaattccaccatgccaattccaattattaattgcatttattagttagggaattagctctaggttaattaagataatttcttcgggcaatttatttaacaaatttttaaagcaaggagagggggaaacttcagggcgtgacacttcgctagaccgtaattccgctgcaattttcttttcttttgtaagtatgtaacgttattatattgatgaatctgtatattaaattgtcagtttgtgtacctcggctgattcctggacgaggatttaatgcacaaattagttcggaaattactagtgaattttcgggcgtgacaggacccgtcccccacaaccgaagatgaggggtcggccggcagagttcccggtggcaagggcaagaccggcggccatggtggtggagatggagcacgcccagagcccctgaaacccggactagaccgaggcgacgaaggagacatgccgattgctagagggcgtccacccgtcttcaaggcgccgtcagccaatgaggcagagagggagagagttgatgttgtctccatcatgggcaccgcgccattgtcgttggctggtgggtatggagaagcctgaggcgttgggggagccgcaccattgtcgttggctggcggtaaaaggaaagccagagcacgtcggggaggagagagactccggaggcacgaagccagtgatggagccgatgatgtcggttgaggaaaagccggtggcctgtcgcccgtcggagacgctgcaccaggtactgagatggtggccagcggtccgcccgtcacagaagccacactatgacgacggagaacagtagcctgacggcgtcatcggaaaggagagctagggtcgacgcacgacgacgaccagagtggctggcagagcgtcgatggcaccatacaccagaggaatcggaggtccgttgctcctcgctagcgtcacaccgtaggccgtcggaggagcacgcatcgtttgccgcggtaggggtgtgcattggagaggagagagctgccggcgccacgctgtcccggtgagccatcgtcatgtcccctgcagcccttggtccaccgccattgggcctgcacgaggcgccccaggcgagaccgcgcacagccgaggtagactgttcctttgcgatagcccaatatgcgagggtggcccaagtacaggggcggcccaacaggtggcccgaggagtgaagatggcccagagagcagagccaacccaaggagagagaacggcccatcagatggagatggccgagaagagccagcggctcagcaggtggaggcggcccaaggagaggtggaggctgagggagtggggaagctgcttctcgaagcccggtctcgactcacatgggatccggtgtggcactagacacaatggtcggtgccacatgtcggctcgccattgcctcctcatggggaagaccctggtcaaaagaaggaaatggaaaaacctcccatttttagcaccaggcaagccgccggcgagggcgaatctagagcacagagaagccgagtgcacacttaatttacacaaggcactcaggggttgtagctgttgggcatttgggcagttcgggctgcacgtaagcaatttggccttcatgagctgcctgcagcctgcaggctgctgggtagctgaagttggtacgagtattttttttctagagtgcacagaaggtggtgaaaattactaccttcgtttcaggttataagactttctagcattgtccatatttattgtttcaggttataagactttctagcattgtccatattgtccatatttatttatatagatgttaataaatctagacacataatacaatactagaaagtttaggaagtaggtgcctgctaatatgattcatcagtgatcagtgcataaaaacctataatgtttgtcaaattatatacacacaatagcgacctcgacaaactaatatttagtagtatatatagtataacaaatgatgtcctccatacatgccaacaactaggaggaggacaccaaagcatgcatatatactcaaaacacatcaaaatacaagtaatgaaacacagccacactgtacaaagccaaacagacaaagctcatcgttcgatccgatcatcacttgccgtctccggggacggcggcggccgtgtcagcggcggcgccgccacgttgctgggaggagacggcctggacgaggtggtgcacggccttgtcatagctaacgaaccccatgaaccagaagtcatgcgagtccaccgtcacgacgtgcacgtacttctccggcgggctctccttcatcgtcaccggctcggcggcggcgaccttggccaccgggatcatcaccttgtagtagctccacgccgtctgccccgagggcgccgcgaaggagagcggccggtcgctgcagaacgcgacgctccggtcggtcaggtacagcgtgccggcgacggggcccgtcgccgtcgagaggtagcaggcgaacgtcttcctcagccgctcgtcggcgccggcgccggcgaacgtctgcttgtagagcttgtcgaagccgccctcgctgagggccttcgctcccaggctcagcttccccatcgccgcgtccgacatcgacggcgccgtcttcactgcaaagaggagcgaaggaagaagaaggtgacacgtcagcaacctgttcgtgacacgtgtcgctggtcaaaggacacgtggcacacgtgatctgaagcagagaaggtaactctgctccggcaactagaagcatcagagtttgcatctaattttgcatttctgttgagtaccagtaattactccctccgttcataaaagatgaaagatatatttatttcaattttttttatcaccaagaaaaaaattaacctcatccccagtctaacaaaatagaaaaaaatctatatgcatacaagaattaaaataacagcttagtttagattaagaaataatttaacacaaagactacacaactataattatctcttttagaaaaactaaaaattgaaacattcttaacacttttggactttggacagatggtgtggttctatacagttactaatcctagttgatatctttcaataaaaatacatcaatattcaaacttgtttcctgaatcagactcaaaaatccaaactcttgatccaaaattaaaagcttgttactgccacgtgtgggcgtggctggtcaaatcacacgtgagcagaagctttggcgcaagaagcagagtaaaagtggtaatcctaatcaatttctcctcaaataaaagaacaccaaaattaaaactgtcttttgtaaatcagactcaaaacgggaaacattttaagcaaagatttgagagttttggatcacttacggttgaaccagatgttggaggcgagctcctcggccttgcggctccaggtgttgaagaagtcgaggatgtgctccatcgggctgtcccctctctccggccgcccccgcggcggcgccgccgccgcctcgcccatgatgacgtagggcgggagctcctggtcgcccctcgccgccgtccaccgcgccgcctgctggttctccgggtgcgccccgggcgccgccggcgggcccatctgcctcgtcccccacttcgccgcctccggctgctgctgctgctgctgcggcggcggcggcggcgcgttccccgtcgtctgaggctctgccgccggcgccggagccggagccggagccggggcaggggcgggggtggtggtggagtccttgccgtccatggctgggtgagtagctgtagctacgagagatcgatgaggaagaagggaccgagagagagatggatgatgctggaattgtttggaaattggaaagagcagagatgaattggatgagcggtgtgatgggtttttatagcgtgggccgtgctgtcggtttggatgattgggatgtggattttcagtatgttccttattgcttgcatttttatctaaatatttataaaaaaattaatttttaataaagatagattaatataaaatatgtcactacataaacgtatagtcaaaattaatttctacaagttgaaaaaaataaaattggaaataattatcggatatttgtagttatattttttttacaacttgtaaaagttgaatttgtgttagcatatttgtgtaatgatatattttatattaatttatcttgtggctttttaatattttatctataactattaacatatacaaaacgagaggacatataatcgagggatgaaatcacttttccggatgattggcttatttgtggagaggcctcctgtttacctctgtacagaatccgttgtctaaatttaaattttgaaatttagttgtacaactgattttaaagtattttttatcaaaatttattttttataaagatgtgtaaatcgctaagaaaacatatatcaaacttttatcaataaaatattgttttcatgacatattaacagtatttggctataggggacggagccaattgctgcggctatcaagtttaatctggtaattacttaattcttttaccattttaataaatttaaaattaaaattttacaatttcaactataataactttaaaagtatttagtttaatgatcctagaataatatttattagacatgttcgtaacgtgcaataataaaaaactatttatttattctatattataattgaaaaaacatagtcagagactcccagtgtgtacttatgttgggactataaattttggaggccaagtaattattatctaaaacattagtatgaaaccggagactactgtattaaacacgaaggcccgaacgaagggcccgtttagtaaaattttatcccaaattacattggatatacggatacatatttaaagtattaaatatagtttaataatgaaaataaattatagattccgccagaaaactgcaagacaaatttattaagcataattaatccattaatagtaaatatttactgtatcaccacattagtaaatattcgtctagtaatttcctgatgaactatgtaattgattttttttacattaaatattttatgtatgtggtagcgtgaaaagttttgtttggaactaaaaaggccctaaattggcaaactttaaactagtagcacagaaagtgaaataaggaaatgattaattggagagagtagtctgagtcaaattgattttcttcgcgagcaagaaccttcgaggcgcggcatccaactaatccacgaggatgcagcgggcctacgtggacacccggaagcttagcccaggcgacaacgtgtcctccatcccccttcttttctttttccttccgattttattccttctgtgaagacgccgtcgtcagattagcgttgctcctctctctctctctccaatgtgaacaactttttcttctggaggcgtcacgcggtggcggttcggccggcttccacgtgtcacgccgcaggaaaaagagaaagaatcgaccatcacctattcctaggggtgggcatataaaccgagtaccgaacctgaaaaaaccgaaaccgtacattgaagactgaacactcggtcatcgtcgtttgtttaagcatagaaaacaaatggttaattggttaatttgatccataccattgaaaatatggctattcagaaaaatatcattttaattcgcctatatatagccgtgtcacttatattttacaaaattaggaccattccattgccagtgggttttccgtcttctccctcacctctacgtgggacccacgtatcattttcgtcttcttcctccatcctcctctctttttcttctaccacttcttcgtttcttctttctgtgaacacaagtagagcacaaggaggaaaggagcagggcgtcagtcctcccagcaaccacagagcactggaatctttggctctttgcagtgtagcaacgcaccctccctgacgagcttcggactgaccgcggattaatgctcaagcgctgcggcaagctgctgagcagcatccaggcgttcacggccggcgacgactagtacccaagcctggtgtccatggtcgacgcggcgacgttcctcgctgacgagctctgagctgagatgaggcgcgcgcacaaacgtggaggtagatcgagtggctggtgttcaaggacctcgtcgtcgtgcagatctctttctcatcgtcgtcttcacaagaagagtgtgaagaaagaagcgtcgccacctcccagccaccggagcaccggcgccccactcctctcctctacctgtgaaggaagaagaaacgaagaaatggtgaagagaaatggaaagagaatagaagaggaggatgaagaaaaaagataaatctgatggatggttcccatgtatagatgaaagagaagctgaaaaacttaacggcgatgacatggttttaattttataaaatataagtggcataattataaataatcaaattgtaataatatttatctgaataccattaaattaacccaaaaacaaaagaccgaacatactacgatcaattcggtcatcatgcctggctaaccgaagagaccgacaaaccgaacaaacaaaatggcccaataccccatcaacccaattgaagcaagcaagcagcccaatgggccaatctcaactacaccaatcaaagtagtccagatccaaaccctagggcctaggcagttctctgcagggcgtccagatccaactccccagcgccatgcctcagttggctgtgtcttccgccgagcgtgtgctactgctaccgcgccacccccgacgcgcccttgttccgccatggagccgctgtccaccgcgccacaccgtcgcccgtcgccggccgtcgcggctatgttttgccgcgaagctacctagcttccaccgcgctgctgtgccgcatggaatcatcctacgcagcagagggggaggtcttcactcttcagcggtaagaagatgtgaggctgtacatgttcggtcaactcgatttagaccgaggaccgaaccgaactatcggttaaccgatctgtcggtcagtactcttctataggtgagttcggtttccttttctcaaagaccgatctttttaaagaccgaattaaccggaccgacctttcggtctacaccgaatacgcaccactagctgttccattccctctattttgggccatcggtccgccaagcgatcgaactggcgggtcggcaatgggtaaacaatttttctttttttttttttttgaaaaattcacttttactctcttcactgttggctgtatcttatttatgccccttaaccacaaaactgattatattgacctctcatctattaaaaaagcagtgcaaaaaatgattcccacagttgttttaagggtgtttttcgcttacgtggctcgttgagctgatccaactgactaagttagcatgtgggcccacatgtcagtgtcgcctcctctttctcttcctctcttctctctcttttttttttctcccctagctatcctctgactccgagcaccatgcctctcccatacggtttttcaaaattgatggccacgaagccctcatccaagccgactactcctgaactgacatcgttaccaaatgatctcatcttttcgcttatgcttatgcttatttgccaaaatttaaattttcaatcttaaatttaaatttgtagttgattttagagttttttcatcgaattttatttttcagcctttgcttttatatcgctaacaacacatacatagtttctggttaattggttacaaagtttataattttttttctacgaggttgtagccttttataatcttcttttgctgcaaatactattcttcctttataaaatacactactaggcaaatgcctggtagttttctcttaaaaaagttttatttataaattattttttatttgtaaatatgccatgatgtgtttgaaaaaccctactggctgtcagtgcccgagatcaagtcgaacaatacggcttgagatcggctacaccccttcccctggatcaacatacagatttttttagataatgggaaggatcaacatacagatggaagacacggcgtggtgactaactgacaacggattcaaacggtgctgcatatcttctgacaacatggtggatcgacatgcccagacagctacacgtccggaggcaattcaacgactaccagcacacaaggagttcaatttaggagattagaatggcttaaaattaatctattgattttatagatatagccaacatatatctacacaggtacacaatattttatatataatttaccgtacctattttcagatccatacaatattgtcaggtgcgtaatttattatgtttacctaaaagcatgttttttttacgatatctgttatgcgaacgtctcctatattaggcctatacggtctaatagtgggggctcgctatgtttttctatagaaatcatgcttgtttatggtttacataatacatgatatttcatccgaatatgctcatatatcatgattatactagaagatttagttttttgagtacgcatttggtattctctgctatatatcttgccttctagaaaatacttttcaggaacaatcgagcattcgagtagacagtggtcgagtacaccccgtcgtcgagaactaatgcggagttgtcgaaccaaatctaccaacaaaaaccgatgacatatctcacatctaacactggtcatgtccggactatttgtgaaaagggtgttgaggacaatctcttcacgaaagttgtcagcttgatcatccgacatgattgcgaatggacatccgatatatatgctactagttgggtatgtgagtcatgctggccacatgatatgtacacgtaataaccaactctagcacccctaaaagtggtcgagggatgactatgtctggtcctcgatcagcgttgtagcgatctctcaccacctatcaaagttaccttcgggtggccgagaaatgactttttcgacggagtagatcgcgactaggtatttgtagagtatggggatcgttattaccaaggtatacgcaagattgaggtaaaagaggcggagacatggacttttatacaggttcgggccccttatatgtaaggtaatagcctgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgcaatattctttgtgccctaatgtactctccggaattttccgtgaattttcggagctcgagaaatagttttaaagtcacgaagatcatttaaccaattaaaataaaaagaaaacaaataaaatcctccctcctctctttgggcccctttcggcccaattcccccccctctctccctctcgggccggccttctccctcggcccgctcggctctctctctccctcaagtctgctttgcctccccagccggcctctccctccctctctcttccgacaggtgg

SEQ ID NO: 67484 - DNA, 10375 bp, Oryza sativa
  unsure (1)..(10375): unsure at all n locations
gtggtaatgggtcagatccatggacctttcttttcacaactatctcagccttttaatttttttagtcttgccaaaatcctttttacgcagcccttacatcttgtaggaaaaaaaattaggctcgttaccacgcctaggtttaaccagcaatgtcagaggtggtttaccgtgtttaaatccacggtgaaaaattttagcatgtcacattagatatatggacacacatttaaaatattaaatatagtataataacaaaacaaattacagaatccatctgtaaaccgcgagacaaatttattaagcctaattaatccgtcattagtaaatatttactgtagcatcacattatcaaatcatagcgcaactaggcttaaaagattcatctcacaatttacacgtaatttgtgtaattaattattttttatttatatttaatactctatacatatatccaaacatttaatgtgatagggtataaaattttaccaggatcaaagcagaccccgagtattgcggctatgtgcctatgccacacgatagacatgctgctagccgttcgggtcgatgcggttaaagaacggaggagttcgacgtgcacaggtaaagcataatctgtctaagtggtttagttcctaattttttcttcaaatttctagctttttcatcacattaaaatttttctacacataaatttttaacattttcgtcacatccttccaatttcaatcaaaccttaaattttaacgtgaactaaacacaccctaaatactcagacaccacagattcaacaaaacagctccaaaacacaactgatggatgatgatccatccaccattctaccatttgttctctcaacgcaagcgatattattagtaacaccatggcaccatgctaagtgagctaatgcatattaaatagttcggataaaactattttaaaaaactaagttcgaaaaaaaaaattaaaacaggaaattatccaacttaacgaaaccttgccgctgccctctcatcctatgttttcagcgtttgagtgacagaagacggcggtatttcctcaacgacattatacgaggtacagccgcgtcgaaccttgccttcagtgaaccaccggacttgcttgccgccgccgccgtcggcggcggtggcggcggtggaggcgccgcctgttgctgctgttcacgcaaaatcaccgagagcttctccatcctctgcatctccggtgtcgcgaacacggacgaacacccgtacacggagctcccctagctgcaccgacgaggcgcgctgctgcccgtgcgagctcatgccggcgagcacgcacgcgcgccccgtctgcgcgtactcccgctcgtccgccacgcgctcgctcagctcccgcagctccgccaccagcgccgcgcacatggcgtcgccggacgccgccggcgccgacctgctcagcgcctcccgcctcgcgtcgaggatccttgccgcctcgccgtaggcgccccgctcggccgccgcgcgcgccagcgcgatgtcgtccgccgcctcgaggcggacgcgctcgcgctcaagctcaacctccatggacggcgccacgcccgtcgcgacggcggggcggaggaccacggcgtcttcctcgccggccacgtccaccgactgctccgtcgccgtgtcccggtacgtgcagcgcacgctggcgaggcgcgtggcgacggcggcgtcgccgtcggctcgaggcacgtcaaggaggagcaggaagcggcgctcctcgtcggcgtagagctcgccgacgtccaccgtggcggcgcggccctccgcgtcgatgcggctctcgtagcggccggacttgaccgcccggacgcgcacgccggggtccaggcactcgacggagatgcgcgcattctgcgcggcgacggagaggagcccgccgatgcaccgcgcgaacgtgtcctggatgacggcgaggttctcgatgaaggagaaggtgccacccgtgatctccgagatgctgtgcatggccgccgcgtcgtggtcggtgccgaacccgaacgcgtgcaccggcgcgcaccgctcgccgccgccggcgcgcgtgaaagacggcggcacgaggacgtcgtagctggtcgccgctgccttgaaatccgtcatgtggaagcggccacggtaacccatggtctggttgtcttggccgtcggagaggaggatgacgctggcgacggcgtcggtgtggcggcggccgtcgagcaccttggcgtccacgtcgaggccgtcgcggatgttggtgttcccgttcgcgacgagggcgtccaccgcgcgcttggccgtgccttcccgtcctccgacatgcgcgtcaggcggagccgcggagcacccggcgcgcgtcggcgtggcgaaggcgacgacgctgaggcggtcggcggcgccgaggctgtcgatgacgaaccccatggcgcgcttcaccagcgccagcttgtccccggtcatgctcgtgctgacgtcgagcaccgtgaccaggtccagcggcgcgcgccccgccgcctcggccgccgccgcgggcgccttggcgtgcaccagcacggcgaagccgtcgcgcgcggcgccgcgcgagagcgccgggtactcgcagtgcgtcttgagcaccagcacgccgccgccgccgccgctgctgttgcgcgccgccgtcgccaccggctccaccgggtcgtcgtcgtcgtacgcggcggggatggaggaggtcgtgagcggcgacggggcgtcgcgccatggcgtggcgcagacggggcaggcggcggcgccgccggggacgcagcggaggtggaaggtgtgggagcactcggcggtgaagatggcttggccggcggccatggcggcgaagcagacgggacaccggatgccacccatggccatcgtgccagctgccatggcccatggatcacctccttgagcaagatcgatctccaacacgacatggatcacctcttttttgtttccaaatcatcttgctccgttattcagtaatgatatgatctttttcggcttgcgcgtaaagctaggaatggaagaacaccgcggtcgctcttacagacaagcaggggagcatagacccgagaaagctccgtcgttcacgtgtcttctatgggcctataggcccaaaacaactatgggtcagtttggtttgaggcctaaattaggcttgccaattttttggcaacctcaacaataattgtgtatgtttggattgaggccaaattttggcatgcctatataacataggccatttcaatagccaaattagtttaatttggcttcaatccaaacatatgttggccttacnaaaatttggcatgccnnnnnttgnnnnnatnnnnnnnnnnnnnttttggtaaggccaacattggtcacgaaccaaactgaccctatgagttttttttttcgttttgaaataagtccactataactcccttaaatatacttgtaatccaattcgtatcccttcatcgcaataacagatatgttaaactccgaactattaaaaccattgtaaaataactctcgacggttttgatgattttcgctgacgtgacgcattgacctagtccaaatgtttagtcagtacgtagggatccacgcgtcatactctctccttccccagcggcaccgccccagccgtggccgctcatacacggcccgatcgagctcctgcgtgtaggtaggggtgtaagtgggtcagccgcgaacccacttataggtcaaaataagcgggttcgtggcttattttagcttataagtgggtttcgcgggttagccacttacacgtctacgtgtaggtggtttgggctcagcttcttagtaacatcatgcagtacaagtaataaaattcacacaaaatacaggggaggataagcacctgtggacagcttcctgatcacttgcctcttgaggctcttgttgactactccacgcttcgcatccgcttggccggtacggcttgctccgccaccagcgccgccggatcgtttgctcacgctgccggcagcttgatgtgacatcatgatttaaactgtgtggtctataatagctgtatgcgtatgtttaatatcatctttctagtttatcaagagtaaaatttacttatactggtttgtctctcgaatcatatcatttccggattaacccttttacatcaaccaagtacaaaaatataggtaaaatggcatgtgtaagtgggtccgcccgttgaatgggctaggcttcgtggctctgtatggcaggctgttacaaggatgaacatcgcaaagctcgaagcctcgaagaagacgccacacatcttctcctcagcgagcatgctttccttcgacgcccactagaagcccgtgctaacagtgctaggggtgcaagcggccaccccatgaacccgcttataatagaaataagtgggtaacccgtctaaaaggggttagctggttggcacactcttgtactcttagagtagggtctcttatctcgctcaggtacccgacacccttgcacatgttgacgaacacgttaggacccttagtctccggaccgaaggcccagatcttcttggacagatccttgtcctagtgttaacgccaaaatttggtaagccctgaagtcatcatcgtcttagagtcactatcggcttcacaatcttggaataggccgataggaattatcaagttgccaatagtcggattcttagtagattcgattaaggaaattaatttattaaaagaagtcaccgagttcaatgatgatgcggcataacagcttatctattaattaggaagactttgtttgtttctttttatctttaggaaagtgtgcttagtgtccgataagtactttatgttttccttttatctttaagcaaatttcattcttatccaagaagaactagtatctacccaagagtataaatatgtacacacagagtcattgtaaattatctctcgatcaatacacgcatcggcttcttttacctttctactttttcgatgagttcttgcttcaagttagggcatcgttcgatcttctgacaacaactatgacttgtctcagcggtttgcgttggcagattagggcgtcactttagatgttctaatctatcttctacagccgctggttatcatatatcttagttaatctagtatagtatcttaatttgatcatatcggctgagattcgttttagagtttatactggtaccgactaaattatcttgctagattagattaactaaggtatctaccactctgaaaatcagttaaatgcataattgtctagatattatgtttctttcatacttagtgttgcatcagttaagtttgatctactaggttgtgcaagaaccataatctctagcctatttctaattagggtttcatcgagatttcagccgatgagttatctgcgtgttacatcggcttataaggattacatgcaaattggatttagccgatcgcaacaaagattttactgtttacctaatcgtttggattttatgccatcaatcctctagccaatatatactttaaacttcggatcaacacttgctctatcatatcatattattggtcgattggtttctaattgtttatattactgttttattacaattttttaaggtccatgtggctcgcttgacctaataattattattaaggagctagctaattatttatttctcgatgatcaactcaacttagctaacttgttatatagcacgatcggtctgatctgaaatcagggtccgctctggagcgatggcctagggcctaattataattagggcccctgcccaggtatataccttgtataggtatgtagcccaattatttggcaggaataagttcacttagtgacccttaaaagtgatcaaaatctaatctgtgaccctaaaccacaaaaccggatatctcgacccctaaactcttaaaaccggtacaatttgactcccttagcagttttggaggacggttttgctgacgtggcgcctacgtggcggtattaaccaggtctcctttacacgtggcgttgaggtggcatttaaaatttaaaaatatatgtgggacccatttgtcaatgacacataaaaaaatttgtgggatccacgtgtcacttctctctcccctccctccagttccttctctctccacgccactccctctctcccgcggcaatgcggcggacggcgagggccggagcggcggcgggcggagacggcggcgagcggcggagatgcgggagtggcggcggcggcgcccggccctcgccactccctctctctctctccttctctcccgcagcgagcggtggtgggcggagacggcggcggaggcgcgggcgtgacgcggcggcctgcgactgcgagcggcggagacacgggagtggagtcggcaggcacagaggcactggacgaccggtggcagcgacacctgggctgagcttcaccgcctcctcgccgacgacgaccaggcgtttgagcaggaggacggcggtgggaggcacacgcggcctccctatatatacggcctaccgtccagattcgttaacggttcacgcctcggccgcatccctcctcgcgcactctccctcgtgacacctacggggctcgccgacaacatgaacaagaacgccgcaccggaagacggcgagagcggcgagcacgagcggaaaggtgcgtacgtgttcgtccttgctggttcttgatttcttctccccggtttttttggggggttttctttgactggttacggcatgcatgccgcatgggtcatcggctatttgttttcttgggacaccttgcgagttgggttgagattgagaattgtttggttcgtttgagctggtggtgattccggttaactgggtcttttttgcaggcacggtatgggcggcgacggcacacattgttacggcggtgatcggctccggcgtgctggcactggcgtggagcgtggcgcagctgggttgggtggctgggccgctcgccctcgccggcgaaggcaccggcaccgacttggaccgcgtcgacatgagccgatgagcggcggcggtgacggtggaggacgtcgtcgtcatcgaccccgccgcgtgtgccttccgccgccgtcctcctgctcgaacgactggtcaccgtcggcgaggaggcgatgaagctcaggccgggcgccgccgccgccactcccgcatctccgccattcgcagtcgcaggccgccgcgccacgctcgcgcctccgccgctcgccgccgtctccgcccgccgccgctccggccctcgccgttcgctgcattgctgcaggagagagcgtgcgcgcgaggagggagaaggaactggagggaggggaaagagaagggacacgtgggtcccacaatttttttttatgtgtcactgacaaatgggtcccacatatatttttaaattctaaatgccacctcaacgccacgtgtaaaggagacccggtcaataccgccacgtcagcaaaaccgccctccaagtgtcaaattgtaccggttttaagagtttggggttgagatatccggtttcgtgttttagggtcacggattagatttcgtttacttttgagggtcactaagtgaacttattccttatttggcactcctcggtttcctggtggcccagcctagcgctaacgacgtgcaaaaacgtaagtaataagttcacttctggtcccttaatttgtcgccgagtttgaaattcatccctaaatcgaaatagcagatatagcatgtccgtcaactctcaaaactactacaaataaggtcctaaggcggtttgggtggcggtttcagctgacgtgctatacaaaccatctacgtaggcgccacgtcagctataaccatcctccaaaccacatggagaccttatttgtgacggttttgaaagttgagggatgtgttgtatctcgtattttggtttagaaatgaattttagactcggcgataaattaagagacttgtagtgaacttattccaaaacataattgcacccaacccgatgcttcgcgcttcttgtgacactctgccttccgctcctgtcgcatggaaatcgcggaggcgccgtgatgccatggagacaacagaactggaggccggaagcggaaacaaattaaccatcaaaagtgaagctagatcaggtgatgatccaatccatcgatccttctcactgattagaattgatttgttctgctaatcctatttgttttcccccttctattgcctaggttaggaatctgggttcaactgttaaagggatcaatatcttcaacaacattttgcttcaagaaatacccgaataagttctttttttataaaagtcattgggtatttgtggtcttctatcgagctatttatactactttgtttctacatgtttttggttgtcaattatactgtcaatattattaatcgaaaataaaatactactccctccatattttaatgtatgacgccgttgactttttgacaaacgtttgacattttgtcttattcaaaaaatttatgtaattataatttattttattgtgacttgatttatcatcaaatgttctttaagcatgacataagtatttttatatttgcataaaatttttgaataagacgagtggtcaaacgttggttaaaaagtcaaggcgtctgacggagagtggggctcctcaccgggagaccgcgcaggcccccctttgccggttcggccggggaccctaggtgagactccaagctcccaatctgtatgtggaaggttcgcgagacaggaagcacagaagacgccggcgatgtatacaggttcgggccgcttagaagcgtaataccctactcctgtgttttggtggattcgtgtgtgaaggagctacaaagtatgagcctgcctctcccttgttctgggtttctaatctggaaaagtccagtccaatcaaaaaacccccctctctccgtgggcaaggtcctccttttatatcttaaggggataccacatgcaccatcccccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgaccagtgtcagactggtcacaaatcggtcattcttgtccaccacgcgtcatcttagcaatctgcacgttggcccttcttcacacaacattttgcctgtaatggttaggatgaagcctggcatatatctgaccaggactaacgtgtcatctctgggaggtaacacgctgatccagctggggacgagtgcctagaagcccttgtcctgacgggatggggcgaggcgtgcgtcagatcgcctgtcgccacctaacccgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggtgcggctcgaccccctcggggggactaagaggagggcgaacacatcttgggcccgacgtcccccgagggtgccaggccacgtgggcgattgtgtctgcctcaaacctctagtcatgatactcccgatcccatgtcaccgacagcgtcatacattaaaatatggagggagtatattgtaatttacaactacttgatttattatttatcatgttagaaatgtttatttatgtcactttcataggatatgtgttttaaagtataaattataagtaaaaaactttaagaacctatagtgtcgagttcgtatatgtcatgttgtagatcacgactacggtatttgcattgtatagggatcgttagtaccagggtatacgcgagatgaggaattttttatacacgttcgcctctctttatctataaggtgcactatgacgaaatccatctttagtggcggctattttgggttttcgctggcggaatttggacccgccacaaagcagaggccagtgacaatcaagattttcgctagcggttatcgaccgctagcgaaaaaacattttcgctggcggtcatgttaagccagcggtcagcaaaaatccattttcgctggtggctggtttaagacggccgccagcgaaaatatttttttttgctggccgttacactataccagccgccagagaaaataatgaccaaattttaaaaaaaagacggacggagcgttcgctccgtccgtcaacgctccatccaccaagcat

SEQ ID NO: 67485 - DNA, 933 bp, Oryza sativa
taaacttagtatgttgtaattttatagaaaatacagatatgtagcatcaacctatctaaaaacacattaagcaagctgacttataaatgacatgtgaaaattgaagacatgcatgtttctcttgagagacgaaaatccacctcctcgatataagaagtgctatccactactccctctcccccttatatataagtgattttggtaggatatgtcacatccctccaaaatcacttatattataggacagagggagtagaagctagctaaggaattcagccgtcagaaagcaaacgtcagcaaccgcactagtatacttataaccccagctagcaggattatagtataactatacataaattaactactattgggggagtggctccggattgacggagttcatctccgtcaagtagcttctatcccggagctacccccatcctgggaaaacgaccgaagacagcctggagctcccatggccatcatgcctccgaaggctggccaagggcaccagagcctatcagcccagagcccatcaaacccccggatccaaccaagggctccagagcccattaagcctccagactctagaggctatcaggcccgcttgatgcacctggccttcggagccaaccaaggtcttcggagttggccaagattacggagcgctgaggaagccccaggccggaggcgaaggcggaccccgagagcgcagtgggccgtaataaatacgcactacgcacccgccaaccatatctggcgtcattacagggacgggccagcacaggccactacccggaaagcacggctttgcccgggtaatagccagcaccctcgggaggcgttatcgccttcttaatgggcgcagccatccctgtcattggggattttactaaaagctcgagggcgggcccaccggccagccactctagattg

SEQ ID NO: 67486 - DNA, 19045 bp, Oryza sativa
aaccaccccacttcgcccacgtcgccggagcccactccgaagaccgttgccggtcgattccgccctccgcggccatgatcccaccgccccgagccaataaaaacgatccccgtggtctcctctcccatttccccaactttcccgagctcccggcgccctcgcccgctctcccctcgccaagccgagcagccgctgctcgccggagttcaccggccgcattttcccgccgccccagccaccaccgcgccgcgccgtgtgtgccgtcggcttcgcctcgccgtgccgcgccccggcctccactccttttcccccaaaccaccaccgaaataccaccccaccgtgaaaaccgagccgccgctcttccctccgtctccagccgctccccgccggcgataccgacctcgcccggtcgtgcggctgcctcccacagcgccgccgctccgtgccgcatcccggccaccggcccactcctcaaatccacccccgaagcaccattcccgccgcaaacccgagccccaccactaactgccgccaaccggccgcctcttgccgccatccccatctacctcacgccgcgccaccgcctccaccgcattcgctgcatcccaccgcccctcggccgtggctccgccgtggtcgggcgtcatcggaacgccgttctcgtcgactcccgtgccgaccgccgccatcctttccgccgccggtcgcctctccgtggtcgtctcgccgtcgccgccctcggtgagcactcctctcccctccctctttctccccttggccggccgcctcccgtgcttgcgcgcgccgtgccgccgccgccggtggccgcccggcccgtgtgccgccgtcgcttcggtcccggccgccgccgccgccagctttgtgtgagcgctggccaggccgcgccgcccggctgtccccagccgtccgatcggccttggccgatctgggccgttcacgtggtggacgcgcacccgaggcacgtgtggaccatgtccaccatgcgccctccccctttgactcgctgacgtgtggggtccgcgtgtcggcgccggccgccccttgctgacgtcagcgaggaccatttcctttgtaaaaataaataataattgcgcaataaatcgagtttaattctagaaattcatttaaatggctcaaaatttctaaaatccatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagattgttttgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacggtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttatgtttggaactgtatattacttgtcgttttgtgtaccctggctggtcctggacagggatttaatacacaaaatagtctggaaatttgggctaaatttctgggcgtgacatagccctactcttgttagctgaagccggtgttgctcttattcatcgaaatcacgcaagtaaaatatttgggataacctatcttgtcgtcgtcgacttggcggcatggaacaccacacgtagtagacgatgggatagtcttcctcctcgaatgcaaacttgacgagatcagagatagtgctagatctctcttgtctacctctgtggcaccgaattgggtatgtcttggcttatctctgatgtcgatgtctggcagcgtgtattggtgtctattctgactgagcgtcccccctctcctctagggggtcttgtatttatacccacagatgtcctcttgtccaagaaaaactagggagacaaatatggatacgattcgagtagtctttgtaattttcaacttgaactctgcttctccttccttatccggaataccttccatatgcgaggaatgattctttataagacttggtatatggtggaccccgtcgagcttaacccaagattattgggtatgtgttatccataacattgacagactagacatgttccttggctagtgttgaagcaatctctcatcatctatcagttgtcttaggcatctggtcctcgaccagcgttgtagtgatctgtcaccacctatcagagttgcctttagatggccgagagatgactacgcctggtcctcaaccagcgtcgtagcgatctctcaccacttatcagttgccttcaggtggtcgagggatgactacacctggtccttgaccagcgttgtagcaatctcccaccgcctataagtagcctttgggtggttgagggatgattacgtctggtcctcgaccaacgttgtagtgatctctcaccacctatcagacttgccttcgggtgatcgagaaatgactacatctggtcctcgactaacgttgtaataatctctcaccacctatcaggattgtcttcgggtggtcgagagatgagtacacctggttctcctgtggatttcctttaaagaaaacatttcttacggtatttatggccccgaaagaatttattcatcgagtcgctttaccttgtttaataaaatatgcatcgcggttatatgcagtgtgagcggctgccacctccacccacagtttgttagaacacatgcttctgccgatcgaaagggtgggaagtttcacatggcttttggccctttgcaactgcatgccaccaaacagagagaggggaatgaaaactttttcccagcaatttcaccggaaagcaaaaaaggagcacccaaattaagtacactaacaagtacactttgcatgaattatattaaaccacggatgggattatttatgccgccggcgtgtgggcacaatggcgcacccagtacaaacaagtttatcttgtttttgcacgattctcacatggatcgatttcttttgtatagtttaatttagacttgattactatctgccattccctgacaggacttttttatatcacttgacatattataaaaatcacatcaaatatagctacagtatgattataatgtaagtataatttaaaatgcatataactataatgtaactcatgggaatcccatgtaagtacacagaaaaacgcaattgtagaggcaagtgcgtgcgcgggatcgagttccgcagcgatgcgacttttagtttttttctctcgtagaatgattttctttctcatctaactaaagataaatctaaaaaaaaacccgatatatcttttgcaaaattatttgtaaaaatgttagcactaatgatgttgtaaaatcagataaaactaaaaaagaatctaatgtcgtctagggcatacaaaatcgtacgttagaataatcatacgtctagaattaatcattaatcgcaacagaaaatcatacatcagaaaatctgtgtaccttcacccaaaaatctgtcaaaaatctatagcaaaatcgtttcctgcatggaaagaagtacgggtgaacttccacaaaagattgaacatatatagacctgatacatcgtttagccctaaactttgtgtattgttcacttaaaccaccccaccctatactcttctccaagcaacacgaggaagcactagctagttacacaaatttaaatccgtgtcggtctaccacggctggaagaactactaagtaaaattttcactactaattcacgagaaaaaccagtactagaatatttagggtttataaaatagaccttcttcccttttgttcttatcttaactagcgcgcggttagcatcattatattttctcccatataatatcatatatgttttctctatgtattattcaaatatattaaaatgacaacataattttaaattttgtactaactttacgaaactactaatatgtaatattcatattgtatttgatatatgtgttagttattaattatttttaatatcaaattttagttatttgtaaattatattcctatatcgactctagacttgtcttcaatatttcttttttaattttttttttcatattttcattatctgtaaattgtagttctatatagactctaggctcttcttccaatattatttatttttaattctgaatttttattatttctaattgtatttctaggtggactgtaaaatcatctttcaatattcttaaattcttaaattcgaatttagttacttctaaattgtattcctatattgactttagacttttcttcccatgtttttttaatttagaattttagttatttgtaaattttatttttatacgaactctaaactctacttttaatattattatgtttattttgaattttagttagttttaaattcatatatagactctatactctacttctaatattccttatttttaattccgaatttctattatttcttaattatatttctatatgaactctatactctacgtacttctaatattccttatttttaattccgaatttctactatttcttaattgtatttctatatggactctatactctacttctaatattccttatttttaattccgaatttctattatttcttaattgtatttctatatggactatagtctcctcttccaatattcattattttaattccgaatttcaactatttctaaattttatttttatatggactctgtttttctttttctctaattaatatgagaatttctaggcagcgagagcgaacgtggaggctcctttttctattcctttaataagttaatagatttattcttaatctcgtcctttccttacacattgccactgccgctgctttcctagtggccgcatctgacagtgaggaggctagggatcgatgtcagatttgataaccctagcctccccactgttcaatgcccctctattctcctatccctctctactcgccaaccaccatccctcaactatccacccggttttgatttgccctaacacattatcattctcgattcttggaccaatatatagtgatagttgtcattggctttttctgtaccacatgcgtattgtgggtttcgaaacctaacagtatttgaagttttgaaaccggtagtgattatgattttttcaaaggagaaagaggaaaagaagaagaatactttatgactcgtgtgtttggtgtaagagggtacaaataccgcggctgatatatatattcaccactttatttggtggtgtagcattgtttatccgcgacttccgcgtagagtggaatatatataatttcatgcacgcacgcggacctgacctaactcctcgatcggtcgtagcttcgttctgtgacctcatcatatcaagtaagctaccttatgtgtactatttatacagtggttcattagccagtaggttacaagaaaatccttttcacgaccaccattatattgatcgagatgagaggattgcaggccgccgtgctgttcacggcggtggcggcggcggcggcgccgacgaactgcaccacccgctgcggcgacatcagcttcgagtacccgttcggcgtggagcccggctgctaccacccaggcttcaacctcacctgcagcagcaacgacaccaggctgttcatgggcgacggcaccgtgcaggtgctcgacatctccatccccaactccaccttgcgcgtcaacgccaccgccatggcgttcgaccccgccgacgacgtgcagcgcggcgtcatcaacgcgacgacgacatggcgcgccgccgccgccgccgacgacgacgggggcccgttcgtcgtgtcgaggcgcaacacgatcgcgctgatgggatgcaacgcccgcgtcgacctccgcggcggagaccgccgccacagcgacaacctggtcagctcctgcaccgccgtctgcccaccggtcggcggcggcgacgacgccgcggctcacgacgacggcgacggcggcgacggccacaccatcgcgatcatcgacgcctggaacggcaagtgctccggcgtcggctgctgccaggcaaacatcatgctgggctacccttcctacaccatccagatcaagcagctgcaggagaagaacctccatagcttcgacttccagtacatcgcctacatcacggacgagacgctgaatttcacggaagagatcgccggccgcatcgccactccggcggcgctcccggccacgctagactttgtgatcagaagcaactcgtcgtgttcgacgccggcgaactcgacggccggcggcgagtgccgcagcgaacacagcttttgtgaggattacaagggtggtggtaataccctccttgggtatagctgcgtctgctcggagggttaccgaggaaatccctacgttgctggtggatgccatggtacgtgtgtgctcgctcggatgattaatgttggtcgttttagggctcgtttggtttaaatgatttctatatgaaaccttaggacatctatcttctatcttctatctattatcttctatcttctatctatctatctatctatctatctattatatactaaaagtccattaatcttcctacaaacgctcttaagccgccacttggcgctctaataaattagagaaatcaaagaaattctgagaaaaaagaaaagcatctatccgttgattttaaaatagtgggtccactattagaaaccgtcagattaactatattgatcttaaaacgtacaattccacaccatccgtaggtacgtacgtacgtacggttccatctccctccctcctttttcttttcatatatatataatcgagataacagttaatatagttaaattttatataatcactagcaaaagtgcccgtgcgttgcaccgggtgattacagagtgtgtatattgaccaaaagtgttgtttggtttagcaaaagtgcccgtgcgttgcaccgggaagtttacagatcagaaaaatatgcaattaattaaaatacaaattcgctgaaatatttggtatttttaagtaggtatgtgtataattaaataaatttacaagtaaaattctccattctccatggttaaataaaatgacatggttaaatttaattttattaaattctccataattagttacgctctttggaattttattggaattttcagagcttaattgctaattttattaatacaaacatcatttaacaattatttaattggaaaaagaaagaaaatactttcttataggtttgcttcgaaataaacatattcaatagaactataattgtaatgcttctgaaaaaatgagcactaaaaatgtacttattctctgtttttcggctcgagggaccaacaatagacttatttccgacctatgccggtcggcccacggccttttgcgcatgcgcgggcgcacttttcctcccccaggccgcaacctgggcttgggccgaaaaagaggcctcactctcgatccctcttgggccgatttcggcccggacgacaccggccgtccgatctctaaggttttgatcggacgaccgagcgtcaatagtggggaaacaaaacccactccctctcagccgcggaaccctagcccattccccccctcccatgtcacttcgccgccctctcctccgcgcccccgagcggcgacggcgacgacggcgcccctcccccaccaccgatggcggcggcggcggcacccccaccacccacggcggcgtcggcggcatcttcccccaccaccggcggcggatctagcgggaggggaggcgccccgcgagcggcggcgacggcgacggcgcccctcctcccgcgagcggcggcggcagcaccctcccccaccaccggcggcggatctagcgggtggggaggcgccccgcgagcagcggcgacggggcccctcctcccgcgagcggcggcggcggtggagtcctcccccaccaccgacggtggcggcggcgctctcccccaccaccggagagtgccctctgcagccgccgccggcggatctagcgggaggggaggcggcggcggcggtgctctcccctccaccggatccacagcgacggcgacggcggcggttcggcaacgacggcgacggcgacggcggcagcggcggcgacccccttcgatctaattttttgtttttatttggatatatgtgtgctagcggcgacccccttcgatctaattttttgtttttttgcaaagtgctataaggctgcatgtgattctttgttatgtgctatgattttttatactatgtatgtatatatgcacttgttctcctggtgatgctaaccgaataggacttggtataattcaaaccaagtcctattcgcccaaacagaaacaaagtcctaatcagctcaaacgaaaacagatgggagtttgtttcctatttttgtggaatcggacatattcttttaccgcgttgatgaatcggattcgttccggttttttttcacccggtttttttgacggacgatggaagcacctcttattttttaagtagtagtagataacttatatgattatattatgatatatctctttccaaaataaagtttacaccactatatttttacccattaaataaaggtatacgtgaaccctttatgtggagcattattttcaaataatacactatttaaataaagtttataaagtttatatcgttacattctgtacgcattaaactaacaaagaaatatattaactaatttatacttaaacgtgctattttagactttttaataaaggccggattaattttacgagtctttacaattatttgtaccataaattatatatctatttttatttttcaaataaatatataattttaatatctatattagatttattgcattctagacctacatccatcttgagtgctccactaaataaaagaaaatattaaaatttgtcattgaaaatcaaaatatgctagcttattttttaatgaaactgttaaacccattaaaagtacattattagacatctaatgactttctaccaacttaattaatttcttcataaaaaaactttattaattcctcacaacatacacgtgggggctatttacatatacgaattgatcttgatgcttttgtaaataaatgatattttaaatttaaaagataaataaacgatcttaaaatgatcatagcatctaaatcatacatatgattgctcctagcactcctaaacacttctaagtcgctatgtggcattctattaattacaaaaacactcatataatcgaccatcggtttccacttaaaccgatggacccaatttttataccatcatatctatcttttcggaaaaaacaaattctatcagaatctctgtctggctcactgcataacatgcatgtgtgcgctcctgtaccttttaaaccggtagaaccattgtttgtaacaagtgtttattcatggtacatgacattttaaaaatattactgtgcaatgatatttcgacgttattgtattcttgctaggttgcgtggagcctctcattcactctacatgaaatgttcataggtagatcgcctctcaaaatatatcaatcatattaggctatataaacccgtgcattttttgtgtagattaatgtcccacccaattcatcctttaacatattatgataatatattatacaattaaaaaaataaaaacaccttaatttttattttacacttacttttactttcgttgacatgttttctaaaaaaaataaatctaccttttttttaaatgatgaagaatattataaataattacttatagatactacttatatttgatataatataaatctaataggttagaatattattaaagaattaattaatgctgacaaaaataatgtatggagaaatcgtggcagatgttctcctgttaaatgtcgcttttataaatacctcaaacttggcgtacgacgcatgcccgcgcgaatgcgcgggctaccttcctagtttttttaacaattgttggaattgaatccttaggatttttttcaacatatatcacttgtttcataagaatggatcttaccaaatttctaaggatggtagtcttacgagcttattttataccctctccgagctgataatacttgtatcgttttagacaagagtaaggtcaaactttaaaatctttgattatgaatcattttaaaaatatttgtctttcaaatatggtgactatatgcatagattagtcttaaaaagtactttaataaaatcatatatatttttaaaatatttttatacatattataataaaaaataatggtcaaagttatttttaacttttttgaagaccgtgcccttgtcttaaacgacaagtattttcaatccggaaggagtacggttcttaggatgagatgaaaccttttttggaaaaattcctaaggaattaaatagatgtgatattctaatcctttactttacgtaatttcttgatttggaaatcctatgagccaaggattacaatttcgatttcacccaaaatttagctcatttcggttctaccaaaatccctgaaatttctggatttttgggccaaaatttcttgaaattttaacataatttaactgaatttgactaaatttgcaaaattctgagagaaaaaggaaatcttggccgagataatcacttgccgggttggaaattttgaaccaaaattgcaatcctgctatgaaccgaatagggcacttagaatgctcaactatatatgtcttaattaaatactacctccatttgtttttgcccagtttatatctacgcaatcttcaatacacaatttatcattactttctaactatgtatgtttatgaaagctttaaaagtatagtaacaatataagtgttttttatgacaaataatatatcaattaccattttctcttctctaatgttttcattaaacaatcatttaaagtttcaaggtttggttgcataaagtaattttagatgacatctatttaagaatattagtactaacacaagttgttttagaacttttatgcattatcttttctgttttacctatgtttgatttttctaaaaaaaaatgtgttaccactctctttagtataaatgatgagcagtaaggttattttccttctttcgatctgtgcatacatttaaaaggactgtttctgtcaaaaattataaaatacttacatttagaatcagaggaaattaatatcctagtcattggtacgtccctttatttcttcaggttcattaatgtttcaatgactcgcctaactaaaatatacgctcatgattatttgttagatatcgatgaatgtcattcccctggctactgttatggagattgcaagaacacagaaggagggtatctttgccagtgtcctctcggcttaacgggcaatgcttcaattccaaatggatgtaaaggtataacgacttaactaagtagcgggagtattcagttaggcatcatcaagtccgattgtttttttttttgaaaaatatggcgccataaatatagctactccctttcaaattatataacttcgaccactaatttgtgctctccaatgtttaataaacatctctaatattacaatatatattatgtttaataaacattttaaatattacaatgtatatttttaataaacaatttctaacaacatgtatatgtgatccctccgtttcagataataagtcgttttgattttggttaaagtcaaactactccaaatttaatcaagtttgtagataaatatatataataatatttacaacactaaattagtttcattaaatctataattgagtatattttcataatatatttgttttgagttaaaaatgttactacttgtttctaaatatatatttaaaaagacgatgagacaaacttttgaaactttagtcggatgcttatcaaaatgatttgtgtttgtgaacataggaagtagttagcttgctagagttttatgcaatattggctccccatatatggctatgttatttactaatctggcttttctcttgacttgttatcgttcttctttcccatgattaattaatttggtcatcatatattcttctatgttatatttcttctagacattgatgagtgtatgcacccggaatcttactcatgctatggacaatgtgtgaatacgtttgggagttttcaatgccattgccacagtggaaccgagggggatccaacaataagaggagggtgtattaagatcaagcattctgtgtcaagtaccaatattgtactccctccatcaaagaatacaatccaagcattcaaatcttataaagaagattacaattatagagtactactttctatccaaacacctctcgttcaaattttctccatcttagccccaaccaccatcccactcccaaccacctcttatttactacaagacatctaagatattttcctttcctactagtttgtcttttgaatgctatgattgtattactgttaggacaaatggagtaacaaacacacacacacacacacacacatattacttatttatttatgtatgttcttgatccaaattcttgaattctttcctttacgaattttcaggtttaacaattggtttgggagttagtggtggcataagtattttaaggaaaaggctatacgtactaacttttttttactaaattcttactaacactgatgtgtcatgctatgagtccatctagatttttttataacttccatctacttaaatcaaacggttgagatgattgttagtaaaagtttagtaagaaaaatttagtatgtgtagcattgctcgtattttaattatggcactttctgcacctttcatagtacagaaaataaagctacataaggtgaaaaggatgaaagagatatttttcaagcaaaatcatgggctactcctgcaacaattgatgtcacaaaatgcaaatattggtgaaagaatgatattgaccttacgggagctagaaaaagcaacggacaattttgataaaactcgtgaagttggtggtggaggacatggcattgtatacaaaggaattttagacttgcattttgttgccattaaaaaatcaaggattgtagtgcaaagagaaatagatgattttataaattaagttgcaatcctttcccaagtgaatcatagaaatgtggtgaagcttctaggatgttgccttgagacagaagttccattgttggtttatgaattcatttcaaatggatctcttgatgatcatcttcacgtcgatggacctatatctctatcatgggtggaccgaataaggattgcacttgaagttagtagagccttggtctatctacactcagccgcaacaacaccaatattccatagagatatcaaggcatctaacgtacttcttgatgataatttaacagcaaagatatcagactttggagcttcaaggtacattctaattgatcagactggagtgactacggttgttcaaggaacaattggttacctagatcccatgtactactataccggtcgtctaaccaacaaaagtgatgtttttagttttggtgttcttcttatagaactacttacccgaaaaaagcctatctataggactgatagaggtgatagtcttgttccacattttgcctcactactggaagaaggcaaattggttgaaataatagatccccaagtcaaggaagaggagaatggggaggttgaagaagtagcaacactagcggcaatgtgtactaagttgaatggacaagaccgaccaacaatgagagaagtggaaataaggcttgaaaacttgcgagctaaaaccaaacatgctccatataataaagaaccaagtagatatgaagtatcccgagttgcagggcattgcatatcagctagaggggacatcgaagaagtactaataagtagacacagcatggaagatgagatgttgtcgttagaaaggtatcctagatgatatcgtgtttccgcgtctctaatcgccataatattgtttagtagaggaatatattgctactttctacattttttttcctttgtgtaatgctcttttgtaaaaagaagaaaatgccatggctttgtttcatgttacaaaaaggactaaggccactctgtatacattaattggatttgaaagatctatgcactagagttgccttgtaaggggagattggaatatctatgatcctaagagtgcggtgattgttttggtgattaatgacaacccattgttggaactaactatttccatgagttggtgagattaggttaagttccggcatcaagttaaaagattaaagctagaagatggacattataccttgatgaggagcaagtgaagatattgatgatgcggggtatgaaatggctatctatggcaaaccggtgaagagaaagcaaagctaggctagaagatggacattataccttgatgaggagcaagtgaagacattgatgatgcggggtatgaagtggctatttatggcaaaacggtgaagggcaagcaaggctcggctacaatggaccatgcggggagaggcttggcaccgatggaccgaatccggtagtgaaaggcgagtgaaggctttgtcatgatggtcatgatggactgtgcgaggccatttgaagctatgagtaatccgtatcaattataagaagaccgcgagatggaatgccgaggatcaagaggatgtggttcttcgatgaacatcaagtcaaaatccaaagtgggcattgatcaaggcaaaggtataattgatttgggactaatatgcttaatgagtgtaggtgagaatagtcccaatagtgaaatggcgttgacgttgacaaccctcaaggtgaagcaagaagatgacattcctagtggtgtattagtcccaggttgcttagaagtggactaggatgtttggagacccccccaaaacatcaaaatcaaagcggcgagaagactcggagctgagttagactagtttactttttcgctttgagtttaggaaaaaccgtactattaagaggggttccaagtgtggttctgagataacacaattgctcttagtggtgtccaagtgttgaaatatttttaggagctgtttttgaaaatggctctactcggaacagagagtcccacccggaggttctgtccggaacttcctagcgccgaggtgaggttgaaaaatttcctaagtgctgcctggaagttcctggcacttttacccgaaacctcctggcaggtttccagttcaaacttgtgagtaacggctagatgacgtcacctagccgttatatatatggatctcgtccccaggtcaccctttggccattccacgttagttcttgtgttccctagcttgttctagcctcttccaatgtgattttgcttcctccacccaaatcttgtgtacttcttgagtgagagagtgattttgagggtggtggtgaggattggagaaggttttgaaggctaggatgacttgagcacttggggtatctcgttgggctatcatttgaagcttgttactcttggagggtgacctcctagacggttaggtgtcgcccgtgagtttccaacaaggttgtggattgacccgggcaagtttgtgagggtgttattccacctccgaaaggaaacggaatacacggtgagtgaattccgagctgaggtttaggaggtcgttttggtagagcaagcctcacttgtggtgttctcttggtgttcaagttggggatcttagtggtcacttgaaaccaaagagaagtacctaggggtgttggcttgaataccggagacctcttcctaggcctttgcttggtgaggcaaggggttaatcaggatccggctctttggagctcctcaacggagacgtaggattctcggtggagaatccgaacttcgggaaacaaatcgtttgtctcctctcactctctttatctttgtgattgtgatgcttttctccttatttgcctagttgtgctatcatgtctcccattgtatgatcacttgtgctatcttgtatattttcatgtgtattactcttgtttgagacatgttgtacctctctatggtttaggcttccttgtgatttaatttacttgttgtgaggtgcttgaaatagcaattcacaactgcccggaagttcctaggaagatccccagaagttccgggcagctttctctgcttgtgagaaaaagctgccaggaagttccggaccttttgccaggaagttccgggcctgattttaaccgctgcgatttgaagtaaattttagaaacacctattcacccccctctaggcgacatcaaggccctttcaggattaatcctgtgttatatgtacaaaataatctgacaaatatccttcgtatgaattgtgaatataaaatacgaacattaacaaaaatagaacttttttccaatcttatttatatcactgaatgcatggatataatatctaaacataccaagtaaattaggtatcattttcttttgaatgttcaatatatttagtattatataatatagatatatagagttagaagcaaaatacatgagagatagaggaatgagatcctctgaagacattttccacccttcctgcatgacaagagatatgcggataagctaggtgagtggtattgttacaaacaaactgagaactgtgaatcaatttgtccctagcatcatgcgcctgtcagcctttctattgatctttcttggaatccagttcacctgtagatgatttccttgtaccgcacactgcatttcactgagtattggtctgagactccagtgtctgggatactcctggaaatctcctttactgaacgttgatgcaattgtgctataatctgtaacgtggatcatatctgcaaagttcaaaaattatttgagcaattacggaggccaattgtagagcaatgagtgagttcagcttgaagtggggacattcccatggcacagttcgctttgatgaagaatgtattatgatcatcagggtgatggaaaataacaattccaatgcataatctgcgatctatgtagcacctatttcttacaggaattgaaaaggaataatttacaggaattgaacaagaacactttcaaggaaaaaaaaaaggaatatatcaaatccacccattagcacattgttaacaacgaaatttggtaagccccgaagacatcatcggcctagaatcagtattggtttcagagtcctagaatcggccgatgagaattattacgtcgccaatagtcagattcctgctatattcggttaaggaaattaatctactaaaggaagcttatccagaagtaaccgagttcaaggaggatacggcatggcaagttatctattaattaggaatagtttgttagttcccttttatctgtaggaaagtatgtttagtatccaataatgactttatgacttctggattacttcaacaaaacgagcgaattcctcgtccactgacggtttcatactccgttgaggaaacggcagcaaccgtacgtgtgtcgcagtactcctgcggcactgtcttttctagctgaacttccttgtcagccgaatcactagatggcgcttctttggcaatctcgttagttcctgcagggttaggatatggcagatcacgagtagacttacctcccctcgtcgtgattgccttagacattttcaacggaggagtcaggttgccccagaatcctcccagtttcatttgcagggactaaggatgccaattgagctagctgggtttctatcattttattaaaactcagctggttttgaaaagcagaagcgaagccatct

SEQ ID NO: 67487 - DNA, 25661 bp, Oryza sativa
  unsure (1)..(25661): unsure at all n locations
atatcaccgagaatgtcacggaggaatattaccgaatcccaatccccatcggtcaataggagaccaacgagctctcactttgctccttcaaccatgtgccctcgtgctccttgtccttgttctcctgttggactatggtcgtcgtcacatagctgcagccccatcacatgcccttctttgccgatctagtttatttgcccccacttccgtcgccgtagcggcatctaaggcctggtttagttctctaaaatttttatatatataagcattaaatataaacttaaaaaaactaattgcacagagaaatcacttgatgaatcttttaaacctagtccatgagactacgattagccataaatgctacggtaacccacatttgctaatgacagaataattaggctaaaaagattcgtctcgcggtttccagacgagttatgaaattagttttttcattcgtgtccaaaaatcccttccgtcatccgatcaaacatccaatgtgacaattaaaaaaaatttcttttcgcgaactaaacagaccctaggcacaacaagagtggatgaaatagagatgaggagaagatcgagagagggagtggcaaatgacatgtggtccaatttgtagccaagtactaggtgcagaacaagtcattaatttcaagtcctctccaattaaaaaaaacaaaagactagtttttggcatgtgttttcgcatgcccgaacttttacggtgactagtggcaaacaccatattttttttaagtatctataacaaattttggctagaagttaactctagttgaccaattaacctggaaattttgagaatacgttgcgtcaataagcttgacgaataattatagtgacgttttaataacaaaatatatccaacttgtcatgagatttctcgtagaaaaaataaattttgtcatgacagattgagagtttgagatcagacagcacatcgcattcataacaaacaccattatactactactattacattatagcgaatgatatgcatttcagacatatactgtagcacgtttaccacgagcctttcggtcgctcgataagcatcgatctggatacagtgagaaaatgaacatggacactttttcgacgaaacaatgattttctttggtgaccttagcccaaggaacttcttcaacgtgatttttttttccttttggcagggtatgtatacatatatatagattagtgagatgtgactgggaagagggccagcaagacaacagcaaattgcttaagggcattctcaatgtataaaatgcacgcagatcataagatgagacccacgattatatatgatcttttgctaatagtatagttacaacaaatatctgctgctcgttctgttggtgttcacggaagcggcggtgcctgaaagctaacagcgaatagggcctcttgttcgataatgcaacagttactgtcacaaactgttcgaattttacatactcattactctctcgtctcattaaaaaaaatgatctgtctcattaaaaaaaatcaacctatgatgagatgtgatgtttctaggtacaataaatccgaatatgcatatatgttttctaatacaatactagaaaacatcttgcctcattctagattggttttttatgggacagggcagcacttgtgtatgtttggattttgcatatcatgataattcagactttataccctcttgtgcacgttcataacgtttcatattctgtaaacaattttatgaattgaacctgaacgagaactaacttatttttgggtatgtttagttcacgctaaaattggaagtttgattgaaattggaacgatgtgatggaaaagttaaaaatttatgtatgtagaaaagttttgatgtgatagaaaagttaaaagtttgaagaaaaagttgggaactaaaccaggccatatggatgtaaacatattcagaacacaaatgccactaggctcaaaagtccacagtgctatagtgtcacaccacagtatgtacagtgattgtctgattgataggtttagggatcttttttttttctaaaaacgtttagggatcaaatgttgccaaagcgaccaaagtatcacaatagacaaacttgtcacaatcggtacaatgttgcacgatagactatgatgtcttaggcctgatttttttaattagctgaataattttataataattatttgagaatacaaacaaatgcaccaaaactattagaaagcagaaaaaataaataaattcaaatatagagagttttttcaatacttatactgtttagaagctcaaaaatatgtccctctattctttcattccttaaaaaagaatatcgatccttaaaattaaggtcgcatacataatttgataaataaatattgtatcacgtttcaatttgtacttcgtatcattaattattggtatggaaactgtccaacaaatggtgatttcttcatcaatagatctagggcgaaacccagtaatcaggtatgtgggtcatcggtcgttgggtgaggtgatccaaacttggaagcatttagtagaaattaattaaaatatccacaagccatgcatgataattgtatgaaaaaattccatgtgtacctctaaaagttcacctaattccttctacgttgctgaattttgttcatttccttgcatactcttgaatcttgaattttagtttgtatccattctatgtccttttagttgactgtcagttggacgttaaattctcgtgtaaaagtccatttttaccctttactatcaagaaacataataaattaatggagtatattgtttgagtgtagaaatttgttcagtgtgactattatatttatgagtttgttatgcaccatattatttgtgacataattacttttagatatgatataaaaaatttaatatttatttattagttattaaaagttggtttatgtagtatatttgttttgatagtaatataacatatttgttgtataagacaaatatatttatatgctacataagcaacttttaataactaataaataagtaattgattttttatttcaatatctcaaagtaatttatcgcaaataatatagtgcataactaactcataaatataatagtctcatctaacaattctacactccaacgatgtactctattaatctatatttttttcatagcaaagagtaaaacggaattattcataagaaattaacggtcaactagcggaaagggcatagaagagaaccaaactaaaattcagatatatgtaaaggacgtagaaaggattaggcgaactttcaagatacgtacataatgaattttcaggggtacatagtgataaatttgcaacaccttgcgttttcgttctcacaacgcagaaagttcagacctaatgttatagtcatcagggctatcatcctatttaaactactatatctccagccaaaccacggatatggtactaaggctccgttcaaacagtacatgattaattgaatattatctattataaatttgataaactgatttatttattaatctttagaaaaaggttctatatagaaatcttttcacaaaatatatcacttagcattttgacaaagtgttatcaaaaataaaaaaaagttatcgtttaaagttacggaaaagaactcagcctaaaagctagctacagcatgccagcagctgttggctgctgcctttgctgccgtaacgtaagctctaagcaccaccgctgcttgctcgccatggaccaagcaaggcccaatgccgaccactacgctagctagcctgctttgctaggcccacaagcaaagaaaccagcccactacctttttctcttatctcttttttttttcatcaatcaattattccgggacgttacatcggtatcatggcctcatgggaactattctccttaaatccttgagtattctaaaacttgagaaatattcaaccgtgtttgtttggatgcaccacaaaaggaatggtttttttagatccacaaaagaaatggtacaggactttggaagaattatagatagagattttctttcacaaggttatctctctcatgtcagaaatctacttagaaacctactgtattaatttattttgcgaaaaaaatattaggaccaaaaaagcacgggttacatcggaaaaattatgttactaagtttttttaaatagaaagttcaattttactctcccgaattatttcattggagtacttcactcctaagcaattttttgggttattttacaccccaaactatttaaaacggttcaactgaccccctatctgtatttctattttttccctctctatatatgtcgtattttatactaaatctaaaaggatcgacagatgcattataacttatctctcaatattttttgaattttttttatcattgtttacataggttggaaacactagaacatatttaaacatcgaggttttaagtttaaagaaagtagttatgaaaatattttagaactttaataatagtgccatctctgccttaagaagtttagcttaaaatacagcttgtataaaagagaaataaagaagagaaatactattaagtggtaaagtgaagcatcattaatagtttatgaggcaaaaaaaagttcatgaattcagtgctaagctatgcctcatttggatttttttcaaaacatagtgcatatgcggacgctcatatagtcatataaattaacggaattgctaaaaaacttgcgacagttttaaggaaaactgtcaatttttcagtcgtcggatttactccgagattcgtgcgtgcgagatgaaagaaaatagcaaaaagcagtacgctatactgggagtcgatcatttcccctccaattaactagagtagcatccctaccactgagccagctgaactattgatgttgaaagcagagttacatgatactcacatatgtgtaaccacatagcagatccctattttttggataatcttattatatttctattttctttgtgggcttgctagcaatgatgctggtgttggatacaaatgctaaaattttttttgaatgttttggtacctagtttttatcgaacgtcctatatgtattgtcatcgtgctttaatatacttacataacacttaccctctagttacagagtagttacatagcagttacaccctagttacagagtagttacattatgtaaaattaggaactacatttttttttcatgagcatgcatactagaagcatgcgtactagcttgtactagtgtggaaccgttttcctgtaacggttgatgacagaccctgtggttaaaaaatttgaaagttttgaacctctgtcgacaactcactagccagtccctaaattaatgagcgcataccttacctttataagtactttcaaagtagttattgatgtttctgtaaatgcaagtatttatggcaagtataagatttgaacatggctgggcaggtccatcacaagaattttttaaaaaacagcgttcatctggatttcggaagaatggaattcacaaactgctagatgaaatccgaggtactagtaatttggagttgtactagctacttcagggtgtgtcagggtgtgtttagttcacgttaaaattaaaattttggttgaaattggaacgacgtgacgcaaaagttagaagtttatatgtgtaggaaaattttgatgtgatggaaaagttggaagtttgaaaaaaaaagtttggaactaaactcggcctcagcactattggagttgtgagtactgagttgtttgtaaaatataacatttattctttgtgaaatcccatattttccaccacaaaatcgatcagaattcagagcagacgatcgaagcagcctcaagcatccacggcgcaccgggggtactcgagaagcggcacgtcgccgccgccgccgccgccggccaccgcggcctccgtgctcagcccgacgacgacgttgcaccgcacgtacaggtcgcgccacccgctcctgaacggcccgctcctgtacttgaccctgcccatgacgacgagccggagctgcacccgccgcgccgcgcagtccgccgccagcgcgcgcgccgcgtcgggcgacaccggcacggccgcaccgccgagcagcggcgacatcgccacgtccgcgccgcggtcctgcgccacgggcgggagcggcgccggcggcatgaccggctccccgcggtacgacgcgtaggcgacgaggccgtcgtagagcagcgacgccctgtcgctggggttgtggagcaccagcgtgaactgcacgctcgcggcgagcgcgtgcgcggaggaggaggcgttggcgagggcgaggcggtacacggcggcgcgcggcacggacgcctgcggcatcacggggcggtagacgaggtacagcacgagcgcggcggcggcggcggcggcgagcgcggccacggcgagggccgccgtggcgaggtggcggaagcggcgagcccggtggtgggcctcgcagaaccgcgccttcctggagacgtccatcgacacgacgatgccagctatgtcccgacctcgtctcggcgtcctcctcctttccacctcgcgtattattccgcgtcgtcacgtcacgcacgcgaggcggcgccgcggaggaggaagccatgtggatggatggatcgcgaattcgggagcagtttggaaaagcggccgcgcgcgcgagctcggacaaaacggggtggtggctcgcgcgcgcggcggtagaaagaagaagccaataggcgctgcggctgctgtgacgctggctgcggcgttgcgggcggagtactgagctggaaacctgggaaagagaagctggcagggacgtttgcatgcattgaaacgtaagcatgtgtgacgaaacgtggtgagtactttgggaagaacagacgatggatgatgggatctgctgaagtaatggaggcttcactggaataccactggatgcaattactggtctatttttttcacacatttgaaatattaaacgtagactaataataaaacaaattataaattctacctgtaaactgcgagatgaatttattaagcataattaatacgtcattagcaaatgtttactgtaccatcacattatcaaatcatggcgcaattaagctcaaaagattcgtctcgcaatttacatgcaaactgtgcaattggtttttttcgtccacatttaatgctccatgcatgtgtccaaatatttgatgtgatatttttggcaaaaaaattttggttcttaagagcaggtacaatagcaggctataagccagctgcaaatatattttaaggagttaaataaggagagagaagtgcagcgggctatagatttgtagccagctgtagcacggactccaagacgcagtgtgtgtatgacatgtaggaccaggtattaatagtgtagtatgtaactattgtatgaatgagctattagattgactatagatgaattggagttagtagttagctgtactattgaacttgctctaacacaccctgcgttagttacctccgttcccaacttctctccctcgtttttcgcgcacacgcttttcaaacttctaaaccgtacgttttttgcaaaaaaaaaatatatacgaaagttgtttaaaaaatcatattaatccatttttggaaaaaaaaagcaaatatttaattaatcacccgctaatcgctgctctgttttccgtgccagggagtgagggttcctgaacgaagcagaacagtccattaggcggaaaacgagagagatgagttggaaaacctagggtaagaacacagccttaaaaagcaaactctcatgtcgtgtgccccccgcctaggcgagacgacagtttaccacatctctactacttaaaaaataagaggtgcttccatcgtccgtcaaaaaaatagagtgaaaaaaccggacgaaaaaaatctgtccgatccaaaacaaaacggacgaaaataaaccggatgaaaaaagaaaagaaaaatcaaatctgtcatataaaaaaagggcgcaataaaggaaaagaaaaacgaatccgattccacggtaaaaaaaaagggagaaaagaaattaaaaaaggaatctatccgattctaaaaaacgggcgcaaaaaaacaggcgaaaaaaaaatcaggtgaaaaaaaagatcggccaaaaaaaacgaatcagatttcgttggcgcggtaagaaaagagcaaaaaaaaaacaaatctgtccgattctaaaaaaaaggaattatatgtgacgcggtaaaaaaaatcgaatcctattatatttgacacgatactatatatctctatcttctctatctctactacttaaaaaattaaaaacgtttccgttgtccgtaataacaaaaaagaagggcgaaaaaaacattaaaaaaaagtttgattcaatttacttccgtcatgcgtaaaaatcgtatcttatcttaatctcaatctttccgaggggaaaaaaagaaagaaattaaagaaagggataaactagattgatgttcccaaaattaaaagaggataaacgatattgaaactcccctaactcgaaaagaaggaataaaatagatttaaatttcccgacaaaattctccaaattcgaagaaccctaatttcgggtaagaaccataagagtcaaaatccaaatcaattaagctaaaggttcgggttacttatcggacttgaaacccatgagcacaccggagctttccaggaagcggcaccgccgcaccttcacctcctcgcagtcgtgtcgggttccctgcgcgctgtcctggagcaccccgccaccatcctttgccgaagacgggaagcgtcggcttggcgttgcccctaccgccgacgaggtccaggccgctcggtgctcgtcgccgtttgcacgcctacctagccagaccgcggacgtcgtggcacggctttgcgtcgccctcgggtgcgcccccagccggcgaagcaagagccgctcggcggtcgtcgccgtacgcacgcaccagcttgccggaccgccgtcgttccgctggctcgtcgtcgaagagaaatgggatcaggagagagcgatttgggagctagggttttgcccctctctcccggtcggtgcttcatccgaggcagggacgattggagccgtccattagatcggacggctcagattcgcctagcgtcaggccgtcgccgccgttgattacgctgcgcctaatgggccgcggaagtgcatcggaccgtccccgcatatgtgggccacgctcagctgctcagcttgcgggccgtcgaattgatgactcaactcgccgaagatgggcaagcccaagtttgggctagcttgggaagacctatgccgaaagcaaatttgatcaaacaatgtggctcacatttttcaaattaaagtctgtcggataaactcctaggtaggctcgaaaaataaatctaaaactaaatcctaaatcctatgctaattgatcaaattagactcggttctacttatttgttaatataccaaattagacttgatttttacagatttgaggttttcaaggtgtcacactatcaaacgatgtttttccgttgcaacgcacgggcactattgctagtcataaaaagattaaaaaaaaggaagccggcagcatttgtagaagtttgaaaaaaaatattttaatagatgatttggaatcacctgtacatttcgacaatgctactgaagtagtggcgttaatgccaatgggctgtagtccacgggaaatgaagcaagcttggcccacaaaagatttggactagtcaaattattgggcctattgttgccatcccaaagggaaggaaattcaacactcaacgtcatcctttctgccgggtgttccagacttccagtgaaatttaactgcccacggtaaaatttggaactggccaattaccaaatatcataggaaaattttgaactttttaccagtagctagccggaatacttgtaaattcaactttaaaatatgtagtactaaatttacaacttctcgaccagcaggcgtccataacgatttggtacgacgtgcattaaccgagccaaaatgaggagcaataccaattttcatcctgttaaaacgtacacatttcacaaaagaacacatcttcggaagcatcacaagctttactgaaagtatgaaactacaccaacgatgttcagtgtaagaaactgtacaaaagaactttgtctttggatatccttgacaccttacatccacacacgtccagcttacacgttaactgttggctagatacaatttagaaaacataaatacgtgtgctacatgataaacgcagcttatctagatctgaagcaaaatatgatccctactgacaaactctacaatgtacgaggtccatggcctaacctagcacacgaagttagcctgtatatatatgcaacaccaccatacactgctgactgtaggtcagggcaatcatactttcactcttcaaacaaaatctgacactgaccaccaggataaccgtggcacagcaatctcctgaagtttggacagccctagctcccttggacaccatgatcttgccgaacaaactgacccttaacccgcggtcgctgctcggctagtagcttcctgctctggtatcgcacctgcacagcaatgtaaaaatgtaaaccacagtttctactattcagcaatacaacaaattggattggaataaaatggcaagattagttgcttgtgacctaccttcttctcaaagcacctgtctttcctcttaagccggaacttgttcagtgcagcctctcgttggctcaggtggcgtaaaccatcaggattttcaggaacaacatttgatgattcagtaggggcaatcatgtggttggaagagctgtcacagacactgccactgagcgtttttctggcgctgtccagcacagtgctgctcccactttcaccggtggttggagaaacatgccgcggctcatctgtaggaatttcaatgcggagatgtttccgattagcacttagatgactccgagcagtttgttcctctacattttcaacctgcttagtatccgtatcttttggaccattctgctgcagagaaattgcttgtgtggttgcgtcttgccaggtagatgttttgctattccaaatgggaggagctgattgtggatagaaaagggatgccacaggtgcaccgttccagaatggctgcccatcaaatgttagtcctccaacaggaacaggaaatggtacaactctaatgggaggttggtttgtttccctcttgtcttgagagggagttttggaatctccatttttgttttcaagatctatatgtgttgccgaggtgctgcatgcctgagcatcaccagcattaatggtagatgatgctgtcctgcagttgtacctatgaacaagaaatgatcggaagtgtgagatctcatatgttggctcttggtaaaactgtgtaaaggagcaagttaaccagtaagttagattatctaaatgcacaaaaagagagatcatacaaaaatttctgctacttccatattatttcatgttttattctatgcttgcaagaccatactgtagcaaatcaaagtaaaatatgtctacgcatgatggtaggtaaataaatgatgaaatatcaaagacgatattttttttctgttataccagtaggaaaaatacatcaacgcgaacataacaaccatgcacaaattaggaatgacagaataaacgttacagtaagaaacacttacaaggaaaatggagatgaagttgagtggttcagtgttcttcgttcatttttctcctggctctctaatctactgtagtcagatcttctgagagaaagttctaactggtgtgctggaatggaaaagcacttgtcatcatttccacgggaatttgctctcgcaacatccatctccatatgtgtgttattcttctgctgattgtcaataatatgaaccagctccatatccctggaagctttctcacaattaatatcatttgaacatgtcatcctcctcagtgatgcatcctcttccctccgtggaatcaagttgccatcattagatgctgcaaaacgaggaggaggtaatatcaggaaaaaaaatgcattcaaaagataattgatgatatgaccactttcagtgtagaagaatgatatggaaataacagagaaaagaatgaaggatgttttattaccatgaattttagtccctccatttttctcggtgttcttgtggtcaggcttggagaaatgccttcccattggctgcttatattccagtaaattgttggtttgcctactgtcagcctccagttctgaccttgtacatgaactctgcaagaggggatccaaaattcagtccacgaacaacagcgaacagatctgaactcagcataataacgacagtccctactgctaaggatataaagactatgcagtatgatgtcttgaagacaataacatgctacagattcagttcaagtgtgtaacatcaaatatccagtacttgaaacaaacaagtattccgtaataggctttatcaaactgttcgtgnnnnnnnnnnnnnnnnnnnnnnagcagccaaaaaaacttaccttactgttgtcatatgtactccattttgcaatacccaagaggaccgaactgtgacatttcgctgacaagaaaatactattctcactcaaaacacagttccattacccacctgacttgaaaaattgataaattagttcaccaacattgatgcagatctgaagggctaaatacatcttttgcatgaagtaataccatttttatcgtgtgggtaatgaaactgcttttggccaaaacatcaggtgatggaagtgttacagttcggtcatagctgggcaatgcaaaatgatacagcacaaatcccatacgtggctaatgattgaaattttgtacgcaagactatctttgggcacacatgagcaggaagaagaaagaacaggtagacaacgtcatgttaactgattctaaaacttacttgagcatcactttcttgttcactgcattccatgttcttgtggacaacattttcagtcacatgttcagctttcgtcactccggtcttctgctcatgcctttctgtaagattatcttcttgttgagtatgctgcacatcaagaacaccgctggactgtaaaacagagtaattgaagtttgttgattagttttgtgaaaaatgcagaatccaaattttaatatataaaaacgagaaagcaaatgtagtcatgctaaaacgttgcaaatatgtgatcttaccagttgttttctccaaacatgctgccataagttccttaattcattcttccgtattggcttaacaaggaaatctgcagcaccctttagcatgcatttgaaaaccatgctaacggaatcatttgaagacatcactgagaccaatagaaaaatgaagcatcagatggagtaatgggattagaaagatatgagaaaggcatggcatagagtcaagttggatacatacttatgacggggatattcttgcatgcgtcatgttccatgatcgtggagagcagcaggaacccagacatcaagggaagttcaacttcagttaaaacaaggtctatattgaaagatttttcctttagtatgtcccacgctttcacaccatcagaggctgcggcaactgcaagaccaaatatgttgcataagatcgacgaaaaacacaatagtataatttaaccaagatcccagagaatacgcgaacaaaccaagagatcaaaaaagaaggaacgtgcctaaataactgtactttaaaataaatttgctttttttttgttttaaaagaggaaactgcatttttcagctctaactctgtcccaaaaaaggatcaaatatacaggtaaacattttgcttcaggaaaaaaacaaatatacatgtgtagttatttcaatttaacacaagatacgaaatggatcgttaaaatacagctatatttttttcgaaaaaaaaatgatattcggtaatgcctcaacttaggtattcctgacgaataggctgcactacaccaaatttcgtctactgaagcagctctggcaaaataaagaaaaagagacagatagcaaggaattacaactacagaccaaaatcagcatattgattaacatatcttctgaaaaaaaaaacagatcacaaatcgtcacatcccaaatctccccacttgaggtctaatccagtaaaatcagctgccacgtagtaacagttttacagcgcagaaacatccgcaactttgcaacttcactagtgagattagccactcgtgacaacaattcgagcaaaaaacaatgaacaaaagcagtcaaccaatttaaccggatcaaaaacaaactgtgcggcacagacgctcacctcgatacccgcacttgcggagcagcgcgcagatgatgtggcgcgtggagtcgtcgccctcagcgagcagcacccgcaccggcatcctcggcagcatccgcgtctccctgctcgaccccgccgccaccgccgccgcatcctccccttcctccccgtccccgtcctccaagtccaccaccttcctctcctccactccaccccccattcccccgccgctagctccgcccctcgcccctcctcgccggagtcgcccgcggcggtaactaccctttcaccgcgcaaggcgcaaccacctctcctcctcctctctctctctcctcgagctcgccactaggaaaatggattggttcgtgggttcgcgaaaaccaaatgccagtgtgggcgacacgacaaagccgaagcggggggaggaggcgtgtgtatatacccccacaccaccacacaggcaactccccgtcaccgacacgtgggccagtcaaccagagggacccacccgccagtgggcgagcgaggcgaggcggtggcgggtgggggtgggagcacgtgagcgagctccgcgcacgaaatatctgtactacactcgaccggtgggcggggccgccacgtcacgcgcgcgggctgggccccacgttgacgtggcgtgcgcggcgtcagtggttgggatatttccgtttcccccgcgagatcgcgacgaggagccgagggctctcgaggccgatattttctctcgcgggagggacacgtggtaggcccggaggaaaaggggaccaatcttgcggccgcgcgggacgacacgtggcgggtggcgaggctaggggattgtgggggagatcgtgtggctggggatgggcgcgtgggcctccgctttgtttaatcgtgcggctggggatgggcggggtgggcccgggtgtagcggtgcgagtttttttttttttttggggggtgggctagtggttggcgtttcgtgcggtccacgataatatctgggcgggtggggactcgtggtggaggataattagcgtggattaagtatggtttaagggcggtggaatggaatgggtttagtgtgggttggaaatatctaattgactcatttgacaacctttgacaccgtgagcgagcccgtgacggatgtgaagatatttgtcaggaggattctggaagcgttaggtttcctccttataattaatcatacaagttgcaaagcaaaaaatattcgctaaattttatgattccttatcacccacatattaatagtactaatatagtgttgtggtaattggcaaaattacgtagcttgtcatattaagttgtcggtactcagtagtaatattgtgaatgcatgctttttattttttttagggaaaattgtgaatacaaactaaagagtggttgtttgttgagatgggcagacggggtgcaaaaaagaatggacgaggttgattcgaccaagtgttggcctacatcaaccatccgtgtgtctgtgtcctccatggctccatgcaccatcaacacccacacacacccacacacacgcaaaaaagaggtagtacactagtagtactactccatataggagtagcacactagtagcactagtgaaaacaacttttcgaacaagccgaacaatatacactcgcccgaagaatatccaaattccgccaacacacatcctgcgccacgaggtccgattcgatccacgtcgaataatgccgcagctgtactccacttacacattgttaagctacaattaccacaaacagtacagtaatactacatatagtagtagtacgtaacattggctctgtccgctagatatttccaggctccaaccgacgaagagacgaggagtcttatcggttgtccatattttctaataaattattttgatttattataaaaaaataatatataattaaaagttttatatatttgttcataacgacgtaaaaggtaacgttaaaaaaattacattgaaaatattttaaaatcaagtttgaaaattaaaattttagcttttattttgatttattagagcaagtttaatagtatagccagctactagctccaattcatttatagccaatctaatagctcattcatataatacttacatactgccctattaatacatggtcccacctatcatatacacactgcgtcttggagtctatattacagctggctataaatctgcagcccactacccttcactcttcttatttatcttcttaaaatatatttgcagctggcttataagctgctatttacctgctcttaggataaccgatggagctagagacaagtggcggcgaccgcatgccgtggataatccacgggccattggccgtttcgttgcaatgatgctgcctcgttgccgagaggaggagacagatagaccggctcgcgtcgcggctgttttgtgtggtggtagtcgtcggtggtggggtcggcgggtctcgctcgcttccgaaacaacccacttggcgtggccgggcgtggccggccgccccatgtttctgagcctccaaggtaggactcgatcgatcgatctcacgggaaccaaactgaccggatgacatggcacgccatctcgctaaatatcttgacggactaacaacgctcgccgttggatgcatggtagtagcaaactagttagctgctaccagccatcttttattctttttggttgttatcggcataattttttttaatgtctagtaatatcaaaaataggctaaatgcattgttgcaaaaaaagtattactgatatttgtaacaaattaaatgcattcgtatatttgtcaattttatcttaaaaatggtatggtccaaaatgacatcaactgaacaggttgttggccaaaatttaaattttaagttttaattttgtaattgatttttaagttttttttgttacaggttattttttataatgatttttcaaattaatatattatttataaattgtttttcgaatctctaataagtattacggcttattttttttgaaaggacagtattacggcttattaacaaagcgaaatgacttgccacaaagttgcaagcaacaatatcgcaatattcgtggggcactagctacagtacagtagttataaatggacagatggggggtcgagttcacgtggcgcggcatggcgcggcataaacctgtctacgaatttgatgaccttcttgttgttgctgctagagaagtcatgcatctaggatagtactggatgcagagatattttgaaactgtgtgcgcctctgcttttcgtcgctggggtcgccgattcgggcggtggatcgatgactggttgacggttgggtgctgtagctataacttgggagggcaaaatggtggattaattggatggctagtttttctccttgtggatgggggctggaccgctggaacgctggatggatggaccaaacatatggccaagcacgcgcgcgtgcgacacgctcgacgacggccgcacgatccgctagtggccgcggtccgcgatggtggcgcacggaccgcccgtgcaaatcgccgggaaatatcttcgcgagcagagagatattttcgccttgatctcgattacgcaccccgatcttttttatggtcgatctccaggctgtctctcagtctctcgcgtgttaatttggagtgagtacgtgtaaagccatttttttccgcgctatggccaggctcgcagcggacgtccacatccacagcctcgatcgcgattcgcgcagcatgggttgtgtttggttggttttgcaagggtggcatgtgccgtgctagaatcggacattccgcaatgagaccgacgagagggagatcgctcgatcgatcgatcagtgaaaggtgctttagctagcatagcaagcgatagctaagcaggcacagtggttgcccgaccggttcggcgagatactactgtacaagtggatgatcgatcgagcagctcgcgggcgagacgaagctcgcgggcgagacgaacgacaagtgaagcggccgtggccactagctgtagcttttactagctcgttctcttcgtgatctctttgggtggatcgattgaaacgtggggacggaggaaggtccccatcgttttctctaatatagcattgctaaattttgtttttttagacttaattttagtttttttatcgagatttattttttaataatggtatacaagtcgctaggtacgtatatataaaaatctacctacaaaattattattattattactaatacgttgaatgacgtatgtgatgaggacggagaatgctgtgttgttggaggaagtgtggtgtggttgctccacgcgtgcaccgggcgttctcctttctccggtgatacgtatacacccaactaggaggcaaaaatatctttgctaggtctgcgtggctgcagttgacaagtcctagattttttcgaaatatcttctcgatcggtctacagttctgtgggtggggacagcttcctagatatccggcagagcactactactattatcctacctgatgcaaccatctggctgctggccacatatactcgggtgtacatgcgtgtggttatggatcgatataatcatttcaggatcactcatcagttaaggttagtggtgtgttgccgcgggctattagaatttagaacttagaacttataaacacttcaatgaatgactgtcacagttcgatgatgtgactatatatggccgtgttcctccctcattaagatgtagattataccttagattttgtcaccatgttttttaactgctaaacaacgtgcttggtacgaaaaactttctatacaaaagttatataatataaaataatttttaagtatgtaataattaaaacttgatatttttactagttaataattaaaactcgagtaatcatgcgttaatggttttatcgttttacgtgtgcacttaaacttcattcttattgcacaccacttatatatgaaatctcatttttaataattaatattgactgaattacaactatataaaaatagaaaatatgtgccgctctagctgattttcttatgtgatcaatcataaaattcagatataagataccatatgatgtcttgaaaaagatattacgaactctcacctgtacgctatctcctgaacaaacataaattctgttcaaatgtgtgttttgagactatttgaagccagcagcatcactccatgttctctcttcctactctccatacttgggaagttgggttgaagtgtgaggccgggaagaattcaagacatcatggtccacagcccatatgaatggcccgagacaacaagtagcctactaactattaggctccactttgggccaagcccatgttttgttgggccggagcctacaccagtacaccaccatcttcctcgttcggttcccatctcccagttcgagcccacgccatcacggccgcgccgatgctcccgtcgccaccggcgccgccgccgatctcgccggcgcggctgcacaagctcgtgacctcccagccggacccgctcctcgcgctcgagctcgtcaccgtcaccgcgccgaccaccgcgccccacccgtcgacgctccacgcgctcgcgctccgcctctcccgccgccgcgaacacctcccccacgcgctcgcgctcctgcgccgcctcccgtcgccgccctccccgcggatcctcctcccgctgctcctctccgcgctccgcctccgccggcagcctcacctcttcctctccaccttcaactccctcttcgtctccggccccagcccgttgccgctccaccccgagcttctcctccgcctcctctccgttctctcctccaccgcttcctacttcccgtgcgcgctacacctcctccgcgacgtctccacccgccttcccctccccgagccgctcgtcctcgcctcgcacaacctgctcatcgaagccgccacccgctccggccacctcgccgtgtcaatctccctcttccatcgcctccgctccctccatgtgtctcccaacgccgagacataccgcatcctgacccagtcactctgccgcaggggccaggtccacactgcggccaccctgctcgacgaaatgctccacaggggcatccctgctgacccactggcatacaccaccgtgctgaatgcgctctgccgtaagaagcagcttcgagaggcttaccgcttgctgtgcctcatgcgaggccgtggggtctcacctgacattgtacattacaacacggtcatcgtcggagtgtgtcgtgagggacggccactggatgcctgcaaggtgttcggagatatgagggagagtgggtgcgcgccaaatgcggtgacatatactgcggtggtgaatgggttgtgtgtgaatggattatatgacaaggcagaggcataccttgatgatatgttgggcaaagggttactaccacatttctctgtgttccattcagtgattaagggatgctgtgcagttgggaaggtcaatgaggctgcagggatgatgactcgaatgcttgatcttggaatggttccacatgctgagacctggagttcagtgatcaggagtgtttgtagtgatgaggataatgtcgaggtggttttgttgcaagtgatgaaaggaataaagcacctctcaaacataaattcaaggagtacttggacatgatatcatgtggcatggatgcaaggaacacctattttatggtgtgttgtaacaatcagttttgaaaggaaacagtagatgatgtgcaaaatgtggaccacaaccatttttctcatcgtatgcagctaatttgatatttgagtttatttgtttatatgcaggttaggagatattgtctgacttcaactaaggtatgctatcctattgcaagaaaaaaaaagttatcgcccttaattaatgtgattcatatgattgttttggtagtacattttgaaggttgattctgaatttctgatgcttgttagttaaagaccatactttgttctactctgaatccagttgatcatttatactttttcttatgcctcttcaattgtgtgcattcgcagatcttataatctgccaaagcccaaagattttggttcaccttggttcatgttttctggattttgttagaccccagttctgtgtactttgtggaaactataatgttttggcagcaggagctgactcagctgagtgaaggatcagcaattcagcatggagatcatctcacggcaaatatgggaagctcactggacgttggctgaattccaactgctgttgtcaaggtgcatctgatcttctcacgacaagcatacactatacatatcgttgcaggtgcagacaaaggttttacgactatttgatttcctgatacaacgcggcaaagctgctgggatctggatggttcactcgcacggcttgctacatttttgtgcacccactgacctcgtcgtacttgccgtgcccggtggtatcctctccctgtgactgcataggtagtgcggtactgcctcagagagttttgtgtgctgaagtagagaaatttttgtaattctattttcactgggtgatgtacctttcaagaattcaaaattaccagcgattaccggtaacagtggccatgctatgtactatgagtctatcttgtatagacttagaacaagccccccttcattcaggagataaaaaaatgatggattcttgagattttagatttaaaaaatgattatgtacacgtattggaaatgcaaacgtgtaatcgtattgtactgattatgtaatgccatacggtgtccattgacatttgcttattcactctggactactcgtttcgtgctgaatcatttgcgcctaattgattaggccatgtctaaattttgatacaaattcctgctaatttcagaagagaaaaaaaaagtggtcatgaatagggtttaccaaaccgaagtggtcatgaatagggtttaccaaaccgttttcagtgggttactatcctcgctcgatttgacggttatcacagtaactaccgtggtttaaaactgaaatatttaccgcacgtgatagccgggcgataaccgtgcggtttgtatgcgtttcctcctgcggctctgtttcgttgcgggggagccccaccggcccacggcgcgggatcaccgccgccacagaaacctccatagagatctccgagcagccgtcctccgccacaactttcgccatggtggcgccctagccccgcgcttcttatcccgccccacctatggctgctgctgctgccgctgccgccgccacactcctcccatggctctcctcgcgctccgcctcggccaccaccaccaccacctcggcctctccgccccgcgcgacccccgcctcctcctccgccggaggctcgtggtcgccagctccggtgccgtgaaggcccccgcggccgcggcggtcgtgtggttcaagcatgacctccgcgtcgacgaccacccgggcctcgccgccgcggtggctgccgagccgcgccggcccgtcctgccgctctacgtcttcgaccgccgcatcctcgacggtacgctgctactactgcgcttgctagccccttgcagcaaatgtctcactgagccactggttttggaatgcccgggggctgtgggaagtgtgtgcgatgtgttcgacacaatgtcttacggatcgcgcggtggtttgatcggacgcttgcactttggtgtttactgtgtactgtctctcgcgtgcccggtaacctggctacgttttttttttttgctacgtttgtgcaaaatctagtgactttgatgccaggattcgtggttttgtagaaatgtgcagtaaaccgaagtcgtaggttttttggctgccgaatcaaagtgtaagctgtggattggttgtagtgcgggatgatactttctggttctgctaattcagaaattccctagcataaaagtgaaacatatggtttgccttaaaatagacgctagtaaatggagagaacaactgcttttcagtcccaacttcttgaggagacctgcacctccactatctggtatgtgccagatcatgaaggttttgattggaatggacgagatcaagggtgtgttttatcaagtcatgctgtggaaatgggtatcagaatctgatgttaacattcatatacaagtaacagcgtgcaaagttatactgtaatctgtattatgcagtgcaagaatcccaagtaatcacactgacagttggcattgacattagcctttttatcctttgcaggttactcagacacgatgctggaactgctactttttgctttggaagatcttaagatggttttgaagtctcaggagtctgatcttctcataggcttgggaaatgctgaagatgttgttctcaagcttgtaaatgaggtcactatgcaaggtttatgttgagaattgagcttaagagtttatgcaaaccttcactgctagccatctaacatatccagatctcctgattgcatgcattgatggagcataacaggtacaagcgggcctcattttcacagaagaggaagttgagtacagagtgcgcaatgttctggccagtgttgaatcatctctctctaatgcatcattcctatcgggaaaccctcctgagatagtggtttggagtgcctcattgtatgactacaaggtaattttgtatctcaggttatcattccctattgctatcctctagcaacctaattatgtttggcatgctaaaatcattccaccagaatccgagggaattgtcaacatcacacaaccaatttttgaaggaaaaattaccgatgaacacacctcttgctgccccgtctttacctgctctgaacatagagatagagacaggtgtatttcagttctcttttttttttggttagtgattatatccttgatcatttttggtgtgtgcattatgataccatgacaatttcctgttcaggttctctccccacactggaagaactaaaagggtttcttaaagagagtagaacgtcagagaataattgggttcctctcaagggcacatcagccagatctattcttaaaaagactctcagccagataaatgtcaaaaccggtgttgcatcaagtggcagcgatggaggagaggataccactgcatattatgctatgtcagggaggaagatccaaaattcaatgttcacatcagaaagctcaacagaagttagaggtggaacggaaatcactttggatgctttagctgcatacctgaaatacctagaaggaacagggaaggctagttggcaagagtacgtcgcaccacttctttttaaaatctaattacattcagcactattggtatgtttgtaactttgtatttgaaaatgttgcctagctcataaggtaaatgcagtctatgatgtcatatcagtcatcaatgatttttctgataacaggctttgtttaaatttcatatccaggttgcatgataaagtacggttaactgaaactagagatggtgcctcgttttgcactttgtttggtcctgcacttcagcttggagttatatccaagaggagagtttaccatgaaactattcagtatgagagagaccggaatgctggatttatatcaccatttggatactcaacacctacagtgacagcagcagtagatgctatctgttcaatggaggtacttttgtaactgtcctgttctcaaaaccattcgtccataccttttcctcctcttttcggtgatcttgttttcctctaacaatgtctttctgaacatgaaagtggtattggctcttggccttgaaatcccaagtatgcattgaaggaaattaccctgtcagaatctggagatggaaaggtcatcttatacaggtactattagttaacttcaagatccacactctctatctctactgcatcagaaaccataacttatctatgtaacaggaatcatgtcaaatgcaagtagtcctagaattggatataattacaatcagcaatgttagtcgttaaaatgaattgtgatggcttggtcaaccactaaaaaggaccaatgtattatcctctgaactattcatctttgcacttggatccttccaccttctggttgccgatacagacccctagataggtaagcataaaacattttcttctatcccatattagtatctctgaaactaactaggatttcagctgaaccatttaaaagttccatccagcagggcagcagctcttctt

SEQ ID NO: 67488 - DNA, 1065 bp, Oryza sativa
cagttttgttataatttaccacgttattgttgcagcaaactgaaacgtgacgctaatgttgcagcaaactgatagttttgtcactaaaattgctgttttctgaaatctacactttaaaaaaagtatatcttttttcctctctatctacgatgagaaaatctagttataattctatttgtatatgtatgactaacatgtgggtcccactagtacgtcggcgctaccgtggcatgacacgttagcacttggagcgggtcaaaacccgtttggacctaaatgacacacaagacaagttcggagacctaaaaatatattttaagagtttagggacctcaataacacacccgcacaagttcaaacaccgtccacgtatttcactcaaattttgtttttttaaaaaatgcatcgtttagtagttcagaaaacgtacccgtggaaaacaaggaagtaggactcgagaaatgtgagaaacaaactaaaagccaagtctataatgcaccacctacaatctaacataattttgctacaatttggttaaaaaaatttagttttgcaaaatttactcaaaattggacgatattagtatgaaatacgtccaaccaaaatactggagagaactcattggacaatcaacggtagataagcgcacgaagctacctcacgttcccagatcaacggcgtggattgcgccaccggagcccgcatccgcatccaccacctccgctcgcaatcactctacaacagatcggaaacctcgcgggcggcggcggcggcggcgcgggtaagcgagcggacaccggcgacgagcgcgaggaggaggaggaggaggaaggagaagatggcggcgacgctgtcgcagctcgacgacgggatcgtccgcgggatggccatcggcgcggtattcaccgactacgtgagttctcccgccgcgaaaatcccccatttgtttcgactgattcgccgtggtttcctaatcgaactggtggtggtggcaggctgggaagataaactgcctcgacttccaccgcaaggaggatctcctcgtcacctccagcgaggacgact

SEQ ID NO: 67489 - DNA, 749 bp, Oryza sativa
tatgtttttagtacgatgggtccgctcagaccgccagaaatgttctttaggatttttaggttgggttagtttttgtttttcaaacttttgactgtctgactttctttgattttatctaacattcatcccttttagccgtttctttttttttcaactccaaacttcaacttttttttattttctgttagtatgtttttcaaatggttaaatggtttgttttttttttgcaaaaataatttttatatagtagtttcttgaaagaatcaaataaactttattttaagtttataataattaatacttaattatttatatgctaatagtttatcacgttttgcatgtcaccgaaaagctaaacaaagatagagatttacactacctttaataggcttctctgtattcgatcctacacgatcactttgaagaagaagctgaggacgtatggtacctgcatgcacttgatccttccgccgttggtgatgtcgccgaagcctgagttggtggagcggcggctcactgggaggccggcggtggacttgagcccctggaatggagccacggaggtggccaaggaggctatgacaatgggagccatagttacgtagctagggccttttagattgatgacattttcaaccatatcattatttggtaaaattaataattatgtgactgcgtttagcttgttactaaatattagtaatgtttatataattttggcaacattattaagccaatcttactaaaat

SEQ ID NO: 67490 - DNA, 44413 bp, Oryza sativa
attcctgcagcccagatttgtctaagtaggatcgtaatcataaaatcgtatacataaaaatgataacatcattgattctacctactatatcgtagaatcagactccttaattacaaccataaagtcgtatgatatattttgacaaccatatatactcacgggtacccaagcgagctcgtgagtgttgaagcctgagcatgcacggtcaacataatcctaatcctaatcaccagggtgcaacttttttttttcgggaaaaacagggcattccattactcaggaataaaatcatcctttacaatttgtgatacagggtgcaccttttgatctagtgcctaatcctaatcacgacgatatgatggttttcgtcaaatttcggtcaaattaatttgttgttaaaaatttgaatccttgaaaacattccaaaattttactcggaatctgccttcgttctacgtcaaaacctaaaaattttacggttttcaatcagttacagatttttttttataaaaaaagaacctgaaccctgactgttactcgatcgtattggataaaggaggtggcagcgatataatgcatgcataaatgtgagttttttcactgaaaactacgggtactttgcagctcacccaccgtggaatcggggtaggcatacacaccacatacgacatccgtaatacgagcgagcgaggcttgcaactgcatgcaaatctcaaatccgcaacaacacaacacaacacaacacacgcgccgtgaccgtgaccgcgttgagcgcgcatgttaaccggaagcggccacgcggccggtgaatcaatcaatcgcgcgcccgtggccgtgggagctgaacctgatcgagcacgtataccgcacgcgaaacgtggatcggatcgcgacatgcccccggccggcggccgcgggcagcgtgcgggccaggcaggcgatcgcgagagagggcaaaccgtgccttctaagcatcacggaaatgaagcccacacgccggtgcatccacgtcgcctagctaaatttggcccggtgtcctctccagtttcctgacgacgactgcatcctggaactggaagtagtagtagtaaataaaatactcaaaattcaccggaattcacctccggattactactaaaatgcatctcaacccaagaaatcatctctatgtattaaaaaggaaaaaaaatacgaattacccttttaaactatagcggtcgatcgaattatccccctaaactcgaaaaccagacatcgttccccctaaactatgtataccggacgaataaccccccctgagcactgttttggatggtttttgacttgtgtctgcatacgtggccgccaacgtgacatccagtcagcaaaataaaaataaaaaaaatcttaggacccatatgtcatctctttcctccaccaatccctctcaaatcccatccccctggcccctgcctccctgcttgctctctctctctgcgtctatggctggaggaggagacggtggccgacggcggagacggatcgacgcgcagacatcggtgcacaaaccatcaccgaaggtggctgccgtgcttgtccaccacccccatcggcgacgttggcgagcctccgcgggagcatgaggcagagatgggggacaagcacgatgtccggtggaagcaaaggtggggcgcgtcgtacggtcacccgagctcgatggtaatgggggactcgcgccttgccagccggccaccaccacagcaagggtagagaggagagagatggcgcgtcgccgtgcgccggccggctgccgccgctcgctgcagcaggtgagggaggaggaggaagagaggggatggggattgagagagtagagagagattgagacgttagaggtgaaagagagagcggagagtcttacaggtggggcccacactgttttttaaaaaaaaaatgctgatcggactgccacgtagtactgaaaccaccccggattgagccgggggttatttacccggtttgtatagttaagggtgtaaaatatctgatattcgagtttagggggtaattcgatcgtccataatagtttaggggtaattcgtaaccgtggattatttaccggacggaattcacctctagattatttacggccgggctgcaaattctcgctcggagttgcatgaacgtctccgcctctgacgaatctgcactttctgcagccttccgccggcagctagcccgcctggcgtatcggagcagaatttttacagattttttgagacattgtggcgttttgaaacagttataactgcagtatatgtgattcacgttgggcctcaagattttcaattttcctttttaataagattgggtccccagattgaaggtatatatgatcatttcatatgggggttcttaagctgacccatcgatatacgattttgtctagcttatgtagattcttaaaagctcgttaccagctagctgtttctcatagcgttaaccttcacaaacatggcatacatatcgaaaacagaagcaaagaaacggatcgatgaagctttggcgctctcgttcatcctgtttggtcacgtgggctgtgggaacgggtgaggctagaacatgataaccacgagccaagtctcccattttcgtcttccaactatatgtcgcatggccgtatttgccaaacgtgacgaatgctccttcttcagttagaccgagaaaaattaagctagattccataactagcatcgatcgcttatgtgagtgtgtcagctgccttgcacgagctgatcagctcgcacgcatcgcggaggattcagtcaaaaatatgatcactcgcgcatatatacatgcatttcagaaagcacggatgcgcctagctcgcaagcaacagcgccgtgcagtagccttacaccatgtaattacacttggaatctagttctaccatgtaattacacttggaatctagttctataaaaaaaagaagttggaatcgtgtttggaacgatcactctgaagtttgatccactcagatcccccggaaaaaaaaatatctccatcatttgctttgtcaacgagttacttgaaatgttgagtacactgcgcggtgcaacgtacgtaacgcaaaattacaatcccaattaagcagacgcagtccccatatattgcatggtcaaaaccaaatgaagtccaagtctccactagattaattcgggccaatattaagtatcctgctgtatgtctttcggtagaaactctgcaaattacgatcaatatttagcccgtttcaagaggaaaatagttacagataagtaggtgtgtggtacgtatacgtatatatgtgtttagttcacatcgaaattggaagtttggttaaaattgaaacgacgtgacaaaaaaagttaaaagtttatatacgtaggaaagttttgatatgatgaaaaagttgaaagtttgaagaaaaaatatttggaactaacaaggccgtaaccgaatgtcaaatttgcatcaaaccacgctcctgtagcagagacgccacgtgcagcacggccaagcgttccattcctcccgtttccacccacgcgcgaacgccacaatttcccccgttttcctgggcgtttttccaccaccaccaccaccgccgcgagacgacacgagaggagggcgcggcgacgacgcgagcttccccgcgcgcgcacacaaccgcgacgtttcccgacccctcactccaccccccaccgcaccacgcgtgcacaccaacactaatacaacactcttcttctcacttaacccgctctctcttataatcaccaacctgcagcgagctgaactgactgagaagccaatccgcgaagctaccaaaccgagccaaaattttgatcgatcgatcggccggccggtgtctttgttgaggcgtgcaaggctcgtgctttcgccgagagggattaattagccgcgcctccagcatctccggcctccatagagatcccagcttataattaaagctgtcaagagtcgttttggttgttaggcttaaagttaactactgctggctagctaggactaagagatccgagggagcagacatggctgctgctacttcgaccatgtccctgcttcctcccatcacccagcagcagcggtggcacgccgccgactccctcgtcgtcctcgcctcccgctgccacaactctcgccgccgccgccgctgccgctacgtcgtgccggtacgtacatgcaccatcctctttcttctccggtgaatcaatggttggagaagaagaatccgaatgaaatgtaaattaaatatgtatgtggatgtggtggtgcagagggcgaggctgttcgggccggcgatcttcgaggcgtcgaagctgaaggtgctgttcctgggggtggacgaggagaagcaccagcacccggggaagctgccgcggacgtacacgctgacgcacagcgacgtgacggcgaggctgacgctggcggtgtcgcacaccatcaaccgggcgcagctgcaggggtggtacaacaagctgcagcgggacgaggtggtggcggagtggaagaaggtgcagggccacatgtcgctgcacgtccactgccacatctccggcggccacgtcctcctcgacctcatcgccggcctccgctactacatcttccgcaaggagctccccgtggtacgtacgtggcccctttcctcgtcgctcgctttactgatgctctcttcttctttcagacttggagaccacaagcttttttccttttttttttcccctttgctcttttcatttttgcaatcaagacgtactctgtgtcaatgtccctgagataattgatgggatccaataattcttgtctgctaaagcaggcaaatcccttgactttctagatctgattttagacactgttattagtggcaccaaaaactgatctccaacaagtaggggaaacaattttaatctctcagattggcatccatccatctgttacatatcaattaaatcgttataaaaaaaattaaaatatttgataatatagattcacatataatatgtaagtttaaattcgacttttataagttgtaataaatataaccaatcaaactctaattagtttactatgttcactgttaaatttgttacttttattataacttgtataagtcaaatgtcaaatttaaacttatatgtttgtggtgcaatatattatatgttaatctattttatcaactttttaagaatattatatactagtgaaattaatcaactgtgttcaaagttgcatgcccacttgacacgtgccaaacacgacttggaagttcagatgtgagaataaaaatcgaaatttttgaacagcttcctgaaattgattaattcgagcctaatcgcttgctttggttgaccgttgactcggcgcgtgttcggccaggttctgaaggcgttcgtccacggcgacggcaacctgttcagccggcacccggagctggaggaggccacggtgtgggtctacttccactccaacctcccacgcttcaaccgcgtcgagtgctggggcccgctccgcgacgccggagcgccgcccgaggaagacgacgccgtcgccgccgcggcggccgaggaggcggcggcggagcagatgcccgcggccggcgagtggccgcggcggtgcccggggcagtgcgactgctgcttcccgccatacagcctcatcccctggccgcaccagcacgacgtcgccgccgccgacggccagccgcagcagtgacggcggcgccgccgcgattcgtagattagcgaattcgtttggttgccatggtacacctacacgcatgcaatgtcgccaaatgacgctgcgtgctttgcgttaaattctttaattattcgtagtggcatttagctcagctcagctcagctctgcaattagcacatatttgattagctttagggaatgagtgtggtgagcttgtaaatagaagaacactagtagatggcaagcaaatggaaacgatcgatgatgcagtagatgttactgcaaaaatggcaattattagatgaagtcgacacacaaagacagatctcgtttcatttgtacattctacagtctacgtcgatgaggacatgactggatttgtatagcaaattagtactagcagctaataagtgtggattaattatgaaacacgattgtttaattatgcgcttggcgagtcatgcgattctttttcctgaaaaaaccgaacgaaccatggtgttcatgtcgcgatcagaattcagaacatgtcaagatagctctcgaatcttgccagactctgcaggagacgtacatgaggagaactgaactgaagaagtcgttgcaaggttggtaatctggcatgggtaaaaaatacgtgtgctctgaagcaaatacgtcaacggtagctttcaggcttgcgtgccggcttaattttgatgaagctgatcgatcgatcaccgcatgagttgatggattgaggtggtgtttgtatcagaaacttaactttagtctttttatttagacactaatttaaagtattaaatatagactacttacaaaactaattcaataaatgaaagctaatttatgagacaaattttttaaacctaattaatctataattagagaatgtttactgtagcatcacataggctaatcatggattaattatgctcaatagattcgtctcgtgaattagtccaagattatggatgggttttattaatagtctacatttaatatttataattagtgtccaaacatccgatgtgatatggaattaaaagtttaagttccatctaaatagggcctgaatgaaatggtttgagagataactttcggttttaattgcgtcattgctggaatctgcaactttgtctgcaaccgtgatgtggtgtatgatttctatggtgtgcttgatgatgcgtgtaactcttgcggtcttgcctctttctagtactgctataaaatgactcttatgctctctgtttttttccatcttttttctgaaagtaacctatggtggctctgtggtttcacatttaactagctttgttatacaccaaaaatatcgattgaccgagatagatatgcttggtacttctttataaagtgtttttgaatttaaattagtttcatgcttaagaatcattttaggtgaatttttacttgtcctcttaggaatcactaaaaaagaacccgggcaataacaaataactaagaacaactctaaaaactaactcgaaaattagaacctaaaatccaaagtggattataacactatatggagtcctcaagtttgatgcttatcacatacagctgattatcattaaactcctaacttctttttaaccaaaagtttatgatttgatcaactacgcggatgcatgatccaaacgaaaggtatgctcatcacggtccagataggcctcaaaattgcagcccacccagaataagtcactttctatcgagtttaaatcacatccctataccgcaatacaagaaatctcatcctcaacatgcaaaaccggtttaaattatgtatttgggctatatggatgatcggttttgctgacgtgacaagttgacctaatacattcatgctgactagcgtttacgtggcaaaaaagaaagaaacaaaacaaaagtggaacccacgtatcatcctccctcttctctcttcctcgtccatcatctccattttgttctctgtctcttccccttggtcctgtcgagcccgacccatcatccacacgcgccattgtttgttgccgaaaattgaaaaggaaaagaaggagaaaaaaagccgatatattgacagcaattaagagtattcatagtgtcacacactaaaaatatgctactcctgtacactgtggtagtgccacacagtcgctgaactccgatcagttcacgcaaagtcgccatgggttcgcacggcgacagcaccggcggcgtgtgtgaatgtgtcacggctgcgacgcaggcggcttcggcgagtgcgacggcggcgtgacggcctacctcgcccacaaatgggccgaaattcgcggcctattccaaacgaggccgtagacaatgcaggcccaaatagcccagcaccgactgcttcggctgctttcccctccttcccgttccaggcttcccctcctcccctctcaccacgccactcccctcctaccccactctcgtctcggagaaggcaacgtcgccctcgccgccgcggcggccggatccggcggatggcgaactcgaagcggctcccgtactccacggccggcggcggcgggggaggaggaggaggaggggggaggcgcggcggcgcctccggctccggcgtggtggcgccgctggtggtcctcgtgttcctcttcgtgctcgcgccgtcgatcttcttcgtcgcgcgcaatgggggccacgtccacgtcgcctcaggttccggtttgcaccccccctctcccccccccctgatgtagcatctagattttattattatttttttggtggggtggggactgggagtgatgtcttcaggtttggtaaatttcccagcgttggtctcatggatattgccggaatggaatccgagtagattttagtggtactgttgttaaatgcaattgatgagttgtatttacagggtatggtatgattttggatgagaactctgtatatagataattggatcatgatgctttgttttggaaacgcaaataatcaatctcactttggagaaatcatgagtttacagcagacaattgaagttgtgcttcaagtgattttggaaatcattttcccctctcttgtagtgtcacttgtgccattgcgaggttagaatgttagatgtgtgacattgtgcggaaagccccagctattaagaagctagggcgcacaagtgaattgtgggtgtaattctagtgccaaaagcccataaacaagaaaactgcatttataagaactgtaggaacattgtcaatgttttgtagtatttgaatactgctatactgatttgaaatatgtaagtgatgttgtattctgtttacctgcagatcccaaggatagggaaggtaatcaggtatttatcttttctgggagctagtcaattggtttactagcctaaattttgaggatccatctcactttaaagcttgcttgcaggaaacagattggcaaaaacaactggcaacaaacaacctgaaatctattttgtccaaggaggtcagaattgtcttgcgacttagtaatataatttcttatctttattttttggtttcatggaaatgtacaagggtacataacaacatgctcatctttgctatgctactaatttcgaaatgtcatgatctctgatttgtccttgcaactgattgccctttctctaaataccatgctactctctattgttccaagtagatttgcatgctgtgtcctctatctgctctgtaattctgttgcgaacattttgatttttcaattaccatctactgttatttgcataggaaactgtcatcttgttcagaagtatcctcgatttttctgtgcttttagtcttatgcataccttttggtctccagatgatcgatgctttagcttctagtcaacaagaagcaggcactttgagtgttgattttttcagaaaacgtgcatctccctcttggaaaactgatgatctagtcaatgacctgagcaatgctagtttggatgttgatgacaaggttaaatctgaaaacagttctgcagaacatgagttatcactgacagataaaacacccaaggatgatactggtataaaaataaccatgactttttttgaaaagcacatttcacacaatccgattaggtactcaagaaaatatacttcttttctgtgcagctgaacatcaagtcgatgcacctgcaaaaaatgctcgaagggtaagcatgctggtcttcttgtatgtacattgatacattgttgtttgtttctatcgatatccatttcttatgacctaatacttcccttgatatgttttggtcgctaaagaaactaagggagaaaaggcgtgaaaagagggcaatggatttggtaaggaaagatgatgaagcacgtgttaagctggagaatgctgctattgaacgatcaaaggctgtagattctgctgtccttgggaaatacagcatttggagaaaagagaatgagaatgagaactcagattcaacagttagattgatgagagaccagattatcatggcacgtgtttattctgtgcttgctaaatcaaagaacaagaatgatctttatcaagagctgcaaaccaggatcaaggaaagccagagggctgttggagaggctactgctgattctgaccttcatcataggtgttatatctgtgatctgatatcttatctattttcacttcatatctgatatcttatcttgttctccatcgtgacaaataatgtactttgcagtgcacctgagaaagtcagagtaatgggtcaacttctatccaaggctagagaagatgtgtatgattgcaaggcggttactcagagacttagagctatgcttcagtcagcagatgaacaagtcaggagcttgaagaagcagagtacatttcttagccagttggctgcgaagacaattccaaacagcattcattgtttgtcgatgcgcttaacaatagattactatctcctcccgttggagaaaaggaagttcccgaggagcgagaacttggaaaatccagagctctaccactatgcacttttctcagacaatgtcttggcagcatctgttgttgtgaactcaaccataatgaatgctaaggtagtttctgtcttcctctttaatcaaatgcaaactgtgataagtgataagtgttctgacaactatgtatggcataaccttttcaggagcctgagaagcatgttttccatcttgtgactgataagttgaactttggagccatgaacatgtggtttttgctgaacccacctgggaaggccaccatccatgttgagaacgtagatgaatttaagtggttgaactcatcgtactgtcctgttttacgacaacttgagtctgcagccatgaaagagtattatttcaaggctgaccgccccaccactctctctgcgggttcttcaaacctaaagtatcgtaaccccaagtacctctccatgctgaaccacttgagattttatctcccacaggtctatccaaagttggataagatacttttccttgatgatgacatagtcgtgcagaaagatttgacaggattatgggacgttgatcttaatgggaaggtcaatggtgcagtggagacctgtggggagagtttccatcgttttgacaagtaccttaacttttccaatccacatattgctcggaactttgatccaaatgcatgtggctgggcttatggaatgaacatctttgatctgaaggagtggaagaagaaagatatcactgggatctaccacaagtggcaaagcatggtgagactactactttcattattggatcacattgatttagagaagaaactgtaatgcaacatgatttagtctaacattattcttgctatttttcttctaacagaatgaagaccgggttctttggaagcttgggacgcttccacctggcctcttaaccttctacaagttgacgcatccccttgacaagtcgtggcatgtccttggattaggatacaacccaagcattgatcgctcagagatagataatgctgctgttgttcattacaacggtaacatgaagccatggctggagttagcaatgaccaagtacagaccatattggacaaggtatataaagtatgatcacccttacatccgtggatgcaacttggcggagtagatatgatgtaaaaagctgacggagaagatcacccagcctgatcagaggtgcttctattaagtggagtaaatacacggccggtgtcagttgttctgaaaaaaataaaatgcgttaacggtagctttcaggcttgcctgccggcttaattttgatgaacctgtcactggaactttctctccagctgatcgatcgatcaccgcatgagttgatggatcgaatggatggttgagagataattttcggttttaattgcgtcattgctggaatctgcaactttgtctgcaaccgtgatgtggggcgtcttttttctatggtgtgcttgggccctgtttttaagtccctatcacattggatgtttggacactaattataaatattaaacgtagactattaataaaaactcatcaataattttggactaattcacgagacgaatatattgagcctaattaatccatgattagcttatgtgatgctacagtaaacattctctaattatcaattaattaggtttaaaaaatttgtctcgcgaattagctttcatttattgaattagttttgtaagtagtctatattttatactctaaattagtgtctaaatataggactaaagtccctgatccaaacaccaccttgatgcgtgtaactcttgcttctttctactgctataaaacgactcttatgctctctgttttttccccttttgttttttctgaaagtaacctatgctatctctctagttgaaacttaactggcttgatatggaccaacatattgagtggccgagatggatctgcttggtactcctttagatttaaagcgttttttgaattcaaagtttgatttttgtaatttggggtagatttttttgattgcctgaaaatcattaaaagagatccaggcaataaaagtaatgaaaaccagccctaaaactaatcggagaaccactcactacatgtactcatctcgtccgatccattactccctatatttttaaatatgtaataatgctattaatttttagacatgatgttgagcaattcattttatttaaagatttattgcaataattgttaaagtacctttaatgataaaacatatcaaatacaaaataaatgttacctcctttgtttcatgctataagacgttttggcctctcgaccccacatctagattaactaacatctatatgaatttagacacgtatatgatgcacatatatggatccatgcataaatctattcgaaacccaaaatgtcttataatatgaaacaaaagaagtacttgcatagtattctaaataagacaaattgtgaaacattatatccaaaaattaaaaggtcaaggcgtcatatatttcaaaatggaggtcctatactattaaattcctaaactctaaggttaccaaagattttatgaactggttgacaaaataaaggatttatttggcagaactctagctcccaattttacgttggatttgaagtatgtatgttaaattgtattggtttcaaatattatatttagtctaaactaagaacaaaatgactaatctagatatttttgatgtaaccttagatttcgattcatgcatttgtggagctaaaaatacataactaaaaaaaaggaaatcttaaatccggagttgtgctaaatagggccaaataagttaattaaagtagagttcatttaacattggactaattatttttaccctagtttcaccacgaacccttaaccaatattttcacttttagaccacctcttttttttttaacctttgtttcatactagcccatacacataggtgggccttaatttggcccatctaaacggggccgtagacaaggcagaagcctagatggttttcaaaaaggcccaaatagcccaccatcggttgcctcacatcttcgggtgctttccccttcctttccaggcttcccctcaccacgccactccccccaccccactctcggcggaggaggcggagagggaagcgcgccgcgcgcgacgtacgtgcactctccggcgaggtggacccccgcggatcctacccttcgctggagatggcgaactcgaagcggctcccgtactccacggccggcggcggcggaggagggaggcgcggcgtggtggcgccgctggtggtcgtcgtgttcctcttcgttctcgcgccgtcgatcttcttcgtcgcgtgcaatgggggccacgtcggctcaggttccggtttgcatccccctcccccctcctgatgcgcggcgctgtcggttgttaatcgcatcctccgtcgcgaatgtagcatctagattgtttttttttttttaaggtgggggtggggactggggagtgatgtgttcaggtttggttagtttcccagcgttggtctgagggatattactcggaatggaatccgagtagatgtcagtggtttaggtactattgttaaattcaattgatgagttgtattagtaggcttggttatgattttggatagaaaacgtagataattggatcatgatgctctgttttggaaacaaaaaattaatccatcgcactttggaggaatcatgagtttacagcagacagttgaagttgtgattcaagtgattttggaaaccattttcctatctattgtagtgtcacttgtgcctttgctaggttagatgtgtgacattgtggggaaagccctagctattaagaatctagggtgcacaagtgaattgtggatgtaattgtagtgccaaaagcctataaacaagaaaactacatttattagaactgtaggaacattgtcaatgttttgtagtatttgaatactgttatactgatttgaaatagataagtgatgttgtagtttgtttacctgcagatcccatggatatggaaggtactcaggtatttttccattctgggagctagttaattgcttagcctaaattttgaggatccatctcacattaaagctttcttgcaggaaacagaatggcaaaaacagctgccaacgaacaacctgaaatctattttgtccaaggaggtcagaattgtctcgcgacttagtaatataatttcttatctttcttttttggtttcatggaaatgtacaagggtacataacaacgtgctcatctttgctatgctactaatttcgcaacgtcatcctctctgatttgtccttgcaactgattgccttttctctaaataccatgctactctctgttgttccaagtagatttgcatgctgtgtcccctatctgctctgtaattctgttgcggacattttgatttttcaattaccatctactgttatttgcataagaaactgtcttcttgttcagaagtatcctcaatttttctgttcttttagtcttatacatgccttctggtctccagatgtttgatgctttagcttctagtcaacaagaagcaggtgctttgagtgttgattttttcataaaacgtgcatctccctcttggaaaactgatgatctagtcaatgacctgagcaatgcgagtttggatattgatgacaaggttaaatctgcaaacagctctacagataaaacactcaaggatgatactggtacaaaaataaccatgcttttttttaaaaaaaagcacattttaaatttttacatcgtctgattaggtatgcaagaaaataaacttcttgtctgtgcagatgaacatcaagtcgacacggctgcaaaaaatgttcgaagggtaagaatgctgatcttcttgtatgtacattgatgcattgttatttgtttctatcgtatgcattatgacatcattcatcccttgatactgtttggtcactaaagaaactaagggagaaaaggcgtgaaaagagggcaatggatttgtaaggaaagatgatgaagcacgtgttaagctggagaatgctgctattgatcgatcaaagattctgctgtccttgggaaatacagcatttggagaaaggagaatgagaatgagaactcagatttgacagttagattgatgagagaccagattattatggcacgtgtttattctgtgcttgctaaatcaaagaacaagaatgatctttatcaagagctgcaaaccaggatcaaggaaagccagcgggctgttggagaggctactgctgattctgaccttcatcataggtttgtgcctattttcacgtcatatttttatatctcatcttgttctctatcatgacaaataatgtactttgcagtgcacctgagaaagtcagagtaatgggtcaacttctatccaaggctagagaagatgtgtatgattgcaaggcggttactcagagacttagagctatgcttcagtcagcagatgaacaagtcaggagcttgaagaagcagagtacatttcttagccagttggctgcgaagacaattccaaacagcattcattgtttgtcgatgcgcttaacaatagattactatctcctcccgttggagaaaaggaagttcccgaggagcgagaacttggaaaatccagagctctaccattatgcacttttctcagacaatgtcttggcagcatctgttgtgaactcaaccatcatgaatgctaaggtagtttcgtcttcctttttaatcaagtgcaaagtgtgataattgttctaacagctatctatggcataatcttttcaggagcctgagaagcatgttttccatcttgtgactgataagttgaactttggagccatgaacatgtggtttttgctgaaccctcctgggaaggccaccatccatgttgagaacgtagatgaatttaagtggttgaactcatcatactgtcctgttttacggcaacttgagtctgcagccatgaaagagtattatttcaaagctgaccgccccaccactctctctgcgggttcttcaaacctaaagtatcgtaaccccaagtacctctccatgctgaaccacttgagattttatctcccacaggtctatccaaagttggataagatatttttccttgatgatgacatagtcgtgcagaaagatttgacgggattatgggatgttgatcttaatgggaaggtcaccggtgcagtggagacctgtggggagagttttcatcgttttgacaagtatcttaacttttcaaatccacatatcgctcggaacttcgatccaaatgcatgtggctgggcatatggaatgaacatctttgatctgaacgagtggaagaagaaagatatcactgggatctaccacaggtggcaaaacatggtgagattactacttccatgattggatctcattgatttagagatgtcatgcaaaacgatttactctaacatcaatgttgctttttttttttttcttctaacagaacgaagaccgggttctttggaagcttgggacacttccacacggcctcttgaccttcttcaagttgacgcatccccttgacaagtcgtggcatgtcctcggattaggatacaacccaagcattgaccgctcagagatagataatgcagccgttgttgattacaacggtaacatgaagccatggctggagttggcaatgaccaagtatgaccaagtacagaccatattggacaaggtatataaagtatgatcacccttacatccgtggatgcaacttggccaagtagatgtgatgtaaagctgacggatatcacccagcctgatcagaagtgccccttctccctgcgaaacatgcttcgctcgatcaaagtatagtagctagagctggagctattgattgcccttctccctgtcttttttttttaaaaaaaaagctagatgttctcacgaacgtgtgttttaggcttacagtagttctttcgttcaattgatgatgtgctgttttgtttgaccatcgatattataaggagaaacctgttgattgtgtgtttagggtgggtgttgccatcgaaattgtcaggagtattgttggcaactgacattgccatatgtgtaagtgtggaactgtggatcaatgaaattctatcacgggatggatgggatgggattagatgatatctgacgacacgaagcaatgtactgctccctccgttgacgttataactttggtcaaagtttaagtttaaccaagttaagtactccctccgtcctataatatagggattttaagtttttacttgcactgtttaaccattcgtcttattcaaaaaaatttagaattattatttattttctttgtgacttactttattatccaaaatactttaagcacaacttttcgttttttatatttgcacaaattttttgaataagacaagtggtcaaatattataagtaaaaacttaaaatcccttatattatgggacagagggtgtagtactttctccacctactttcgatagtcatatttcatcttggcacacagatcaaggataagtaattttacttatcatccatttaaacatgctactagtcattccttgtaaacatgcgattcattaatatttacatttctcgattctcatgtagccaatcttacgtggaagaatagagtcatgcattaaatccgagaaagtcgttaaaatgataatttgttagattgaaatatgcctatcgaaaataaattttacagatttgaaaatatgactatcaaaagtagatggagggagtaatattttcaaccaagacaaatttattataaaaagatatttaattattgatttgatgaaactaatttagtattataaatattactatatttgatatataaacttagtcaaacttaaaatagtttgattttgactaaagttaaaacgtcaaataacgtgaaaaagagggagtattctactgttcggtgatcgtatttgcacacgaagcggcaagtatgtaaaatgcagaatctgaatttaactatcggcaacacgtgacactacggggatcaccgccgtcgaaattggggcgaggagtccaggaggaggtagtggcggcgagatcgccggatcaactgatcacgagatggagatggtgagcacactggtcatgattcgattcctcatgcttgattgataatgataccttaaacctagctttgatctttaccagttcgttggcctgacggtttgcatcattcttatttttggacaattaacagaaaaggtaacccaaaaacagtactaaattgcccattcgctcaaggtttctgggaggcaataggtttaagccctcgaattcaacatgtcagtgatatggccaatctgaaacctgatgggaatctgccccaatttcattacaaggtgttctatcttctatgtttctggtgcttgtggaatcatcggcatgatgttgttttcaggaacatgtccccgtctctgcagtcggtccttcgcgaatgtatggaggagagtggtctttggctagaacgcctcaaatttgagcatcgctctgtaatcaattcttggaagcttatcttttcggctccccttcaaattctgactaatgtgtaacaaactttgtagctctcctttataatggtaaattcaggtggggaatctcccccccccccccccccccggggtgacttatctaaaaaaaacagtactatcttcctgattaaggataaggaggtaattatgcacattttgtctctttttgttgtgttgttctctctggcctgcattagattatgacgggcaagctgactgacttcacaagtgcatatgcatataaatgcaggttgcaccataagaaaacctgaacctctgtttctttctctgcaggtgaggggaacaacatcgtcaacttgaagcaatttgttgcttgtctgtacgactgtaattatcacaagccttccatgaggctaattgaccattggatgtcacatctttgtgctattaacaaatggaagcggcacacgtcataagctgattaggtaatgttcttccctttgtttactgggtgagcctgcatttcatcatttcacttcatgagttgacgagctcagaaaaaaaaaataatcggccgactttctcaagatcttttgttggacaatcgaattaagccatttgatagaacaacaaaatataagaatgcagtttgaattgatcctctcatactgcagggctgctgccctgttccaaaaaaataataaaaaaaaagcttaagtctatctctgacctggtcgctacggttgtgcaatgtaagtctagtatgctgatgagcaagaatgtgattacctcaccttatgttgtaaaggctggtgcctggagtcctcaaaaatagctactttctgaggaaaattaggtaattttctaaataatctctatgaacatataagaaatgtcaattggaacttgtagggtgcctctggaaataccttttgtagttttgtgacaggtttggttctatgttggactagtggctagcactgtgatttactgattttgctcttggtgaggtaaaagtttaaaactggtataccctactatgcagaaatcgtcttcatacttttcaataggaaagggatacatctctttgccttttagagatgaacacagaagaaatccaaacaatatactgaatctgtcttcctattggaatgctgaattggtccctttactttatctatcattcttttttgaaaagacgcataagaatttgtgatctgcagttgtcttgtctagttcaaaatctctctgaatccattgtcatggaccacctcctgtctattagttcttccatagctacagtgtattccgtataacctttatatatcttttcaagtcagagactgaccgtatacgtatcctttgaaatcttcagtcttcaatctgtgtatagaatatacatttgtatgaaattaaattccattccgtgcacagctgccgttggtttttttaatttgtccttaataaaatggcccttctagataccacatcacatttgcacagcagggagggagtgaaatctccaaagtgagccaagcacgaggaggacaattttgtacgcgagcgaagcagacaagaactcaaacaagcaatcaaaggtagcatttcttctcaagcttccttcacctttggttcgtcttccaaatccacatcctgatcgatcgatcgaatttatcttcttccatcgtacttatttcagattattcttcatccgcatactgtcagcttggcccgcaggatccatcgattgctgtgaagaaatgatcaaccggtgcttctgctgcgtcaccggcggcgactctgatccggagccggctgccaccagtagtcgtcggaggtacgtattactgcagtaccatgcatgtagaagccatcagaattagttcttgatactttgatagcatcgatcggttgaggtgatcattcggtgtgatgtgttgtttgccatcggagagagagttcttgatagcaccgatcgatcggctgaggtgatcatttggtgtgacttgttaattaatttgggatggtaggacgaatccggcgagggcgtccaagaaccggacgagcgtggattacccatgggaaacgtacacgctcaaggagctcctgcaagcgaccggcaacttcagcgagagcaacaagctcggcgagggcggcttcggcaccgtctactggggacgcacctccaaaggcgtcgaggtgggttggatcatcgccgccgacgcgggcaggttgatggccgcggtgttcttttctttttttaacgactcgcactaggtgtgtgacggccgaggtgtgtgttcatggattgaggcgaattgatcgatagttctatcttgttcagattgcggtgaagcggctgaaggcgatgacggccaaggcggagatggagttcgccgtggaggtggagatcctcggccgcgtccgccacaggaacctgctgagcctccgcggcttctacgccggcggcgacgagcgcctcatcgtctatgactacatgcccaaccacagcctcctcacccacctgcaccctcaccgcggcaccccctcctcccaccaccacgtccccctcgagtggccccgccgcgtcgccatcgccgtcggcgccgccgaaggcctctcgtgagtcgtccacggccggcgcgccatgatcgagcatcaccgaggttgattgattaacctactatccattggcattgcaggtacttgcaccatgaggcgagcccgcacatcatccaccgcgacatcaaggcgagcaacgtgctgctcgacgcggagttcgtgcccaaggtggccgacttcgggttcgcgaagctgatcccggacggcgtgtcgcacctgacgacgcgggtgaaggggacgctcgggtacctggcgccggagtacgccatgtgggggaaggtctccgagagctgcgacgtctacagcttcggcgtcctcctgctggagctcgtcagcgcgcgccgcccgctggagaagctccccggcggcgtcaagcgcgagatcgtgcagtgggcggcgccgctggtggagcgccgcaggtgggagcgcctcgccgacccaaggctcgccgggcgcttcgacgccgcgcagctccgcgccgtggtggagacggccatgctgtgcacgcagagcagcgccgagagccgcccggcgatggccgaggtggtcgacatgctcaggttcagcggcggcgagaggcgcaccaaggagatcgtccccgtggcggcgacggtggccggcagcagcgacgagatcacgatgacgaccgaccaggacgacgtcaccgccggcagcagcgagccgctggacaggaggaactggaaattgacgaggttgaggtgatctgattgattgatcgaggtaacaccaactgggactaaagatcatttagggccgatagagttttaaaccgagaaaaaaatcatctatagtcccggtttctattcaaaccggaaatattgtggtttttagccaaccaagcaaagatggtttctccaataatgcataagcaaacatattattgcatgcgattaagacatacaaattgttggtatagctagcattttgtttgtgttaatttatacttgattagtgtagtaagcaattgattaatggtggagtcgggagggagaaatcaagtgagttttaattaatgttctaggcctgcaaagttttgtttgattgcaagatatgtttttcggtatttctcttgactttcattgttcgaaagatgcctgggctagcgttgttgtcactcctctattccgaatacctaggccgagtttattttcaaaatatttcttcaaacttctaacttttttatcacattaaaacttttctacacacaaacttccaacttttccgtcatatcgttctaattttaaacaaacttttaattttagcgtgaactaaacacacccttatttccggttttaaacgggctagatgaactttgaccgttactttttcccaccaacgtcaaattgaatatgttgaaatgtatggtgttatattaaagcacattcggtttattaaatccgattgtatacaactctattatctaataatattttaaaatattattggtcaaattcttaacaactcaaagttaaaactgataattattttaaaattgaaggagtattaatttgttatgtaattgttcagctaagatgtttattaatcgtctgtcccgtttaagttacaagaatttttagagaaaataaaccatttacttgaaaatgttcgattctgttaaattaaaattacaaagtgacaattgaatattacaagcgaaataaacgttaaacaattacaaggaggtaattaatccttgagctaaaaaaatacaatgggaaacgggcttctacggttacatcctcacacacaactcaactaggatataaatcttagttctctgaacacaccattttctcctttgaaatcatttttcttcaaaggagttgttggtagtaaggttgagtttaaatcaacttcctggttgggctattaccttgttttccataaccatgcttctcgatctactaaagatacttcattcgttgtgcaattacctttttttttatgtttcataatatagggtaagcatgcaactagcacctcctcatctaaattcgttttttagtccttcttcctcaagatttctaatatcattgggtgcatgcattatatgatccaaatatgaagatgataaaattattttttggtatttgtgttagtggtaattgtgccttatattttagaatagattttttaaaaaaaatattacagaaatttcttttaaaaaatcaaataaatctattttaaattttgtaatagttacttcattcatccaaatatatagcactatatgactagatggaatatatccttgtaataggatgtgtcctatccagtcataggttgctatatattgggacggcgtgagtaatactcaattaaccgtgcgttaattgttgttcccgttttgcctgttgcgaaaaaatattgtaattcagctatatcgaacaaaggccttaaggatgagtacatagaataataagatagtaaagccccatagggctccatttttgtctttcttttttgctccttggtagttgtgccatgtagtttgcaggtgcggaacctcctcgattgggtgacatgatttttttttgtctggtttcccacactggttgtgtcggtctcgccttgcatgtgcgccatgcacaccctgatcattttgtttctcgagtaaatgacgcatggtggtgtttatgaaaaaaaaactcattgtgtttgaacggaatagcggtgcacgtcctcccaccgactgacacccgttgcgtcttatacggaaaacccctcatctttctcagaaatacaacactgagaagggaaaattctgcttctagaggttgctctataaacataaaaaacacaagggtttttccgaaaaacaaccgcatttatcccctcttcttctccccacggcacgagagcgccgccatccgtcccctacggcatgggcgccgcgtgcattggagccaacgtcggcgctctccctacccccccccccccccctctccgccttccggcaattgggcctacggcagcggcggacctggcggcgagcgccagccgaacacaggcacccccgccgcacaggcaccggcaccatggcaacctttaccccacgccgcacggagtcggcggcagcagtgtggtttcggcgcgaaggagctagtagtactcaaaaagccacgcacggatatggaaaagagcataagagctcgtgtagtgtttatactgcaattttggacctatcactgaatgttattagcccgtgggctttttcacatccgacatactacggcccattagcagtttagcactcgtttatatcattttgcacttactgactgttgcaaaagcccacaaagatctaatcatttttcacttaaccaacggaacaggtgataagctttcttatttatatcatcatatatactactcctactcctatactggtactactatatcgatcgactgcatgctactacacatacgcaagcgtgttaaagatagagctcgtcagcaacaatacagtgatacactgcacatgtaccggttctcagtacttaattagtccaaaaaggcttgaaaaagagcacactaaaccttttgtagctaggataattaaaactggctgggtggcccgcgcaattatgcggctagcaccgatataaaattatctattttttaatatagttttacttagaattttgttaatagatatctcgttgtactttgaaaaaccaaaccttatcatccctgtgtttctaattttatatttttttaaagttatgtcagttgctactcctaaatattttgtcacccctcatttatttgcttcctcgatctaccactacttctatttgttctccctaaaacctctaaaaattagaccttatagtttttagagtttattgtctcgtttgggttttgtttttataatttttagaagtctcgtcaaatgcagccaccatactactctacggtcaatccactacctcttctctttattttcattgggatttaaaaatcaaacgtaattaccatttaggtttttttttactttctagaagttccaccaaactgtcagggactttaccactgtactcatgtacagctcacccgctgccccctctttattgtctccgagattttaaaattcaaacatgattatcattggggtttgtttttatttttactttttagaaatcccgccaaccgtcgtaaccatgctgcttaatgacacgtccatcgtccctccttttaatcatcattgggattctatttggggttttgtttatagtttttagatattccatcaaccgccaccactttaatcctttacatacatgttgattatcctatatttgttgtcatttgtcatctttttataatttttagaagttatgtcaaaccctgtcaccatacttctcttcggtctgtccactacctcttctctttattgtcattaggattttaaaaatcgaacatatttattattttggttcatattttagtttctataagtcccgccaaccgccatgactgggctgcttaacggcccatccgtcgtctctccttttaatcgtcattgggattctatttgaggttttgttattagtttttagatgtcctatcaaccgccaccattctacttctttataaacctgttgcttctcctctttattgttatttgtcatcatttgtgttctagatggagtttttttagaagtccatatttttcattccgatatttttatttataaattatatttctacttgaactcttataattatttttatatttacagaatttattattttgttattacaaattttagttaatctcgtcatatgttctagatggtctcttatttcaatagtttttactttttatgtcgaatttaagttatttataaactgtattcctagttgaactattatttttctttttctatttttggaatttattttaatttttatttagaattttagttaatatcgtattatgtcttatatgaattatttttttaatgtttttttattttcaattttatagttgtttcatcctactcgaactatcttttttatttatccaatttcagattttattttatttttattccgaattttagttaatctcgtattggattcttatatggactcttcatttaatattccttatttttaattccgaattccagttatttctagattttattcctatatggactcttctttttccaatttctgattttattttatttttattctgaattttaattaatcgcgtattggattcttatacgaactcttctttcaatattgcttatttgtaattccgaatttcagctatttttaaattatatttctacttggactcttattttctttttctccgattaatgtgggaatttctagcccccacagcgaacgtggtgctcgtcagcaacaatacagtgatacactgcacatgtaccggttctcagtacttaattagtccaaaaaggcttgaaaaagagcacactaaaccttttgtagctaggataattaagatgctatactatacccaaacaacaataataggaggcaggcagcgagagatcgatcgatcgagacgacgtcacggcaaatgtgtgcgacaggttcccgtcgtgatcaccgaattgggacccacatcgcaagttataataattaagatatgagactaaaccggccggccgactcactcgatcaaccgataatatgatcatctctctcgatcgctttttacgtgctatactttcggtgtcaacgattggagatatcgattcctccgtcgcgtctctgtcaatcgtagtactactgtgtactagtagtagctcttatagcaactagccgtaattgattttttttggccctgtttagtttaaaaaactttttaaaaaacatcacatcgaatctttagatatatgtatgaagtattaaatatagataaaaagaaaaactaattatacagtttacatgtaaatcgcgagacgaatcttttgaatctaattagtccatgattagccataagtactacagtaacccacatatactaatgattgcttaattaggttcaaaagattcgtctcgcggtttccagacgagttatgaaattagtttttttttattcgtgtgcgaaaactccttcagacattcagtcaaacgtttgacgtgacacctataaattttcatttcaccaactaataaacaggccttgttgatggtgtgcaaatactactatctgtctcgtctcgatcttgatttgtttctgctgtctctgtggcttgacttgctttctcggaagtaggcaggatacggccggctgctggagtggccacgatcgattcgttaatgcactcgttcttttctactgtagctactaccttcatcataaaatataatacctccatttcaaaatataaaaaactacgaatggtatatttccatattcgtaatattagaaattatctgattttatattcttatatttttgagacgaagtgagtagttaagatatagtagtagattttatctcgatttcgttagcgcgtttttaagctagcaagcagcattttttataaaaaaaattctatgcagtactatattaaataaatttatttttaagtttataataattaaatcttaattaatggtttttagttttacatgccttgattttatattcatcttaatttatcttaaacaccacctaaatggccaaaacgcggagctctaggttaattagcctgatgactgagttataatggatgagagcaagagaaatctctctgccgattgacgcaactgctgtggaccaagtagagtttgttgcctgcatctgcgtgttccttgtgcaggatatgtgttgtcttgtaaagtttctgtcatgcatgaagcgtcatgtcagggatggattgtgtctcccaggccggccccggcccagctcagctaacaagggtttcgcaacagacgagtactaattaatctgatccacgcatgagcacggtaaacgtggcaagctatataccacagatacttcgtctaattggtttctcgaccaactagcggattttctccccgctttgtttttaaaacttcaaaattatgttgatattcagctctaattagcttatgttttcacaaatatcaaaatcgtctagtgcaagtatatgtttatctcttcttaattctccagttaatttggttaatgttttcgccccctcttattttctacctctcttgtagcacataaatagagagatttcttttcttcaaaacaagattgattgtattgaatatgattaaaaacaacctaatattacattatagacaaaagtatatatagtatgcatgcactatattctcggagagtactcgtgaactatgctagctatatgcacacacagcaagaggaacactcgaataactaatgatcattcataccacttcagtggaaacaagaaagtgcatacggaaaagggctaacaaattaaagtagagagacgcacgtaaccaacaaacagtgttatttcttgtacaagcaaaaataacggtacgagaagtagtatatttcttgtacatggcatgcaggcgtacgtgtgcacgtacgtcctcccaatctcagttcgttgttcgagcagctggtagctttttccttcccagctttccgatgaatggaatggaatgggaatggaattgtgtgtggcgacaacgttgttgtttgatgcagagagatcccctcctcctccgtggagacatggccatgttattgttatggaaccctacccatgtactactagcagcattagtactgtttccgctttataaaaaggacacacgctgctagggccaaaaaatcaattccctctctacactatacgcgcagtgcacctacgctaaaaccactgttcacgtgcaatgcaaagcgtctcgcatcggcatcgcatcgctttttcccgcgcgcggcgccgcacgtacggcacgtgaaaaacagcggcacgcagcagcagcagtcgtcgtcgttacagttgcaggaggagtagtagtacgtgtccgcgtcgcggtggcgtgtcgtggtggacgtcgcgcgggacggcggcgtccgttgctttcaccgtaaatccgggcacacgtcccgacggctgctggtggtggtgttgctgcactgcagccgcggccgcgcacgccgcacgtacgtacgcactgtgcgcgcgacgacgcacgtatgttgggcccgtgagagcgagcgaagccgagaggccgagaggccgagaggagatcagccgcgacgagggcgacggcgcgcgctgcgtctccgtgtccgcggggcgcgcgcatcccggcatggccgcggacgacgggacgtggggggcgagggagaggagggcccacagacaggaagagaccggggggacgtggcacagcgggggaggcaagggaagcgggtcaactcggctcgcgcgggtacgtggagtacaggggcaggcgcagcagcgggcgcacggctcgaggagcacacacagcagcagcagcaggcagaggcagcggcaggcaggcttcgcttcattattggggcccggactttctcggcaggcaggcactgcagcggcgcccttcggatcctgttcccaactttttctgcgtcgatctcttccccctcctccccctccttcaatgcactgccgctgcatgcctttgcctttgcccttgctggtcctggaaaagaacaactctctcttctctctgtaaaaaaaaaaaacccacacactcttgttgccttgcaccaccacgtccctcccactacgtacatgacgctctccacagtgcttgcctcccgttacggtaacacggtactagtaacacgctgccttgccacaattcaccgaacaaaccggaacttcattgtggtaacattttttttgtgtgtgtgtatggagtagtatgggtgtaaaagccctgagcagtctgggggctctgcatgcactgcaccggccttcgcctactccggtctctgactcgagaatgaagtttggtctggttctggttcagatcggagacgatagagtaggaaataaataatggagttcccctctctgacgacggacgtaacgtactacgtgcatgctcaggccggcgaaaccttcaatgccaccatcgatcaaacgatcaacgcttgtcgtttcgatgagtgtgtgcgcagtgtacgtcgtgccgatcctgttctcgatcgggatccccattaaacgatcccatgggcgatcggtgctacagtgatccggggtccagcacagtgttcagaaaaccggtcaggatcggcacgcgcagtgaatggctcagtggcccccctctttatacgctactgctactccaagcattttgctaaaatggcaggggggcttgaatctcctcccatctccctccatcctgctgctgcatgccaacatccgggccaatctcggatctctacagaaacaaccgcagctttggtggggaatgagggtgaaattcgaccatcctgcatgtgtgctagatctcacaaggttagctgccaagtgttctcaaactgcggttgtcaaatgtcaaactacaagaaactaaattagccctgacaactaattgattagtactatatgagatattttcagttgctaatcgtgagtgtcaagtggttgattagttgatgaggttctttcggttgcttttcatgattggtttgattgtagattttcaactactgtattcgtcccaaaataaagatttttccctcttatactattgcatggataaataactcttatatttgatatacgtgtaatataatcaaattcatattatcgatttaatgggattaagttagaaatgcattcgtaaatcgaatgacttagcaagatggctcactatgaaaaagccaaagtggttttattcataattagcttattgagttgatatcattatacaagtgagtgaacgtactaacaaatctagctataggaaaaaaacattatgttaagcagaaaaacatatcttactaccgatataaaaatagaagttgatattagtattagatttgaaaaattaaataataaataaataccccatgaaaagtgtgcgaagggatacatgatgaagctccgggcctgtttagcacagctccagcaccaactccacctcttttagagctggagctcagccaaacagtttcagtttcaccaaaaatgggagcgaaactgggtgcagctctatcacaaaatgaactagagaggtggtgctgggtttaggcagatccacaactatatccactgtagatccaactccttgagctaaatttggagttggagctctaccaaaaagacctttcataagggcaagtacaataacaataaatcaccgtctaatactcccccttcccaaattgatcatcatatatatttatgcaccaagaccaaggataatttaaattgtatcaatcgagacaccatgcacacattctcccacaaggcatgcatcaattaaaaacaccatgccaattacaccttagcatgcacactttctccaatgttgcattagttgtattctgatgaaatctgtgtccatgtggttatatgatgatcaatttgaaaaattttgaattccattatatcatgatcaatttaagaaggagggagcagtaagcttacattggattttatacctagctggcggagagagagtactatgagagagatacgtcattggtccaatgctcctatcgttggcttagcgccttcatatatatcgacggttccgtcgactgaaaaagaaattagtgtgaatgggtttggctgattggcttggatgaaagagaaaagcgggaaagtggtgagagaaaaaataattaagcgatgatgatataaatgttgcgctagatgtgaagagacaagcattgtacttatcatatgttaagttgtttctaaatgacgtgtacatggattatagtaagcagtcggctcctctattgcccttgccctaagatatgtattcatggtgcaccggtggaaggttttattgttttgtatactgaagatcaccattggtgataggtcataaccccaaatgatgacttgaatctatctttctaggcattcaaccaaacagtgagacataaagataacccatttgtttaataaacaagcaaccaactagcgtgaaaataatcctaacatatacttaaatttagattttatggagcgtaacaaatcgatgttgataaaaattagtggcaccgatttaaaaataacgatcagtaataaaactacattttgacttatgatatatattactgcgtggtaagaattctatgattatatatctatataatatttcactccaatgtctcacggtggttttttcaccgtagagtagccccaacgaggatggtcctgtagtgtgtacccagcgtatgtgcccccatgggaaaatgacagagtgccactccggcgtgtagtttgcggtcaccactcaccaactgctgtcactcgcacgtccagtacagtacactgctagctagttgcccttaattatctccctgtcacgggggcatgcaatcaatcagctgcttaattaaaggcagatgatcgaaacacagctgagagaccctttaattgggccccccctttccgttaaagaaaataaaaagcagcagaaaactgccttgtcaacgatccacagacagacagacacacacacagagcacagaacctgtcttaacagtatctatatatgctaaataatccggttgatttgtcccactgaaacgtgcatatatacgatagatacgatacctcccggtctattccttctcccctgcaaaccggggtttggactggaccactcgatcgccactgcactgtcaatcgatccatcacaccactgtttcctgctaattaatccaatcgaccccaacacgacatggatttcagctacgtcacgcgtaatatatccccactcctgcattggcttggtatctcactatatatatctcctttaattcgcacgattaaccgagacgtgatgtgatgaccgagtacaataagtgggtgttttgcacggtggatgacggtgaaatcgagcgttttgggtgggggaaacatcagaaaacccgcgcgaaacagggggagatggggggagccgcgcgcggatgaccgtggagtaaagaaaagagcaagctcccgtgttctccggtgtttgactgctactcaggccggcgcgcgccgctccgtgccgcgtcgtcgcacacgaacgatccggcggtgtcggtgacaacgattcgagatgaattgacatgttgagactgaaccagacacactgtcaactaaacaaatcttcttcttcctttccaggatcttttctgcgatcgaagacgcgtatacgtatgggcgtggctagcttggctggctttgaatattactacgcactgactatggcgttggaagggaggcatggaataactgaattctggagcacgccaacatatgctctctcgctgcatgcatacggcgcgggcaattaactccaccccggggtcgcatgctgcatgcagctagtagcagtgcagtacagtacagtacagtacattccaaccagctaactgtattcagaacgagagagagagagagagagaggggtgaggcagccggcaactgtaccctgccttttcccctcgactctctttctctctctcgcagcagcagcagcagccgcgttgccgtgtgcgcgtgttggtggctggctacctctccaactcacgcgcacacacacacatctcttttcctctcggtgcgatacgaagcgagagcgagagagagagagagaggaggcaaaggcaataaatggaagcttaggtgagcgcaggctccatggcggcgtggcagggcctctctgtcgcctcaccgtcttaactcgcggcagcgcagcgagctgagctgagctgatccggccgccgcggattaactcctcctggccgcgcgtgctagctactagctagtggtctacacgatcgagagagaggtttcggtttcttgatcggttcttgatctgctgctgctgcttcgtggtcgtcgtcttcttcttcttcttcttcttcttcttcttcttccctagccgggggtacgtacggccgcctatggatttgggcgcatggcggggttccctctaggcggaggaagccacagccgagacaacccggcgccgcccgtcccgccggtgcaccccgccgacgccgcctcgttcctgtacgccacgaggggcgggagcttccagctatggcagcagcaggagcagcagccgttctacgcctccaacatcatccgcttcgccgatgacgcgcccccggcgccgtcgttggcgggggcgtcgtcctcgtcctcgtcgcgcgggatgcggtcgagcggcggcgggggcggtggcggcggcggcggcatcagctgccaggactgcggcaaccaggccaagaaggactgcacccacatgcgctgccgcacctgctgcaagagccggggcttcgcctgcgccacccacgtcaagtccacctgggtccccgccgccaagcgccgcgagcgccagcagcagctcgccgcgctcgccgcctccgccgccgccaccgccggcggcgccggcccatctcgcgaccccaccaaacgcccccgcgcgcgtccctccgccaccaccccgacgacctcctcaggtatatactagagcttagcttagccatggcgcgcgcgctgtatctaaccgcgttgatcgatctgctgggtgtgcaggagatcagcagatggtgacggtggcggagaggttcccgcgggaggtgagctcggaggcggtgttccggtgcgtgcggctggggccggtcgaccaggccgaggcggaggtcgcgtaccagacggccgtcagcatcggcggccacgtgttcaagggcatcctgcacgacgtcggccccgaagccctggcggtcgccggcggcggcggcgccagcgagtaccacttccgcctcaccggcgacgggtcctcgccgagcaccgccgcggccggcgaggcaggctccggcggcggcggcaacatcatcgtgtcatcggctgtggtgatggacccgtacccgacgcccgggccctacggcgcgttccccgccggcacgccattcttccacggccacccgcggccgtgaccggcgcccactccggtcgccggccggccgtccggccaacgtcgccgccatgctgtaacgccactacaatctctcactcgctgcaactgtcaattgctttggtcgatctcgatctcttgagaattcttagcttctgatctccctttgatatctcgttgcataaattgatgtgtcttcttctagagcctagcttagcttaaattaggcaggcgaaccctttagactcttgtttgcttctcttcttgggagccatttgatatgagcaattaatacactcgtttcctagcaagaatgattggaagcttcccaacagttaggagcttgggggaaagcaccctctctctttagcttaagcttagcttgatgatttccaccgtgcactgttcatcttcttccatcattcctgctgcttgattgaattgatactagtaattcttggtattggtgtactatactccatgtagaataaggctaataaggtttctttgcttttactactccatgttgtactccatgtagtatgtgagtactaacaccatgaagtatatgtgagatgtgagtactactagcttccataaggttgacaccttcgctttactatagcatgcacctttgctctcttgaaaagctgagccctagaaacctagttggctttaattggtagctcgtggatcctagatatcgcatcgtcttaagttaattggggtgtttgcgtttgtttatgcctgtgattatattactactagctagttgtagatgagagagagagagagagagagagagattcagtcatcgtatgctcatgggagagagagacaaagtgagtgagtgagagaggagacaaacgaaaggagcaaatgatcatctatctggtcgggagccgtgaccgatcgagccatgcgccgatcccttgcttgatttcgtgatgggttttttattgtttccgagttttacaattgcaaggggggtgagatgatgactcgcacattctcgtgttcttcatccgatcgatctctgacatatgaacattgtctcgttgatcccatcacatcaggcagcgaatatatatttgtttggccttttgtccatcatcctaggttgctagcgtacattgcctgggtttggtaactattgttgcacagggaattaacctattcaggcatgactttttttacactactttagcaaggaatgtactgctcttctgtttttaacaagaaataatattcaatttcatgcttcatctcacaatgccgataattaatgtctactttcaaaaaacaatatatatagttgaggtggtaaaatactacccggttattctattgtttgtggtcaaataaatcacataatataacttgtataaatttttaatgggcttccagcttgtttgtttttgtacatgtgatgttattggtttttcctgaagtatatgtaggaatccataacaaagctttgcaaaattttagaaatatcacatggtaaatatatatgacatgtttaggtaatatatgtaaacttttcttctactgcctattaatcatcttcatttatgttttctttttgcaatcagtggtggtgacatgatatttaatagtaatgtgtttgattctgtattgttagctagtactgaatggttatttatagcttgtcatactgaatatatatcatcacttcgcaaagcacattgtacatgtatttatgtggcaaagatacacaagtagttaagctcattcactgaaacactagtaaaaataaaaacttactactagttttttttgaaaccgtaaaacttactactagtggtgctcgtctagattcatagtcagattttttatttttttggacggagagtgtaaggtgtagacttcatttcggctcacattaagtctcctgtacgttattagactaatctggttagtagtgtatatatatacatatatatgttcgattcatgtgtagtatgtctaaaaaacacatgatcagagtaatctgattagtagtagtagttctcctttgcgtttatgctgtaattcatccaaaaattaatggcccatatatctagaatatataatacctatttgccagctatatatatatatatgcaattttaaagctcatttgtcaaatacaatatgctgaactatattgattttttatgtcttcgacagttgccggttgcttacaccagtactagtatatgttcccattgcatcattttacggcggtgtatctgttagtccatttgagattcttgcgtgctccacaaagaaagcaacctgggctgtcattctaatccgcttctagctttatgctactgtgtcaatgagaagattctgccaaacagaaatgattgcatgcattttcatatatagtatattattcgttctcgacgcttataaattaaattaaggttgttaatcaatatctctatttgtcgttgaatgcatgtgcatcctggtaagtgcctcttcgaacactgggaattttatgctataatttacacattgctagttttatataggactatttgagttcagtgtgagggatactctttagacaagattatgggcggaaattacaattaattaattaattcttagacaattataaattcttgctttggcattgacaactggttctgctttcaccttgcaaactttttacccctagacaattaaaagtaattactgccacacgtttgtacgtgctaatgtctaaaattgttactccattccaaaatatagtaatttaattagaatgaaattagacctatcctattgctactactatgaatcaggatatagtattatgattggtttaatcgatcacatcctagattactatattttttattactatattttttaaacggaattatttggaccttggtagattactatagttgtgtgctggtcgcataatttcctgctcctacgttgtttgttcatttcaacttattttttcacgggcgcatatagtgtgcttggagggcttcttttatgcggttaataagctcaagacgtgtgaccgatgtagcgtgagactgaatttcttttcttagttccattcttttcaactagtttgtcggatctttgccatggaatatccgctcaactcatctaaaaatacattttttttaaaaaaataacttttctaccacattatattgttcataccacatgttctaagctactagatttatctaagtagatcatccgtggcaataatccaataagcagtatgtctgttttgaaattaagttgtaaatttcaaaattagttgcaacttaaacaatctaccaccaccaccaataaccaggatcctgatctctcttatgaacgtgaaagtgggcaaggagcatctcgtactccctagctagctatagctatcgtaagacaaatctttgctttgggcaaatatatcctcggttatgattaataactaaaaatatgctctggatgatctcttggcaccagagaccggctgcatcttgatctcacaattaactcctcagtctctttcggaacaaattcgcgtctcagttcatttaacactcaccgatcacggctcgctcccgatcccaatggaccactgcttgcggccggctgcagagattagattgatcgtaacatgcaaaacttgtgagaaggcaccaaccacaatgtgtgtgtgcccataattagggcatgccaagtctaccactgtacaatgtgtacaccaactctagctagctgcctctaggttgatctcttgaccggccagtcgaatatgaatggataggagaggatacactcagcgttcaccaaactatggttccctatggttatcacggttaccacgagttatactatggtttttaaaaattgagaaagttaccgtacatgataaccacgataaccgcatggttttgtataccctggatactctatgcctaaaaagtgttactgatagagtaattctcagttcataatggttgatcccactcagtttttctctttttcgcaattgttttttactcttggaaatatttacacgtggttgactattatgcaagagtagctcgatagtctgctagcttatgagaatctagactatctggaagagttggagatttagaatatagctgacagaagctccccgaacaaggtttaaactgcagctgccactcatttaattcatacttctctagtcgtttgttgtgtgccactataagatgagctaggattattttgaataggaacttcgaatgattagaacttctacaaattcgaaaggtgtcctaaggcctgcccataaaacatgggtttgtttcaatattcttgaggaaattgaattgtccctataaattccatgtgattaggacattgcattccatgttaattaatcctatatgttggactacctaggacaaaaggttttcttccctatttgagaggcatatagctcctcgtcgcttgggaaatatctctctttaaagagaagtaccaaaactaattccagaagtaactaggattaaaatttcaccacgcagtatctatacctgagttttcatgatccaagaggcgtagttttttttattgttaattaggagatactctctttattccataaaaaaacaaatctagtattagatgtgacacataacctatgtccagattcattacactagaatatgtcacatccagtactagattcatttttattgtgacagagggagtttagcctacgagatatctaacttttcaagggtcagaaaaaatttgtttaagttatttcaatcaatttattttttttacctctaaagctgtggtgagatatagaacagttgggaacttggaatccttggtattcctggatgagaagttagccgcgagccaatgaatctgaagcgaaagaaaacaaggaaatgtgacgattgcgtggtgatggatgcaagcacctgcagctatcttggtgactgaaagtggggcctgggacaaagtggtcagtgtgagaggacaaaagaacagtatctgcttgtcacctttttatttgctctagtggtctctcaatggaaggatgggatgaaaactctttgcaaatgattacactcatggttgatacactgctgagggaataggaaaaatatgagacatgacagattctaaagcaaatgtgcatggtagtcctgcttgccctctcttcagtcatcaccttcttttccttggccatagaagcagctgatagctacaagtggtgcctccttttgttttctttctcctcacatggactagtaacaacaccgcgttactctctccgtctcgaaataagttcacttctatacatgaatatgaacatagccgagacagtaataagcttaatagtcatacacacactcacacaccagtagtacccttgttccaagatagaaaatcattgtcaacacatggaggatagcacatgaaaaagcagtgtactaccctccttttctgccctagccatagtgttcactactgttccccacccatctctctctctcccctctgtgccgttaatgttcttgctctcatgataactgtgaaatgaaaatcacaaggaaaaaagggaggagagagagagagagagagagaaagaaaaaacttgtctcatggatggatggtgcaggctaagagttgtagggctcttcatggggaatccttagagtggggaagacgagagagaggaggcaatggtcccatgaagtacgtgcatcgagttgttggcgttggcgcgcgcgcgcgaggtagagatgagcgggtcacgtgctgctcatccactgcaaaaaatgccaaattcttcagaaccgttagccctgatcttgatccagcttgtgggaatcactgtgcatgagctatctcacttgcccaagataatcacagtctcacacagcttctaaaacagcatggactctgacacaaagaaagttagtattaactgaaggcgaaatagacgcaacgcaatagattcgattacccaaggcacggaaccaattgtacctaacttaaaccgacttatagaatcagtatcgggagtgggtatataaagaatcgagaatacagaaaacattgtagtctaacattaacgaccttggtcgagctaagccgagccatgtacgtagtgtattgtacttggagtttaggagcttaacagttgacactgcatgtctgaacttttctgaactgttgcaaatagtacttgcgccacacagtttcaaaacaatgttcatgtttcaactcgatcctaccagatctctttgcaagcagtagtacagaagtttggtgagagtccacatggctaacaccgtctagccctagctaactacggacgtatagattcagagacatggggaaaaaaattcagacagcttgctgctatacctagcctggtccagcgacggcaaacggcccaattaagctctgcaagaagcgagattgatggatgaacaataattaatggctgcttcttgtgcctgccatgcctcacacgtcacggatcagacgaacatcaacatggacactactagctggtggtaattcctttggatggaaggaaaagatgctaatgatcagatgaactctcatgatcctccaatgcagaaagggcccagccaatgcatgcacacatgatgaattcttgcagcatttagaatgtctgatcatggcataaaccacagcaattgcacatttgtactgcaatccagcagaactgttcatcctgctagatacaaaaaaaaaagagtggcaattggggggccaatcatctttatgcagcagcaggagcaattccttttctctgtgtatgagctagatagagcatctatccactttctgaacactcttttcccctggctgtgcatgagaggaagaaagaaaagagagaaatcaaaaggttggtttggcttagctaggtcttagggatcctttaatttgttctttgcttccacacaaaaagctccattggttagcttggtctctctcaccctgtgcaaacttttcttcccatttatatgcgacccagagattgctagcccactttgctccatggctcgcccaagatcgcccgtatctttagggctcgagggctccattgctagccacttcatccagtgtagcaaaagccatggctaagcttagcttcttctctctcgatctttacccacgtctcgctgttgcctttgttttgacagaaaggagagcaaagctgatgtctccctgatgatttgatccgaagaagaagctctgaatgatacggatttactatatacacgtaccaaacgcctagtacgcgatatcatgcatgcatgatgcaaacaccaactaggtagctttccccatgcaactcagctcagttagctcgagctcgccttcccgggaatccatggccgcttttgcatgctaccggagacaagccctcgtttttaagtccacgtcacctttgcttttgcttctgcaggttgttgccttgtgaactccaaagaagaagaagggaaaaaaaaagttgatctgtccatgaagagaccttacctgttgttggactagcacagtaacacatctgaaactctgaattctgaatcatgtgaactctgaatttcacttgtcgatattatctcacagaacaaaatttgcgaggattatttagctgttctgttcaggcataggggagtatacatgtacagttaaagagttgacctgaattaagggggggaaatgactaggtgatggacctgtcctggctattgtttctgtcagttgttagctaggatggagccggcaagctcctgcattgagttaactttcgatcacatcgatccctttcctcaggccaaatcgtacaagaagaatttattcgatgggccttttgctctgtacatatagctggaatataatcctccttaccctttaatcccatgcaactactctttctacgttgccacttcttccatctgaatcaaacctatatctgatagcaatagcatgttctttctttcttcctatcttcagagttcaggctgttgtacttaatttgtgggttaattcagctcttggataattacaggattacgaaatgatccacacattgaccatgttctccaagctagataggaaagaatcatggcaccatgttctgatggcctgagttgtgacatcagggatgatcatgatgtggagcagatacgcctggagagtaagtgccaaacagccttggtacaaaagcttggagctaaaggaaagcgaagagaaggggataaatatactactcatggtgtcgccctatgatcgattattccaagcttttgcctctccctccccttgcatatgat

SEQ ID NO: 67491 - DNA, 1045 bp, Oryza sativa
gtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcagttttttttactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggatacc

SEQ ID NO: 67492 - DNA, 8881 bp, Oryza sativa
ttgaggacattgaatacagaatacagcttgagtacattagttggatttgttacaaaaactactacgtttgttttttaatacataatatagttgacttttaattgttcgtcttattaaaaatttagtgtaaatatataaaatataagttaagattagagttcgtttatgataaaattaacaactcacggatacaacaaacgagatgtatataattttttaataagataaatagttaattgtcacgataaaagttaataacgttgtacattaaagttttttaatgtagtattaactaattacgtaagaggattggtacatcataaacaggtatacatatagtaaaaaaacgaatggagtattaattaccactgcatgccacttattcaaaacatatagtacttgccttagataagagatcgggagtacaaccaagcacacacatgaacacatgtggcgtgcggtagctatatgttatacatgcatgattgattgatatctatcagaactggtagacgacgcccttgttcttctcctcctggtcccgatccttggtctcctccttgccgatcaacctcaccaccttgtccgccgccttctccccggttgccgcctcgtacttcttttcctgcatgcatatgcacaatactaagttagagcaagaacagtagacagtttaagccgatggtaatgcatgcgtgcaagaagaagtgatgagctagaagaggaataagtggagagagtatatgcgtcggtgattaatttgccgccggctccaaacacatccctaggtgagacggacaacaccagccagtatagaaacatggttgtgaggtccatgtgagagcatatgtgtgtgaaagctaaattagaaaaatatagatcaatctattggagttcatgccaatagccaactgctatatatacggtctcttgatcacctccaatctgatgtggcgcttttaatcgtcggcaggttgtatacactattaaacctgctcttattataatacttcatttgttttataatatatatagtaatcatttgttctataatatatatagtaatctatagcggggataagacactacatatgtaacgaatctggcaccaccaattccatccaaattcgatgcactatatatgtatatttcaatcttagactgttatattataaaacggagagattactatacaattactttcctactaagtagcactaaatatttctctctctcttttcataggcttccaacagggatgggggcaggcctagggcagggcctaagccctagcgctgccttcaaaaacatacttaaattttattaattcaccgtgtaaatttttttagaaaattaatacttcattagttgagccctatcttggagctagtttttacctccgccactagcttccaagtcgtcatcaaataaataactaagaaccgttagactcgtattgatctaaaacacacaaccgttcgatttcatacactcctagctccaccggcccaccggctcaattcaccgaccttttatttatggaaacgaattgattatatatagttcccaaacagggcagctcacatgtatgatttgttctgtgattaatataatttgatttaaagatttagtacaaatgttatatgtgtgaggcgtccatcagttcaggattggtcatcatatttgttcaatctaggtgcataacacaaaaccgcatatcactgaaattacgcaatactaaaatttatccacacccaccttgttattattcagcactgtaatttcaattgacaatgattttgtatcatctctgtagagcttaattagtttgctagctgttagctttctgcttgatgaatcccgttgtctttccataatccatagcaataacgtggggtatggtatcatctactagcagctagttgaattaagtgaaacattagactctgatcgcatatttaattagctggagtagtaatttactccctctatcccaaaataagtgcagttttgcactgtttatatttaacgtttgaccgttcattttatttgaaatttttttatgattagtatttttattgttattactccatccgtttcacaatgtaagtcattctagcatttcccacatgtatactgatgttaatgaattaattaacatcagtatgaatgtagaaaatgttataataatttacattgcgaaacggaggaagtagatgataaaacatgagtagtactttatatgtgactaattatttttagttttttcataaatttttcaaataagacggatggtcaaacattaaacatggatattcatgactgtatttattttgggacggaggtagcagctgatagtagtagtagtagtagagtggtacgtacgaaataggccgttccagcctgagcgacggcgccaaagttgacgtactccaccaagtcgtcgtctatgcggatgtggccgtgctgcttcgccgcctctttcccgttcgtcttgccggtgtccaccgccgccgcctgctcctcgtcgaccttcttctgctggggcaggtactcgtccatggctagctcgatcgatctaattattatcaggatgctatagcaaagttttggaagaagaagaagctagctgctaccttattatataggctcggtgattgggacggagagagtatttaaaaacatgtgtaatcataccccatcaactgcgtgccctactccatcacatcatacgtcccatctaaatctggtttaggtcccaactttttcttcaaatttttaatttttctatcacatcaaaacttttctacacacacaaactttcaacttttccgttacatcgttttaatctcaatcaaacttccaatttttgtgcaaactaaactcgccttagccctgtttatattccaacttttttttcttcaaacttttaacttttctgttatatcgaactttcctacacacacaaactttcaatttttccgtcacattattctaatttcttcaaacttccaattttgacgtggaactaaacacagccttaatttggtttgtacgagtaaagtaatattacctttgtttcataaaaaactaatctatattgacacatcctaatactacgaatgtaacgagattcatagtattaagatgtgtcaacatctactactagattgatttttttacggagtagtactcccttcgttaaagtgtgtgtttttcactcttttaccgtactaatacaaacaaaaatattcttactttatcagattttaatataattatttcttcttttatttattttaagtgtatttatctttacttttataaacttgggtacaatgatgatggttaaaaataaatttattttagaagagaccgaacgaggaaaaaaaatggagtaacatatattgggtgatggcgacgttgcaccagctccgggcggtcactacgtggccatcgacgaaccacagaaacgcaatcaagaccgatcatcgataaattcatataccatggattaaataagagtgttgttgtttcgacatacaaatcctcatcgataagaataatttacaaataacactcaaaagcaactactctaaagctagctattttcagagggagttgttacttttatattttttcttaaaagaaacttcaaacgatagcagatttgctggatatgttaggaggaataaaaacataaagtcttacagagatcttttgagaaaggaacacatctaaacaatcaaagtgattagacttagatcaaatcaggtcagtggatcgactatctgtcggcaatcttccccaagtcgagccgactacaaggttgaagcgaaactgccctttcctctcccacggccgaaactttcctctccccatatctagatccgccctgccatcgccagagctgaccggcggtctacgcggcggataggatggcagcggcggggagacagacagcggagaagttgcggtggcggtcggacggccagactcgtgcctggccgcgtgggttggcggcggcaacggaggtggccgggcgggtagcggtgaagcggcggtgttcctccgggcggtggtgggaaggcgggcggcggaggcgctgcggtggcagtcggaggtggccggactcgtgcttggctgcgagtgttgacggtggcaacggatgtgcccgggcgggtagcggcgaggcggcggcgtccctgcgggaagcggaggtgttgtggtggcggtcggaggcggtcgaactcattagccgcacaagctagcgatgacagtaaaggtggtcgggcacgtagcggcgagacgaaggcagcgacatctcttcggacggtggcagcctgagcgttgacggcatgtcctcaggaaggagatggtggttccagtgaaggtagccctagggatggcggtagcctgggattcagggtgaaaaggacttcctcaactatggcagtggtagccctataggggcagcagcagcccgggacggcgggggcctgagcgccggtgcaaggttctctgcaaggcggaggtggatcttggcggcggcggcgaccctagggacgatggaggcttgggagtctaggcggatgaagatatcctcgacgacggaggtctaagttttcagcaaatggacactgacagaggcgtccaagggcggtggtgggctaggaatccgggaggcgaaaaaggatcccaacgatggcgacagcccgacgaaggcctagaaatcatacgaagtggaagcagatccctcggcctacatctggtcagctagttctgacttggacgaggatggatgatggtgggctaatcggtggcgtgtggcgttaactcacctgaagcgaatgaagatggcatcagcagaggttctcagcgacgacgcactaggggtggtggtgacttgaagactttcactaacggaatctggccgtttcagcagggtgtggtgaggtgtaggttttctttttctggttctatgttctcatcgttgaggtgtgagtctaagtgctcttgtatctttttggctgtgtatatctttcatggatacaaaggctggataaatgaaaatccattatcacaaaaaaaaaagatttacaccaaatcaaacagaccgtagaaaggattgatcacgcttagccaataattcttttattgatctattaagctaatatttttcttaatttggaagacgacttttctttcattttttgatgtttgttggaagattcttctgctgcattccaaccagacgttcctgttaggatacgcataggctacggtagcataaattaaattttttctaccgcgtaaaccaggacccatacatgtattagatcatagatcattatcattcgacgcgctgcgcagcggaagaaagcgataagaaggcgaaggaaccctcaggatgtagcgcgcgtcgatgtagaggaagtagttgaccgcaccagctcgaccttctccttctcgtgcgttctcctcgccgtactcccacgctgatcaacaccgcaaagcagcggctcctctaccggtattcacatgtatagggacggaacgccacgcgcagatgtgctagcacatgcgcgcggctagggttttgctcgaggaggggagtggcggctagggtttctcacgtgatggaatacctccgccggtcacacccctcacaaatatatagaatccatgactcgggcctccaaggcccgtaggactcctattcggatccctatccgaattaagctcatattggatctccatctaatccccttattccggcccattaagcgtgcgaccctgtagatttatgtacactcggctgcaacccgaaaactccttttcggtctacgtgtcaacagcggcccctagcagaatgtattgatcgaccgggcatgcacaaagatcatctcggttaaacctctagtatatacttgtatgaacccctttgccttacgatatcgattaagctcaaggctagatatgtgccatcctcttcgcatggattgaaggctcgctttatcaccttatttgcatatgctttctcctataatattaggtatatgctatttccatataatatgaaccatgtatagcatatagtatatcttactcgtaacaccaacactatcatggagcaggtgatcgacaagaacatggaagaaattaaaatggaatcttggagcataggaggagcgaggagtaacggtgatcttgttttctcccctttttttagcaacatttttttatattttccttgttgagaggaatggtgatcctctgtttgctgtcaaattctcaattagaacagaaataaccgcttaggcaatattcttttctcgtcaatatacatattttatcttaatttccgttagcatgttttttcaaaccacgaaatataccatttatgaaaattttatatacaagtcattttaaaaatttagataaatttatttttaagtttatactccatccgtttgataatgtaaaactttctagcattgcccatattcacacacacacacatatatatagatatatgtatatacctagattcattaatatttatatgagtgtgggtagaaaatcttaccttataaaacgcggaggaagtaataattaaaaatcaattaaccatattttacgtatccgtacttaagctccattttcagcaaatcacagcccatccctaaaaaaaaaaaagcaaatcacagccacaaaggcccatccgcccatgtggctatgtccacgaggcccataacacgctcgctctccctctctctctccaccaccgccggcgctcgcgatggccacggggctcgccgcggcggcggcccgccgccgcctcctccaccttcctcgccaccgctgggcccacctctcctcctccgctgctcccgcgggagggctggacggcggggacgggagcggtggcggcggccgcgtcaagatcttcgaccgcgacctgaagcggcggcaccgggaccgggcggcgtgggccatgggggagaccgacgcgctcgccgacgccgtcgccgacaacctcctcgaccgcctcgaggactgcaggaaggcgttcccctccgcgctctgcctcggcggctccgccggcgccgtccgccgctcgctccgcggccgcggtgagtgagctcctcaaatctatctcctcttgttgttcttgcgtgacaacccctctacatatgcaccagtagaatcgctgaatttttccagcttttaacttgatagggagtatgttgtaatgtggtgatgggaggaattggggttttcttgtgtaacaggtggaattgagaagctgatcatgatggacatgtcggccgacatggtgagaaagtggcgagagatggataatgctaccgatgacgtcctcgagacgcagtttgtcgtcggagatgaagaataccttccaatcaaagaaaggtaaagatcaatgggagcaatggttagtcttcagtatgttagttggttccatgtaaatattattgagggcattattatgttcttgatttgttgattctggcaatcaaccattcggtagtaatgttatccacctttagttgaaaatatgacattcgtaaattggatacgcaaaccagctctttatctttccacatttctacttaataaaggtaatatcatgcagttctcacaattatttagtttaagtcaaacaatgtttcccgatcttcctatctgcatattgctcatgtcattattaatgtggttatggtctctgaagctcgcaggatacgataataagttgtcttgggcttcattggacaaatgatctacctggagcaatgatacaggtgaatttttttttagtttgattcttgctagcatagtttgcaatatacaactattctcagttgaatgaactggttatacttgatggcagtgtaggttgtcgttgaagcctgatggcctttttcttgcagcaattctcggtggagagactcttaagtgataacctagcaagctttaaaatattttgacatttaccatggcatcagcatatcctaattatcctttgacttgcccttttccggatgctataatcagggaactaagaatagcttgtacaattgctcaaatggagcgtgagggtggcatcagtccccgaatgtcacctttagcacaagtaagattcctgtgcgatctgaagtttgaccccaacaggatattattttgtgcttcgtacacctttttatggcatcagtttctcagaagcacattcctggcctttcgcttatgagataggacttgcaaccacttaacagctagattgcatcacattattgctttatcttgacatattggtgtttattcagtctgatggtgatattgggttgcacttttcaaggtccgtgatgcaggaaaccttttgacaagagcaggcttcacccttccaggagttgacgttgaccgttacactgtgaaatacaatagtggtttgtaaacaaaacttaccttttctaatcagtggtatattttcaaggaaaaatcaggtacatgccacttcagagcatttctaaatcatattcagagtggcacgtacctaacttttcctattagaattaatgattgggtatacttctttttcctggaataatgattggtagtactatatctgaaaagttcttttatattgatgaaaattctgtcattgtgttgaacatttaaacatctccatgtgttgcttatctctcttgaatcctgaattcctgatattactgcttctatcgactagctttggaacttgttgaacatcttagagcgatgggggaaacaaatgctctctttcaaagaaatcctgtgagtatattatagtacttgtcaaataaataggtcaaattctaattcatag

SEQ ID NO: 67493 - DNA, 1640 bp, Oryza sativa
cttcatctttagtctaaccttctgccagtgtgtctcaaagcactacttacctgtgacgttatagggcacaactttctgttgtcaacggctcaatgatgttgatcatagcaagtttagagaataaattctgtaagtttgtcgttcagtttccagaggtatgctggtttgatgtaactctcgcaatcagaattcatgatcgaatgataatatttctagcaccatttgcctgcttcatttatcaaatgtcggattcttctatgttttccctgttttctgggaacaatttgaaacaaagccattccagcattattatagatcacttggtgccaactgggttttgttctgtacctgctcaggcaaatggatggccatcggcaagggttcactcgcaagatgtaccatagccttctgaatcattccgttttccatcgacttgatgcagaaccacacaagcaccaccaaagcaactcttctttttctcctttggatccagctcagtttctcatgctccaggagagcagggctccaaattaaataaggaaaaaatcacaatccaactgttgaaaacctcacaaaaactcttaatttcaggtactgctatgaggggaaaatttctataaatccagtcatgttcttcaatcttacatggtgattatatcctacctgataacacattgttacaagctaaaactctacgtatgggcttttgcagcagcctgaaattgcaggagaagataggaggttgcaacctctgaactctggtccatcttctcagaattccaaggcaccttccaactacttaagctacctgcctggcttgctgacacgcgccttgcgaacggcttcttggatctgcctctcgtgctccttgagcatgtcctcaacgttccctcctggcggcatcaatggccctgagtggtggatccttctgtacttcctcccatggttctgatcacaacggcaaatgcacaagaaatgtgagataaaacaaaatcatggtatacaatctttttatcctcgtgcagaattgcaggatttcatcagtatttgctctagcagcagcaaagctatgcttaccatgccgtccttgacttctgggttcttgttctcatcatgcctgtctggtgagtcgttatgatcagtagcttcaacagtgctcctcaaatcggtcgcaccaaactgtggtatgagcgagtgtgatgaccccttcttccttatgccacaaggattcgcgacgcgcactgagcagcaagcgcggccaggtactgttggctggtcattgtcgccctccatgttgttccatgtggaactgtacccagggagctgcaccgcagttggacgttcccgtggttccaccctaaaccctggaacactgtcctcttggttgaacacctcgctgttgctctttgagctggtgtgtgtttgttgctgcatgtcaggcagagttggtgagatgaacttttgaaaaatataaatgttttgaaatttgttaaagaaaactgaagcattgagtttgcaaaaagatgtttagaaccatagaacaaacatggcgcggtgaaaaataccataaagcaaccaaatgttctgatatttatgtttaaaatgatcgagtaaattgaaacttgggcagtaatttggat

SEQ ID NO: 67494 - DNA, 8634 bp, Oryza sativa
ccataagcacataagatgccttcttgaatgagtggatcaaattgagaccaattttgacagatcactttccagatatctgcccttgacaagaaaacatcattgagtacgcttgataaacctctgatgacctgatcatactcttacaaaacaacacatttttccatgtggctgttcatttttcaggtaatttggaaacaattcacatgttcaccaaattttaggacaaaaaaatacaatcgtatcaaatagaaaactcaagtaagatttatggagaagtgaatcatagaaataattaaaatgaacataaggcaacaaggttggtgcacaattaatttctttcttcccatcaaactaacccaaaaaaactgtaaaaatgagaaaagtaactaaagaacactatttggttaaaagactcaccttggggaggaggcatgagtacgcaaatttcagcttggtgtgaaggcacattccaaaagcaagaacaaagaatctagtattaatctgtttttccctttcgagaaaacattatgggttccacccatttcaggtaggaacaagtgtgacaaatagtaagaaaaactgaacttggatttacaacagagagatttcacattgagagtttgattaagttacttctctccctctttctctctcgttcctaacaaaacacataaaaaatggaaaaattctcaaaagcaaaacagcataccattagaggtaactaataatagagtatgaaatgaatgcatgaagtgaatgaatggatgggagaacttgaagaggaatggctcgaataatttaccgacaactaaatatagttaacactttggttttcttaaaatagtacatgactatgcctttatactcttttgtagatagaataacttgtaaccttatgtttacatcaattaacgagtttgtaaattaaaatagatgaatgttgctacagatagagagatgcataaggaactctctacatttctagcataagaaagacgataacaaagatgaattgataacacaatgataatcatatcaacttcaataattactaaaataaagctcatagtttattattaattttgctaaagcaaattgatggtgagagaataatccaacagtatcatttactgttcaaaatttacatacaatagcaaagattaatacttagttatcagcctagtgactaatgacaggttagacgaaagcaaagtaacaaatttcttgttaaaaatatggatgacaactcgaatgcaactaacagtaaatgttagacccttcttacattaataattaattaagcaaatgggaattcttgaagtcagagtggcagatcgtaactaactttagcatgccattgatatttaatcttttcttgaaaaacgaataccaagcttaccttttcagacaatagaaaaggagtatcagtcatttcaacaaatcaaatgtggcgttatatacagatttactgctgttagcaattcaaagagggagttgataaattaaacagagtagctttcagatcagcaaaccgatgtgcttcagaagtcctgtctgcagcagtgagaagccgtataatgcagtcaaaattatgttcagacgcttccagattgtattcttgcaccatggagttgaaaatctgaagagcttcatcatgcaaccctgccgcttcacagattctcagcaacacatcaaaggtgccattatttggaacaaacctgtttgacagcatccaagcaaagagttccagtgcctccttgtgtctctggttgattgcgtaagcttctattatggcagtgcaagtaagggatcccttggactcaatccggttgaaaacccgttgcgctgccttgaggtctccacatgtgccatacatgctaactagccctgctgcaactagggggagaggttccatccgcaactttaacgcttgaccatgcaattccttgccaagttttgatgccccaatgtcacggcaggcactcaacatcctgctgattgcaacagcatcaggccggcggtttgagagcagcattgatctgaacacatcaacagcagttgaaggatcaccattctttaggtacgcatcgaccaatgctgtccaagcttgtacagtcttcttgtccatgacatggaacacccgttgagagtaatccgagtgactgcacgtaccatacatagtgatcagtgaagtgcacaaggaaatatttggcaggaaccacctccgcaaggcatatgcgtgaagctctttcccttccctcaatgctttcaacttcgtacatactgggagcacagtccccacggctataaaatccggtctgattccttcttgttgcatccaaagtatgcacctcagcgcctggtcaggccttccattggatgcatagccagacatcagtgccgtccatgagacaacattcctcttcttagcgctatagaacacccgtctcccagagaccatatcgccacacttgcagtacatatctaccaaccctgcctgaatgtttccaacatccttacgatgttggaacttcttcaacacaaaaccatggatctccctacccaagttccaggcacgcaactcgccgatgacaggcacaactgacgtaagcaccacagagttcaccttgatcccatcctccaccatccaccggaaatgctccagcgcctccctcttcatccccttatgcgcaaacccggcaatcactgcaccccacgcaaccacatccctctctggcatttcctcgaacaccataaccgcaggcttcaccttcccgcacttgaagtacacgtccatgagccccgtcatgagcatcctgggagcgcccgcgtaggcgttcttgatcagcatcgcgtgcgtggcggtggccatggccatggacggcgcggcgctcccggagatggacttgaggacgcagccatacgtgtactcgttggcgtcggcgcccgcggcgcgcatctctgcgaacccatccacgacggcggcgcccgcctggccgcgtccccggcgcacgtgcccgtggaggagcgcgttccacgagaaggagctcgcccggggcaacccgtcgagcaccttgcgcgcgtcctcccgggcgccgagcgcgaggtagagctcgacgagcctggcgagcaggaactcgttggagtcgaggccgtggacgcggaggtgcgcgtggacctggcgcgcgtgggcgagcgaccgggcacgcggtgagcagcgcggcgaaggccgaggccgtggcggggacaccgcggtgggagaggtggtcgaggagggcgagcgcggaggggagcctcccgacgcgcgccagcctccggagctccgcggacagcgcgggcgcgttcttggagtccggccggagctccgcctgcgacgacgaagcgccccgcgcggccgcggcggcgccggcgtggagcgcgcgggagaggggcgtcgcgcgggtgaggggcttggggcaggagagcggcttggaggggaggagggggtggtttgcggcggcgagggaggaggacgccatcgccatggatggtggggcggaggttttcgggagggaaggagaaggggttaacggttgggaaggatggtggttgttgacgacagactaaagagatttttattagtttactttttcaatttctttgcattttctagagagtttgtttttgaatttcttgtgcatttttacgaataacattttaaattatgacaaagaaaaactccctagctataaagtcagctaatgctcccttagtagcatccattttgatgaaagaaaaatgtgttctctgcccaaacaacctaaaccgtaagaggccacgtgtctatccttacctatgagtatattgtatacactaattttgtattgagtcattgggatgagagattggggctgaacttggatggatgatagcattgaggttgcgaggataacggagaacgatagtaggtagagagtaactgtcagggttatggataccacatacctaatagtagttgactaaatctcggcaggacccactacataccatgtcttatacggaaacaaccttcggatataggaggagttccgcataaggaaggatgaatagagttctacatggaaacgacaaggactactcggattgtatcaatattggttttcctagttctacttggacaaggggatacctatgggtataaatacaatagatcaagacacaagatcaatatacaagccaacatgcgctaagacaagacgccggatatcgacttcagagataagcatggctagtcccctatggtgtctacggatactgtcaggagagacatagcgctgtctttgatcttgccggatgcggattcgaggaggaaggctaccatgttgtcgactacgagtcaacacttcagaccgccaagtcgacaacagttagattggctaccccaaatattgtactggtgtgattatggtgaataagagcaatgaccggcttcggccaacaggagtagggttattacctaacaattcaggggcccgaacctgtataaaaatcctcgtccccatatcttttattacaatctcgcatatatcctagtaccaacgatccccatactgtataaataccgtagtcgtgacatcaaacgtagtcgatgattgggaggaagttcacgcactggctagccaaaaagcgtgcggcaaacacacgaacgtgtccatcgcggctccttaagccatggcttcgcttgctaggttcgagggctggctaaagcactcacaccttacaaaagacacacatgtcttgctcaagccacccatacaaactgagttaaaaacatagctcctatgtgatgtggtgttgtgacttgtgaatggtcttattttacaatcaatttttgtcttatgatctttttttttgtcttatgatttttttttgctgcctataccatacaagactaagtgagaggatagttaggaatagggtaagttttggtaaaaattaaataggataatcatgtgggaaaatagtattaaaaacccaaatatttatgaaaaaaaaataaaattgggatggaggtagttgaagcttactccaaaacacttgtgctctctattgcaatgggtagatcaaagggaactatgattaattttgcaccaaggttttgggcaggtcagaataaaatttggaatacgtgtgttcgatccctgcatctgtcctcccctttgcgtcaatctcagccgtccaagatactagtttcgatcgaacggctttccgcgcttcttcctcctccgccgccgcaccttctcccaccaccgtcctccgccgcgaagccacccccccacctcacgcggctacggcgagccgagacccgaagaggcccgagtaggcggcgccgcctcgaccgggaggtggtggatcgaggtttgcgctcgccgacgacccccacccgatcgccccgccgcgatgcccgccctgcgaaggtaagtagagaaatgcagtaggatgcaacgcaaatgcggctcgcttgttctcaggctctcagctttgcttatctcttagacagtgcacacttttatcttctgagctttgctagagcaggcatggtttggtttgcttgttcttgctgaatgtcacggttggaccgaaggagtgcatgaaacttcgatttggatgtcgccagtgatacatataggttggtttcttaccgatgtagactttatattatacatctcatgtagcggtatggttggaacatagggaaaaaaatagcccctcatagtagaatctgttgaggaaaaaaaaaagtacccctcatattacaatctcaaggaattttactgtacttgaaaaagtaccttaaggtacctaaattttacattaaaatttttggtacctagagatattaaattttacactagaaaatatgatactttctcaagcatgataaaattaccctacaatcttatacagacaatgcactaagatttggttgtgtagtgcgcgggtctgtaaatactgacatgtaatgttggaaatgccggttttataagctaatactagcatttttgtaattgcttacatggcggaggcagaaccagatattttggtgagggaacacttcagaatgaggaattctgaacctattaattctttggatgtttctcatctaaatactagttaacttcctagatctcatcacagaaatgtgatggcttagacaggacggtatagaaaattaacaatatcgaccaacaattttcttgtaatatattttgagaaaaaaaatctaacgatatttatgctacgaaaaatctttcccaacacttatacatacatatttcatatggattgtccaaaagttcattaaaatcagaataattttgttgctagctagcatgccactttttcaccagagggattgatctgcaatctgcaccataaaaatacaggaggtagtacaagtgggctttctattttcttacaagattataggaaagcgggaagtcagacaagtagggagcacttccctttgagtggaaaaattgagccacatatatacaaatttgcagtcagaagacttagcaacaaagtactgcaagtaggcgtagttaaatcaaatgagtgctgtgctgtccacatccatagtctggacataactaatggcattgactggttcccaactatgaaatttcttcagagatactccatctagtccagtcaccctcaagacaattaacaaagctgcagactgaagatgccattgttacaggtactagaactgtgcctcctatttagatgcacaagatttgggatcctgatgcatatgagcctgtgatatagttacattgacatgtgcatggagaggatttttttcctttgtgtgcttctacagtagccatcttcatcttgaatctctctttgtgttgcttcttctcttgcaaatttttacgtgcatctccatatgctgtaatatactaatctctccatagagatctttctctatagcttctgttatggcactagtgtttgctggaaaggcagtggcaactgcagccatctccttctggatcaacaaggctttcacctacctgaaagagtacaaggttgaaggcatcgaagatattaagaacaggctactgcagtcgatgccgaagatccaggtcgttctcgatattgtcaatcccaggtatgtaaaggaacagagcagtgcactagatgcatggttatggcagctcaggcacgcagttgaggaggctgaggacgtgatcgatgtgctcgagtactacaaactcaaagaaatggcaaaggaccacaaggttagtgtctggggttcctctttctctaaggtgaagcacaaagttattaagtctgttaaacatgtcagtattttggacaagaatttgaaacaatttactcaccggggcactctcaagaggttgagggaagctgtggagggtttagacaaggttgcttcagatattatgagcattctcacagtcacagaacatctcaaagaggttgcttcgtgtagtcagcagcaggagtattcaacgaacgatgatcgtgcgacaggtttgacattaactccacctaaatttgttggacgagaaaaggagaaagaaaagatagttagatggctgacaaaggcatcaactgacgcttctggaaatttgatgagcactaaccatattcctattctgtcgttaattggtcacggtggcatggggaagactacgttggctcaacgtgtttgtgaagaaatggttaggaagaatttcaaggttatatgggtgtgtgtatctgatcgctttgatgtaacatctgtgacaagtaaaatactagaatctgctacgggggcaaaacctaatgctaattgtttggagacactacagcaaagcctaatacacaaactgaagtattctactgattttttgcttgttttagatgatgtgtgggaagataagaaaatagataaatgggaaaagttgtttgctcctctaaggacagggaagagtgggagcaaaattttgttaacaacacggatgcagtcagtagctgttttggccacagaagccatgggaattgaaacagagttcttgtcaatagaaggactagaagaaggtgaaaatcttgagctcttcagtcattctgtattttctggtcagaatccacaagattttccaaatttgaaatcagtcggcaaacaaattgtgaagaaactaggaggatgtcccctggtaacaaaggttgtcggtggccatttgcggagcaatatgagttttcaacactggaacaatttcttgcaagaaggtttgcaacattttaaaggaagtgaagatgatattatggaagtcctcagactaagctactactgtctaccaaccgaccttcagatttgctttcgatactgtagtatattcccgcaagattatgcatttaaaatgaaagacctagtgctgatgtggataggttcaggactgatctcagaagctggaaataaaccaccaaaaaggcttgaggacattggagaacagatcttggctcaattagctgggaaatcattctttgaaaccaatatcaaagtagatccgtatagtcaaaggaaagaaaattattacataatgcatgacttaatgcatgaattggcaaggtatgtat

SEQ ID NO: 67495 - DNA, 1616 bp, Oryza sativa
atgtaacacgggcacacggcacaacaatagcatgatcgtgtaataccattttcatattgttgcacaaaagttaagaatataaaaggtgccagatgcagaaaattcattcaccagagtcttcatccacacttggcttgcatgtgggaagaaaatatttgatctgataggtttagcatcaatgggcaaatacatggacatccgtgttttaagtgaacataggtctgagtggatcgtatttactcacaaattagacacaaacacttttacacgtaagaaggtacatctataagcttctatgaacttcataatgtgtcgtgtcatgtacaaaaggtctactggcatttggtttatctatttctatccagattttcatttcatttatccacaataccaaaccatttgttaattatagtgataccatttacaggaaagaaaagaatatattaagtatgtcagtcctctaattaacatattacattagattaaagcctattgggagatggcacaaaaaaatgtttgggcatcactaatagcatacaccatttctgtagaccataagaaggatgtagcaacacatggttgacatgtcttatgcgtttccaaaataaatatgttatttaagcataccctatatttgcatctgtgcctcattaaagatgaatcaccaataagatcgtaagaaggatggaagagtatacatattattgtgttaataatagcttaactagtgattaaaaaagaaacagtattttaatagcaaagtataaaaaggctataaggctatgtgtgaataaggttcactttttggggggaggtaaattaagaaggattgtaacaaagtaccatcttgctaccagcaatgttggatggcagatcagactgatggcatgccatagagtctgcatcagctgaaaggtcaccaccttcagcagcaactgcatgttcacttccattggaagtgctactaacactactgatactactggccatgctgctgtaattgctgttcttctgtctccttagtcttagaaaattagagttcactccaagtccacgagatgatccaaggcaagagctgataccgaatcacaacacaagatggaaaaaaatcatggacaaaacaaaattagcaatcaggatatattaagaacataaaggataggcattaataagtgcaacttatcttctagttacaacacaatagcatggtcaatgagtgccattatattttcatgacattttttttagtataatgaaccatgggtagtaaaaatatattacgctgtatatagctttcatatgtgcttgatagacagtgatctttgcattgcacaatggaactactctaaatataataagttcatatttgcagttcattggatatttattttcatttggtatgctgaaataagcaccaagctctggccaaaaacatcggatgttggttcacataagtcatgttcctgctccagctgcaaactcaacttaagaaaaatgaatggtaaagagtctgaatactgattcacttgatcagctctagttttggctacaaacattaggacaaagcagaatataactttaataatcaggtaaacatagttagccaagagccaacg

SEQ ID NO: 67496 - DNA, 9441 bp, Oryza sativa
aacaacgagagaatatcctctcgagggatcaaaattaatccactctcaactaatagctatagaattcgcaatctcattattgtgcaacgttgaagccattctacgtgtaagtacatattgcatatctcttctctatctctacttatctctaatgttataaaaattaaagatgtttttgctggtactttggtacgtcatccgtatatgagtcggtttttaagtttgtttgcttttgaaaaaatatatatgtatttgagtcaggttttaagtttgttcgtttttggaaatacagaaggagtcatataaaaaatctttttaaaaaactcgcatgctaatttgagatgagtggactcctaattacagctcatgaattcatgatcttttagagaaatatatatccaagcaaatttcgacagtgattttcaccttaattaaaccatatatcaataataaaattaaaataaccttcacctgttgcaacgtatgggctttttttaagtatataataaaagacaaattgcatatataataatagtccggcagcttctctattttattactccactacggctacatgcacaattggggtttccacacagtcgttattgtttccgttgcaatgcaggtgcagacagtttgcgctgcgttcggttggaacatttgggacctttgccacgcatataaaacggaacgagttattagcactaattaagtattaattaaaaattaaaaatatattagtattattttttaaagtaacttttttgagatttttaacaatgagttgttcagaagttcaggaagtgtttgtgtaaaaataaaggagcagaaattggaaaagttcaggaagtgtttgtgtaaaaataagggagtaaacgttggaaagagcaggaaacgaatgcacccttcagagcaaatagctactagtactattaaagagcacctcaatttatctctagaagtttgaccaaatgcatttgtgaaatatcccatacgttggcaatgtcaatggcttcaacgaatgatgtggctcatcctgattgcactttgtgattcacttttactaggtaagatatggatgtatttagtttgttaccaaatattggtaatgcttagagaattttggcaacaatacatttggcctattctaaaagaatgacaatattaccaacttgtttgttaaattttgaaaatgtttatttaacagtaatcctaacaggcccaactagaaagtctctcacgctgggccttgttgaccggccagttagccatgcgttctgggccaccgttgcctttcctcgtcgccaactcacctgcccggtggctcgcaacgtcactctcgccgccttgaactcgtccgtcaaggcctcccacctccacgcacggacccaacaagaattcgaacaagctcaactgaacaaagcccagtgcaacaagaattcatgcactcgcctcgtgagggctgtcaaaaatgctcaaaactcgcgagctgctcgagctcggctcgtctaggctcgattcaagctcggctcgagcttcagacaaactaagcctgagcctctccttaagctcgcgagttttatcgagccaagcttgagcttccaacgagtctagtaatatatatttttttgttatttaataaattatgagatcaaatatgttatttgtatgccttatattaatatcatatatttattttattcttttttcctcttctattaatacgatgcactagaaattaattgttttttaaaagattatatttgaaatatatattgttttacttaaaaattaagctcggtagtcgagcttgtcagaaagctcgaatattttatagactcggctggagcttgtatcgagttcgagcctagacaaacgagctcgagcgagctcgttgacagcccttgccctcgtctgcgtctggccgtctggtacacatgtaggagtagtactgtttcacaggaagacaacacaaataagtactacaggctacagagttgctgagactgacgatggcctcaggattggtagcagtaaatcgtgcgtgcattttgtaccttctaggagtaaaaaaggagtactactcctagcagatggtataaacttgatgtcttgtactgtacttaagtgatcgagtgaaatacagtaatctaggtctagatacccctacattaaccatgaacaacagtacatcttggatgtcacccaagggactgattcacatcatcaaatgacgctactatctggcatctgcagcaaaacacaggggacccaacttaacccaaagcattcaagcccccatcatcaatctgaagcaagccaaaaagaacagaaacaatcaaacgagagcagtagtagcacaaccaaaaaaaccaggaggcatcaaagagtggcaggcaagtactatcagattgatccatttattattttctcccatttgctgacaaccttgtatcgagataccattattctgattccacgtcgtaaagcattttctctgctttttgtagacagcctgttgaacatgatgttcgcgctgtcgtacagttcgaaaaggttcgtcatccttcccttttttttcgttctttctttctttcttttcttcacctgaattttataaatgttgtcacggggatcgccgtggccaacatggagcagggatcctttcctttctcgtttgcaacgtaccaacagctagtgtaactagacaaccgagtcatctggagaaaaagattgagagccaaataagtgagacaggcttgtaaaaagctcatgtcatttggctgctcgctcagcggtttttgcatctctctgacgtttggctatgcatctgtcggcgttgttcgatagcgcatcctagaaagaaaaaggtttcttgtacagttgtactcaaaaggacagggtttgttggttctgtttgtgtgatttttattcacgctgtatacaaacaaattataatactccatagtgactatggctgtgttcggatgcctgagttcccaactctaatagtgcgcacgaaaaacggagcgatccattagcacgtgattaattaagtattagctaatttatttttcaaaaatagatcaatatgttttttaggcaacttacgtatagaaactttttataaaaaaacgatccgtttaacagtttgaaaaacatgcacgcgaaaaacgagaggagagtgttgggaacttagagttccgaacacagcctatgtttttttaagtgtagtacgtatgctggtactggcaccaaacttacatgttactctatttgttgatgtattccaagcagggctcataaaactgatgaaaacctcccggttttggcacaatttttaggtttagagccaccttgagctgataaaccgctctgataagaaaaattcaaagtgcatttcaatttttttttacaggacttacttgaaattcatcagatttcaatgcttttcatgaaaacaggtaaaaccgcttaggagcattttcttattagataaaacctgatttcaagttggtcattggacctcaaatccttcagtggtgaattttgtgctcccaacttatgagcttaggaattaaggatttaatgtgtgcacacgcacgtgcgggtgagggttcaaaaatcatttgctcgccaaatactgcactagcctccacagcaattttgacggtttttgtgaatagtatctaacaaatttgtcgaagattgaatttcagcttatttttttaaaaaaagaatcgtcagtttatcagtttgtttcttgatgcgagctgaagcgaacttgttctttatttccacgtattagaccatcatggaattatctctgctattataaaaattgaagatgtttccgcggtccgtcattcatgtttaagtcggttataaaaattgaagatgtttccgcggttcgtcatccgtgtttgagtcggttttaatttttatgatttggttttaatctatatctcttctctactgttataaaaattgaagatgtttttgccggtattttggtacgtgtcatccgtgtatgagtcggtttttaagttcgtttgcttttggaaatacatatccgtatttgagtcagtttttaagattgtttacttttggtaatacagaaggaatcatataagaaatatgtttgaaaaactcgcatgctaacttgagatgatcaggctcctaactgcagctcatgattttctatatatatatatatatatatatatatatatatatatatatatatactagaaaaaatgcccgtgcgttgcaacgggtaaactaaaattataccaaatataaaagtattagatgattagggtttagttttacatgatatgagctttttaagaaaatctattcctaatgaaataaaaacaattcaacttaagggacctcaagtgaacttattctgtgcgtgcacgcggcccatgaggcgggctacagtgtgggcggcctgagaacatattcggggacgactttagggacataaagtaaatgtattctctgaggagattacaagcggcccaatagtgtgggcagcctgggaacgctggagaagctgagccgtccgatctgatggacggtcttgattgatcacgacctatataaaagttcaatgatccaaaccctaaccctaaaaacatttcccctccctccctctccctctccctcagtggcggcgcctctccccctccccggcggcgcctctcctccctccccggtggtgccgctccccctcgcctccctcgcgtgacagatccggcgacggtggtgtcggcgacgaccgtgggtggatccagccgcggtggtggcggccgaggacagatccggcggcggcggctccctccgactcctctcgcctccctcccgcgacggatcttacggcggtggtagcgtcgacggcgaccgcatgtgggctcggtggctgttgctccccctccccggtgtggcgacgtggccaggagcggtggtgggctcgggagcggcggcgggcttgggaaccggtcacagtggaaggctacgatgccgacaacggcggcgacggcggcggacgacggacgacggcgacgaccacgaggagggtggctctgggagatggctagggttaggatttggattttatttttgatttggaatgttgattttgtggggattcttggttttgatttgggattgcaattgagtgattctgtgattcttgggaattgggggcaaaggggttgggaggctgatctgctcggggattttttttaaaaaagacggacttggacttacacgacgatgacggacgaaacggacgatcggaggccttacatgttttgaagtaggtatagagttataaaaccaaacgagaccattatgtcgcatgcatgaccgtaaatgcattaggtggtatgttttaacttaacgaagagaacaaaaaagaaatcaatggaagagcatcttttaacttaactaccgtaatagagagaaaaaaaattaacgggagggaaggctactcccatggaacagaatgggaaacaacgtttgaaacgcatgcgtccaaatgcgaaacggaaagggacgacgtaccaaaaacccatggtaaaaataagttaaacttttataatagtagagatatatccaagcgagctctcacagtgaatttcatcttaactaaaccatctaacaataataagattaaaatatacttcacccgttgcaacgcacgggtattttttctaatcaattaaaaaagtctaagtctaacttatttttaagctttctcattgtctgctaattagtttatcagatgcaacttaattttaaatattttaaatttaattttaaatttatagccgattttatgtttttctgtatttttcccagcaatgaattttaaaccgctaataacataatataaaagtttttataaaatatgtgttggttgttttgctccttttctatggcttatcaaatatcagccgtaacttaaacgatgagagcattagtttgagcgattgggtctagttgcctgtcatcaaaccatctcacaagctaactttacatgccttttcaagtttaaaaataaaactccacatgccttttgaaagcctgatcaaagcgagcgaaatatgctgcaaattttaatctctcaaacaaacacaagacattaaacaaaaccaaatggaggaaaaaatgtctggcagagaatgattgatgaacatgaagcgagatcgacaaaacaagttgcattttctttttctttcttttctagtaataacaaagagagaatagagagagaagagatacccatatcgaggagacacgatgcgcatacggtacgccgtgtacagtgtacagcctcccgagacaaaattcccaacacaccctggcgcctcggcgtactacgctgtaaagaagagagaacgggaactcccgttctcttgtccaacaaaagttggataaaaattaacaaaagttggataaaaattaacatttttatggcacgttttttaaactgctaaacgatgtgtttcgtgtgaacactttctatatgaaagctgctctaaaatatcatattaatctattttttaagtttgtaataaattaaactcaatcaatcatatgttttgcgtaaaaaacttaatctttattttcatctttattttcagtagaaaataactccaccgtaagagagaacgaaagaaaacgagaggccgcgccgccgccgcgcgccatacatgtggccattaattcccgggtggccccatacgtcagccacgtacatcgcggtggggactggggagcggggtgcatttagcatattttatcccgtcgcgctacgcatagcgaatattcgaaaccccccaatcccaacaggcgacagctcgtcccatgacgaaactctggcacgcgattttacgtaactgccctcgcctggacaaagcatttcaccggaattatctgcaaagctgcgtcatcactcgattgggtgaaagcttatgttacgtttaactgcttcatgttttcttgggcaactgaaagccaaaaactgatttggtcgaccagccaaggtcgtgacaaacaagacgtctttgtatatatcttgtgtgtttgcttaacctacttttagtgttctcctgcatatcttaattcaatcaaacttttcttgctttagtcaacttataatctagtaaatcggcaatgaggtgttagagacttagagttggttacctaagattgtgacatggaaaaacttttgtatggcttcgcctgggggcttaaataaagacaggacggcgtacaaaccaagcaagtcagccattgtacttgcttataagtattcggtattttgtttgccaggtagaagggtaatgtttgtttggtacgtaaacctgaggattgaaaatgacgcgactggtcacggtgtcactataaatttatagaccttctattaaaaaataaaataaccttgtttcgtgacattacatatgtatagatttgttatactccactagataatatcacacaccattatagattcgtttatttcggagacagataaggtataggtttactctcttcaatttgttaagaaaacaactgttatcaactagtattaaattagtattatgtaagtgtgagcgtctatgtatatctcggcacataaaaatataaaatgtgagtataatatttgtttatcttcgagaggagagaagaccatcacacaaaatcgactatactagtgtataatagattgttttctctgattacatatgctgatacacatcatcacatacgggcaatacacacaataccgatgataataaaatgcactcacatatgtacaagtagggttcaaatctattaacagataaacgactaggggcggaggatcaagtaagactagcatgaggggctaaacaatctgtccaaagttatagcctcctttttttaagtaaatactccctccgtttcagactataagatattttaacttttgtcaaaatcaaactgttttaaatttaactaagtttgtagacaaatatagtaatatttataatattaaaataatttcatcaaatcaataattgaatatattttcataataaaattgtcttgggttgaaaatgtttctactttttttcaataaacttggtcaaacgtaaagcagtttaactttgaccaaagttaaaacgtcttataacctgaaacgagggagtatatggcaaaaaaaaaagatagacggtttaatggaaactcctataattttaacgctgataataagggcttgagacccgtggtctccatggcatgcagatccactattgtagacaacccacatttttttagcttgtacccgatcattttggttccattagaggaagtaaaaaaacagtgttgtgcagaaactgaagaactaaaaaagacataccaccttgttaacacgttcctaaagtttcctgattttctagcaacgcccagaatcaaccaataataaagctcctttaacacggattattttgcacacgtagaaagtttaggccctccagtgccagccactcaggctgctgcattgcatagtgtactactagtcgttaaacctataaaatggccaatgctagtccagtactacctctggttctataataattaacgctttggacaagtttcaggtcaaatttttataaatttgatcatcaataactttaaaaatatttagtttaaagaaactagaacaacatatatatatttatctttaaagcactataataaaagtaaacatatatttatttattgtatatattataatagaaaaataagatcaaagatatattttgtagaccgtgttattgtccaaaacataaattaaaataaaaccggagggagtatctctgtcaaaataatagtccaatgagaggagaccagttcggacactcaaaatgatcatcacgtcatcaaaaagcggccgtccagggacgagggggggtaccgtggtcatttgccgcaccgcacgctcccctcgcgaagcgccaccgcttttcagccagccgccccacgtgaaattacccctctaccccccacgctccctctctcctcctcttcccctctctctctctcctcccccgctgtcccgcagcctttcccaaatctagccgcacgacgcaccaacccacgcccgagccagagccaggtcgccgcgccacctcttcggcttcgccgcgccgccgcgagcgggcggggagactccccacccccggtgagtgcccgcccgcgcagatccgcgcggttctttttttgtggggagaggcgggctgtttttttcttgcggtttggtttgggatttctgaggagagggggtttctgccttgggtggggggggggggaggatttcaaattcgggagcttttcggggggaggtttcttggttcttggtaatgcggggggggggggggg

SEQ ID NO: 67497 - DNA, 1599 bp, Oryza sativa
agaaaatctagcataaggttctaccttatatttttttttcttccaatggcacaagttttatgtgttttcctgtgtgttatccaaacggtagttttggaatttttctatgtttttaatttctataggaatttaatgggcatgacaatattcatacgtttttcttttcatgtttctgtgttttcccaatcctacattttaaaggagcccttaaatatctctctcccagtatgtgcaaagcttgagaaatgatgtatatatccatactgtgaaagtttaataggggaaacttattccagtagttttcacaaaatctgaatattgatgatcttatttgcaactatatcgtatatatacgagcgtgttataatgaaacttattccagtagttttcttgcacgctactatctccttgtctaaaaaaaggacttccaaagaaaggagcctaagctttaaatgctttattccttttgttatgccaaccttggaagccaagggaggaccttggagcccttgttatgagtactaaattttacacgagaatcacatatttatgtgtgatggtttttcaaggggcctttagtaactgggaagaaaaaaaaagtgctttccctatatagttgagatacatttttctcaaatatctgacaagcatattgcttgattcattttagacaaaatgtacgtgtaatgtaacaaatcttagaccttactacaaattaacttacacgggacattttggagaactcgttaaccggtttattatatatcaacggacacaacgacgattttgtagcgaatttggcaattagctccttcaaaacatagggcttgttcactatgctaccattttcaaccttaccgagttttggtattgctaaattttggtaaggttaccaaaattttagcaaggttgttaaattttgacaagatttaaaatttagcaacaaactaaatgtagccacttttttataattttataaaaaaaataaggttgaaaatgataacaaagtgaacaaccccatagggtcagcttttggtcagatactcgagtcctctgtctctacggtgtttctcaaatttgctggatcatcaaggagctgccgtctagtacttccccctgttttcaactgagggcgctattgtttttaactcgtgtttgacaaaattatacagatatactaaaatgccatgctttattatttttcatgataaatgaagtcacaatagaatacataataactacacaatttttttaataaaatgaatgatcaaacaagtgtcaaaaaaatcaatcacgtcacctattacaaaccgaagatatcggagatagtaccatcaaagagggagcctatgcaagtttgcagtcttttattccttcaagcaaggtctacaatcctggtagaaaccggtctgagtaaaaaacacacgctcggttttttggccaaaataaaattaagaaaaatcaaagtgagagttttaaatttttgacaagatttactcggatttcattggtttttatcgatttatgcacaattgcacagttccatgaaatccaaagataccgttaatgaatgtttctagattaggtatcgggactgta

SEQ ID NO: 67498 - DNA, 9688 bp, Oryza sativa
ttgtttgctgcttggctatggatgtgtgatgctgatttcacagcagcagcagttagaacttgttgttgtaccagaagacgcccttgttgtcctcaggctcgacgtagatgcactccttggcctcgcgccatgtcgccttggcgacgggcgtcgggtcgaactggtagtactcgccgaggatggggcggatcgccttagtggcctccatggcgtggtagtgcggcatggtggagaagaggtggtgcgcgacgtgcgtgtccgtgatgttgtggaacaccttgttgaggatgccgtagtcgcggtccacggtggccagcgcgccgcggagccagtcccactcgctcgagtcgtagtgcggcagcgccgggtgggtgtgctgcaggtaggtgatgagcaccagccacgcgttcacgatcagcagcggcacgccgtagacgcgcaccacccaccagaacccgaacgccgacacagcttgaacagggcgagccccgcggacacgacgccgacgtcggagatgaagatctggacgcgctcccggtcgttgtagatcgggccgtaggggtcgaagtggcacgcgaagcgcgggtacgggcggccggacacgttgaacgccaggtacagcggccacccgagggtgagctgcacgaagatgtgcaccagccggccgatcgggttgtggtacacgtacggggtgtaccacgccatcgccgacttctgcttcgggacgaacacctcgtcgcgctccagcgacccggtgttggagtggtggcgccggtggctgtacttccacgagaagtaggggacgagcagcgacgagtgcagcacgaggccgacgatgtcgtcgagcaccgagtagtcggagaaggcatggtggccgcactcgtgcgcgatgacccacacgccggtgagcacgcagccctgcgcgatccagtagagcggccatgccgcgaactccatcccgctcggcagcacggggatcatgaccagcgcgaagtagagcagcgcggcgacgatcacgaggtcatggaccacgtaggagaaggacttgatcaccgagcgctggaagcagtgaggcgggatggccttcttgatctgccccagcgtgaacggcggcttgtccgtcggcgaccgctgcacggccgcgccattgccggcgcggccgagcagcttctgctgctcctcccgctccttctccgtcatcctgccgccggcacccatcttgctgcttacaacaacaatcacaatcgcaggtgatgagaaagtgagaatcgattgcaatattgtagtgggatcagaaggtgcaatttgagcaatattataatgcaataatacggaaaccccacacgaacaaaaatatctcgcaactaagccaataagcaatagattacgtatgcacgagttgaggagcatcaacccaggaaaagaaagggcggcacacccatgatgcgatccatcacttttcttgattaaagtatatgtgataggttattccgagcagcgagccgagcagcatgtgcttgcccatgttcagattcgctttctagggcgtgcatcgtaagttcacatgtactgctacggatctgccttgcgcaagttaccacaagatgacaagactgatcactgtaccatagcacagtgaattagtactagtaaggccattctcaacccattagacatagtttccataaactccacagcatcaagaaactagtactaggggcctgtttggtttccagtgacttattttaagtccctgtcacatcggatgtttagacactaatttagagtattaaacatacactaattacaaaacccattatataaccttggactaattcgcgagacgaatcttttgagtctaattatgccatgattttgacaatgtgatgctacagtaaacttttgataattatggattaattaggcttaaaaaattcgtctcgcggattagctctcatttataaaattagtttttttactagtctatgtttaatactccaaattagcgtccaaacatccgatgtgatatgggctaaaaagttttagcctcatctaaacaccccctagacactactcttccaatacaaacatcactattccatacttcaatttaatgcttcttatctcacatgatgtcttggatattgtgtagaaacaatatctcatgcaaaacatagtttccttctctttactcatttattcacttgtcacatcattttttatcctatatgataacttatttaatgatatagacatcatcctaatcattgagttgggaatagcctaattacgcttagcatggtgcagtaaacgaaaaggaaatggtgattgattcaacaagcgagaaaggtttggtcttgggatgtaatgtggttttgaaaaatactagtactacagtagttatatgttcctcgataaaaatgtgcatatgtcggaacgcacactttgtccagatagtctgaactctgaaggatgatgcctaggaccatccccagaaacgtgtgcagaaggaatttatcacttgtttgggggaaaaaaatggtaccatatctgattatgataaggtcattaaatccagccatacaaactgggcggtcaaatataagctatccatattcatcagacatcgtcatatcctaatgagtggtcaattttgacgaacaattaaacacacaggaagtttcctctactcttaaaaagacaccaatctttgcaaaaaagaaaaccacttgctcctgcaggttggtggaacagtaccatcaagactaattagtataattacctagctagggtcaaattaaccaagtgcactgcacgcgtctagtctaacgcaaatgccatcccacaaggcagattcatgtgcgactgtctcacttgacttggaaggcacacgagcctaccatttttcctacgggctccaggattgtggtgctggtgatctggccttcttgtattccgattagacggctgcactcgtttgattaggatgattgctagctcgctgcacctgtttgtggctggaaatcaccagcacatgcagctaatagcagacaagccagccatgcatgcactagtggtgtgtgaactatcatactgcaagtggtggatgcaaatccaagaagaggtaaggggggccagatccgctaatctacgatttgttcatttctgcgtgtccagcttatctctggctggaaatgtacagagatagaggggggataaattggtgaaacatgccgtcaggtggggctggagttcagcgccaccctgccgacctttgcaggctgtgtgacccctgcacttttgtatcctagcgaagacatgcagctgctgcctgacgatgggcatatgggttccagaccatacagtatttttatgcagagaacagtgataatttgcctggaaagtaagaggcaatcgtcaccgtccaaatgcaacgaacgggatctgacggtggagcgacctggggatcacgatgccttttgctaggtcaagcaacccaccaagcccgcgaccgggcgggggcggcggcggcggaggctgctgcccggcgcgtgagtgcgatgtcttttttattttttcctttcgctttcttttctacaaaatcagtggcatttccaaccacaccaccgggagcacgagaagcatatgccgtgccctgccgccggctaggttccataggcgaaaaaaaaagagagagagatttttttttaatgccagaaacgacgaccgcacaagaatcaaactttttcttttcttgaaatgttgtccgtgtgtaaggtcgtcggtttgtcagcgtcgtgactcgtgcccatagcgctgagtttcagaaaaaaaaaagaagaagagtaatcggccatttcgtcctgaggcgttgaaagacgaatcccaacatggaggggccagaggccatgatggaagcatgcagccaaaggaggcagctttggtgggtaaaggtagcagctttaatcacaagattaacgggaatagctaaaaggtttggcaaaagttcctacaatgagttgtaatggcatagcgatggagataaggtacacaactacagaagcatgcggaaatggagcatatcaaactatcatcctatcggtaaatcctacagatctgcccaggagacacaacaaaatcctatagctctgctttaatccacctcaaaaaggtcccatcaatccccggcggcgagacgagatcaacgacgacgagctcgcctgtcctatcccccaatccaccaccattactcccaagaacacaaactccacagagtgaaaacaaccaaaaatcaccgcagcgatttcacacaccgtaccgaaatcgaaaagaatcacgaaacaacagcggtggcggagggtaatgtgggaggcacctgagttagcgttggtagatttcgcaggcgcggaggagcggagcggcggaggcagatcggggtggggggcgggcgacacccttcccttgttccctccctctttgtggaggaaacgagtggtctgtgcaggggaggaggagaggaggaggccgcctccgaatccaccgggtcgatgcgctatttaaaagcggtccgtgcgacgctggcgcgtggggcccgacgcgcggacaggtggggcccaccacaccacgtcggagattgggaatctgacgcccgcacacgtgtcgcgacgtgtatcgcgcgcccggggggcggccttgacccggatcggggggctggggccgcgtgggccgtccgctgcgtccatccgacggccgggagcgcgtcgccgtgctggagggatcggccgggtggggttttcttgtgaggagggaggggtttggtggtggtgtcgcggcggcgcgatgcgaggagaaagcatatggcgcggcgcacggcggcggggggaatcggtcgcatccgggtaggcttcaacgagggagagaccgagagaggctggaaattggcaaaggtggatcgggccggatggcccggatccgagccagattcatgggaaatcgccgagagagagacgaccgccgaggcgagccgggagaaacggacgaagaaggatgagatatgaagggatcttgggcttttctacaaagtggtaggtcggcttccattgacatgtggcccaagtgatgtatgtatgtatgtataatttgtcctttaactttaaggttttcaatgcaaaagtttaaggcacacagcagctagaatttatacaggggctgaaacaaaaataagttagttattttgtattcagcgaagacaccaacctgtagcttagagagtggttttgtcacctttcttttcagatcaatctgatttgagattttgctagtggtttggtactttggtttacaaaaattatgcgatttctttgacaaccaaatacagcatttgacttcgaagttttaacggcatttttgcttccggtctttatttgaaatgggtggcgctacttggctacttaattcgtccaatactccaattaatctaatcccccaggccttgtctcactaatcgctactgtactggttttttttttcttctaacgcatttctcatgtgcaaagtctggttttgcaagcatacttttctttcagcagatgtctaacttcattgctgtagtacgtaacacgtacagggtcgtgtcctctgtccagtgcacgattttattcaaactactcgtcgacccgaagtaaatagtacatggcatactattgttggatcgtactattagatatggatcgtttgcttgtacacaacccttaagccattatttagaagattataactcgtaaataacgtaaggcgagctttgctttgtgattactgattagccttgtgcatggctcctacgcacgctacctgttccaaagccttcgtttgatgacaatcatggccacgtgatggcgtattctgaactggttttgcagcaaaaaatatctctcagcgagtcgccctcgaatgtcctcctaacttggcctttgggttatccgccagcttgtgtcttttcagcatcaaagtgcagttgcgcagtgtgcaacgccggaaaatattctttcataaattcaggaacccttcgtcggcaaccccttggccgccgcataacagcggattagctaggatattcttcagcaagatacacgcatacaggaaagatgttcatttattattagctagtcacttttctctccaacgatacagtaatatattaacgggttgattattattcgtgaatcgtgatttcgactaggctactaattcctcgacctaaacttcatggtatgcagcagaccaaacgctctcagtattatatcatgtcttttccattttgtttagttaattttggtcatcagagtcagagaccgatcatattcgcgcccacttgtgtccccaagttggtgtattggtgttcgtactgtatactccgataaaatatactgtataacataacatgtcccgtaatgtatatgctgacatatactatgtactccagctaacacgcaattaatcagctgcttcgtccatcgatctaaattaatgttactgtcctctgcagcttttgcgtgaattctcttgtcgcctgcaacgatcgtgcccaattctaactgcatcctgcatgtgctgcaaagatatatagagcactgtgctgctcgtagcagtgtacgtccaacatcacccacagtcttggtcacccaaaactggtggcgagatgaccgtgttcacggtccgtgacagtatcaacgttgtcatccatgtggtcagacactgatctggtgagatatctccgatctgcccaatagttaggtcgattaattaggtccctgtaggtgcaactggttggaaaatatatgtgctagatctagcagcttagcacggcgcaagacggccattgtgttgtcttcttgtagcgccggggactactcttagacggtacttaggtagtacagtactacgtacttagtgattcgtagtcatgtactaatggcattttgctttcggggttggtaattttggtagttttgttaaaccaaacacatgcgtggatctacctggtttggtgaccatacgcactaggcagagcacagagcagtgccacggtagcacggtcagcgagtactccctaggaggctgggattgtgcttactggcagaaagcgatggactggacttcatggcagttcagaaacagattgcttttttcccccttttaataaaatgcatgagttctcaaaaaaaaaatgacttcatggcagttgcagctgtgttttttcttttcttttattttttggaaaggtttggttgcctggctatatttataagaaggcagaaacagttacacacaatcgatttacatgaagcagataagcttcaaagagttgcagctggtatttttgagtcctgtggcgcagcacatatcaatttggcacaatttgcaacatggcaatttgggatggtttgtcagataaattccttggggaggcttcagtgcgaagtgggtgtaacgggtaataataatccactgatacgctgttatatatagagtgcgtcgctgctaattcaatgcttcgatcaggtctattctggcaacagcgtccgtgctgaacaatgcacagatttgcaggaaaccatatgtgcggactaacaggattaatatcggtagaattactcgcgtgacagaaagctgatgatgcacggccatccccactagctgtgccctaagttctacggggacagagatcagaaaagaagaaatggctatagctccatcatttcaattcaagaaggtagtgtggtacctcactttgttctaaaaaagatggcacagtgcgttgcagctttcaacggtacaagctgttaattgagtgtcatcatctgtacaccaaggtctactgttgcaatattccaaaataaggacgatatttagacagctgaaaacaatattttgttttctttcagtaatgatgctgctatactccacgcggtccggtctgcagccttgcgcttgtgcttctagacgaagtacagagtctaaaataacttgaactcgtttttttttcctccaatacgcaagacaacaactactactacttctcatcccgttagcacatcgaaggggatacagctctacctgatgttacaattgtagctttgcagtaaatgtgctcctcgcttctacccgaactcgtgatttgtgagttggcgcgatgcgcgtaagagcaattataatataggttataagctagctaaatgctgaggtggaggagagagagaggagaagctggctgtaaacttatagccggcttggatacaagaaccaaaaaactatataagagagataagtgggtcctatattaattataaagagctaactattacttcctctatcccagtaaaattgacgttttaaggttagcaaccaagattagttgttgtgcaaaattaccaaattgtccccatgatttgattcagcttgtcatttccagcatttatatatgcactcagaatattctagaggatgtttccagcagtaataaagtaaccacaactcactgccacgtgtaacagggagtacataaatcggcgccttggccacacgtttgataaaggggcaaagccattattaacatattcaaaaatttgaatcaaccattaaatttgctttggcgtctaaagtgcctcttctctgtgtagcgacatattttttgagataagcctggggcgttgaacgtcaattttactaggacggagaaagtatatggataagctgagaaaatgcctcttatagccaaccttgctcggacgcactgtggactgtgctaacatggcgagcccaagtgcaaactgctcgagcgagcgaagcagcctcggtaccaacgccaacgaattgctagtagatgttctctgtagtctactactactagtctgtacgtgtcatcgacgcccacgacgcgtgtggtcggcactcggcagtcctgccacgtcccggccgcgtgcggcgcacactcaccagcattggcagtatctgcggcttgccgccgcacgaccgcgcggggtaggtgggctggtccgtgtgcagcgccctcaccaactcgctgtttgggccaaactcaaagctacaaattccacacacatgtattcaagctattggatcgtcacaagattcagaagtcaaagtgtttagcacaaatccaaggaataagttcacttggtgacccttaaaagtgattgaaatctaatccgtaaccctaaaccataaaaccagatattttgacccctaaactacggaaaccggtgcaatttgactccctcggcggttttgtaggacggtttcgctgacgtgacggtattgaccgggttttctttacacatagcattgatgtggcgcttaggtggcatttcaattaaaaagttatacgtgggacccatttgttattcacacacacaattgtggggcccactgacatgtggccccacacgccatcttctccctttcttctttctcccctcccttatctctttctttctccctctcccctacagccgtccgcggggagctagcggcggcggtgacgacgaccatgggctagagatgaagcggcggccgctcgccgttcctctcgcaccaccaccacccgcaccacccagtgcccggcatcgagacgtcggcggctaccgagcggcggcagcgacagcccgcgggc

SEQ ID NO: 67499 - DNA, 597 bp, Oryza sativa
aaacaaactttacataaccaatcataccaaatttggactccttccaaattcgactccgcatcccatatgcacacaatacctccatcatatgccatatggaatgttcaccttccacgtgcattgaattctagccttagtatcccgcatgatctctgaccactacggatgtcgtcttatccccgagccgactcccgatccatcaccgcaaatactctcccggcatcttgagtcacctacacatagaacaaacaaaagaaaccatattccgagaccaaactatccccaacttgactcattagtagcaaacaacagtattacatacgcatagtatccatctagaagccataatcatgaaacaatcacggatatctaaacaaacaacccgaaaccgaaaccgacacagagtcggccggtcaaaccgcgggctgcgccggtctgaccgcgtgatacatgccggtctgaccggaccacatccagcagtacctgtagatcacctgtgaaatccaatcatctccaaaaccacttcgtgaataaattccaaatatcaaaactaataatctccaatgccaatcgttcatcatagaataacaataaaaa

SEQ ID NO: 67500 - DNA, 2184 bp, Oryza sativa
ccacaactccactccaaactcaacttctgaagttatatttagtagttgaagctgtaccaaacatgcccttaatttagaaaaggggccttactctatactcctacttcaggattagcatccaaccaattgggtattcggaatctgtccatgagtacatgtacatccatatatcgatcatggatgagacttgatgagatgagatcatacgggatgacgatattaatggcgttatcgctgggtagtagtaataggtcaggaagatggatgcatagagtttagcattgtacagtaccggggcagcgaaaaatctgtacgtgtcacggatatcctcctctctttattactcctctgccattaagcactgtagcaacatgcaccatcgatccatcgccctttgcttgcccccacggcgacggtgccctccctcccctgattgattgcacgggtaagcatcgtgtgatcagcttcaatggcggaacgtgacagcgcgcgcggctcattagcactctctgtagtagtaccaaacaccacattgcatgcaaaaaaatttccaacaaatgaagttaaaattgggtatattgggcttatttcgtttggagccaatttttaccctaccaaactggtagtgccaaaacattggtaaattttggcactatcaaattgagtagtattcaatttgaactattgtgggtagaatttggtagcaaaccaaacattcacttgctactattgaagttaccaaaattttggtaaggtaataaattggaaccaaaccaaacaggcccattatcgtctgaacgttaacttatcagatactccctctgtctcataatatagcaactttggaccaaatgtcccgtccaaattcgtatgtactataaaatatcacatttggtattagattattatattataggacgaaagaagtatgacccaaacataaattacactcgttaaaagggtcctcatcgtttgttcgttagcttatatgcctagaataacgaaattttaaagtttattacgagggattttcattatccatttattagcgttagctttttaaaccagttagtattatttttatcgtaaaatttaaatcgagagcgctctcgatttagtcataatgagcgaccctatcatccaatcaaccgttgtccagatatgtcttgaagaatcttactttactatagtactaattgatcaagcaagtagaacaaatattcctatcatctatgcttcaaataaaattttctcttaaattactcatccgatttacaatccgatttgacggagcgtggggcccctcaccggaagaccgcgcaggcccccctttgccggttcggccggggactcagggtgagattctaagctctctgtatgtggaaggttcgcgagacaggaaacacacaagacacgggcgatgtatacaggttcgggccgctgagaagcgtaataccctactcctgtgtttttgggagatctgtgtatgaaggagctacaaagtatgagccagcctctcccttgttctgggttcctaatctggaaaagttcagtcttctttatctaagtgggcaaggtcctccttttatatcttaaggggataccacatgcaccatttctctcttttttgtggggacttcccccaccttttcataaatggacggagatttgtatagttgccgtccgagtcaccttctgatgagacggcccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaatgagtgcactgcactgcgttacatgcggcgtgacacgctcagccgaaacgcaataaatgtggttaggtgagccccgccgtcttacctaacccatacacgctgagcaaaataccca

SEQ ID NO: 67501 - DNA, 39799 bp, Oryza sativa
ccgacccctcggggagacaaagagaagggcggccgtatcaccctcgggcccgacccccccgagggggttaggccacgtgggtgatcgcgtctgcctcaagtctctaagtcatgatactcccggtcccatgtcaccgacacgattacaccattgtgtttgtaacaattaaatctttacaacaagatctcacatgattatattttgataaaaaatcacaaattacttttataatatatctaaattacttttagatttcactaagttacttcttaaatatataaaagtaaattcaataaagttttaaagtaattaacataaattatagaagttattttctttttttataagttacttctataatatatgtaaattacttttaggttatattgaattacttttatatgtctaagaagtaacttagtgaaatctaaaagtaatttagatatattacaaatgtgatatatattttttcatcaaaatataatcatgtgagatcttgttataatgatttaattgtatgaacacaacggtgtaatctgattgtagatcggatgactagtttaagagaaaattgtatttgaattataggtggatagtgtttatcatagatggagtggtagataaaccagctaccattagatgtctagcaatgtcctatttttattgctttgttcatttatctatattacatgggctcgaaccgcagaagatcaggaggctaggaaaaatctccaccgtcgggccatccgatcgcgtcatctgggccatccgtgcgaggcgcacctgatcggatcagacacgccgcacggcgactacacggccacgtggcggggcccagcaattagaaagtacagtgagtttttctttttctttctaccggggggcccaatgcggggtcgacacgtgaacactgcttaccgcctccctcccccgtctggtcccgtcaagcgtggccgaaacccgagctcacgtggcatttgggcactgcattttgagagagtggcaaatagtaaattctcccagctcacgtggcggcgtggcgtggcgcgtcgcgtctgcaggggaccgggagccgtcgcctcccgaccggcacgtggcgcctactctgctgcctcaggcaagacaacccagcgatttaactaccgcatcatatcatcagcaaagttaatcacagtacagtaattagtactacaaggtgtgctccctccctccacaaatataattagaagtatcgtttaggttttctttaagggccctttgaataaaggaattacgaaggaactattgaaatcctataggaaatcttcatatatagctcttttgattcaaagattgaagttttctaaatcctacagaatttctatagaatattttgttgcatataggttttggaggaaacttagtaagaggttgtccaacctcttagtaaaaatcctctgagtctatctctcttatccgattcctgtgttttttctgtggtctaatctaacgatcattcatgtgttttgcaatcctctgttttaaacttacattcttgtcataattctatgtttttactattcctccgtttttttatacctacgattcaaaagggccctaaattaagaaagaaagagaagatctcatacagtactccctccctcccttgatataaagggattttgatattttgtttgcactatttgaccattcgtaatctttaaaaaaaattagaattattatttattttatttgtgacttattttattatctaaaatactttaaacatagtttttttgtttttatatttgcataatttttaaataagatgagtggttaaacagtgtaagtaaaatattaaaatgggagagaggttgtactagttaccccataaaacatgtgctagtgctacgtagtactagtatcaactatcaagttcggattaaccgaaccaatacaaccactcaaaagtagtgtagtggagtacagtaactatagaggagtattacttactaaatgagtggtggttggtccgtgataatagtactaaatgtgtataattaatacatacaaataaaaatgcatatactgggtcagttctctttgacagttcactgctgtctctagctcgtaccggctcagttcattagggtgaaactgttttgccgctttgtccaaactggggtcacattaactaaccgactataactgatcactgtattaattataatcagtcacacacacacccctcacaccagccgtgtccacgcgcgcgcataaaagctccccctcctctctgctcgtcccggtcgctgccgctatcaacaccaacaaacaccgcgcctcgcctcgtctcctccgatagcgacgccgccgccgccgccgccaccgacgccgggagtgacagcgagtgagatcgtcatgatggatcacctgagcctggtgccctacgagggcggcagcgccggcgggggaggaggtggagggaagtacaaggagtgcatgcggaaccacgcggcggcgatgggcgggcaggcgttcgacgggtgcggggagtacatgccggcgtcgcccgactcgctcaagtgcgccgcgtgcggctgccaccgcagcttccaccgccgcgccgccgcgggcatcggcggcgggccggtgttcttccgcccgccgccaccgccgcagccgcactcgcaccacgccgcgctgcagggcttcctcccgtcgtccgtgccggcgccggcgccgccgccgcagctcgcgctgccgtaccacgccgtgcccgccgcggcgtggcaccacgcggcggcggcggcggcaggccgcgccggctcggagacgcccccgcggatggacgacttcggccccggcagcgccggcgggagcgggagcggcggcggcggcatcttcgggcggaagcggttccggaccaagttcacgccggagcagaaggagcggatgcgggagttcgccgagaagcaagggtggcgcatcaaccgcaacgacgacggcgccctggaccgcttctgcgtcgagatcggcgtcaagcgccacgtcctcaaggtctggatgcacaaccacaagaaccagctcgcctcctccccgacctccgccgccgccgccgccgccggcgtcatgaaccccggcgccggcatcggcctcggcaccggcctcggcaccggcatcagcggcgacggcgacggcgacgacgacgacaccgacgactccccgccccgcgccgccgtgtcctccccctccccttcaccgatcagcgtctagctagacagccagacacactgtcactggcacacactagcttagccttagcctagcttagcttagctagctaatgagttcacttaatcactagggtttaattagctctaattcaactagcaatatcccatggattaattagccgctagtcgctcagttccgcgttaattaattaatgacccacttccctcctgccccccgcaccgcggccgtggtaagctaatggaggtcatatctgtaatttctccccccactagtactactctgctgtagtagtagtagctgctgctgcactgtctcatctcattttcagtcgtagtaccactgattgcattgcagtgactaatcatcgtatcctagctcattaaacagcatcggccacggcagtgagagtgagtgagagtgcatcggtcgcgcgttggggttggtgcgtgtgcctccactactgcaggaagcttccatttgcttcggcctgggcgcgagatttttttcttccccgagatttggctctcaccaacgtcgtgtcggtacagtagtgctgaggtttttgttggcatttggcggaggataatgcgacggccaaggcggaggcgacagcgcggcggcggcggtggagccagctgggggatcgaacggctcgctcgggtgcacggctccccacgtcgcgtcgcgtccgctagcgtgagcagcgtctcgtctcgttctcgtggggctcgtggcgggttcttgtcgcgcttctaatgacaaggttgggtttacaaacccgatggaaaccgtctggttactgtgtttaccgttgggaacgagaaagtttaaaccgctgtaactccattaaatttaaaaacaatttgaattttcgacaaattttatatggtttgtcattgttacggtgattattgcgtgtgtaatcatattcagcaccccgggtgctgtaacccccactcctatggtaagggaaaccctagctaatgcttgatctgctctttttgttttctacggtgatgatggcggtccagggaatgaaaatgatcacgaaaattcctaatcgaacgagcttcgtttttatatagggaaggattaccgtttctgactagtatcgttttgttgtatactataaaatttataatttctttgtgttttgtattaatgttaacactgaataatttaaatgaggaaaaaaatacaaattactagttgatcaaacctagcggtgctatctattccgaccgtttttcaccccgtgtggctgagaaatgggccggctgcgtctggtcgcgtcgcgagttgtcttttcggcgcgtcctcctgccggtgtcgcggtggaacggcacgagccggggtttttaggaggtaaggtgatgatggcaattaggccggcacgattgggggctttcggtgcgggagggatctgacacgatcccacgaggatttgtgtcgcgtactagtagtacgctccgtttgctttttgagagcacctggggctggggggtcgatcggtcagtcatccgatcgaatgtgtgacagtggcgggtgtttgtgtggtaggaggcaggggtttttgtgtgtgtgtgttcgtgagtgatttgattttgtttggtttggtgggctgttttggctgtctgatccatggattgggatcacctgcagtagctatagctacttaagcagtcctatagtcaccattggatcagaaattaacgttctagatcttttctaaataaaaaccgtacaaagcatattcctgtagtatgtaattaaagctactgtagcatatgtttagaccgttgattgccttaatccaacgatgaaaaacagtctcaactgccaaacttgcagtctctactagaggacagcttttttgcattgcagtcttgcagaagacaaagcaaacacagggccgtcatcacgagttgacgacccgcgccaccacgccacctgtggtgcgcggctgcaaaccggaaggcacacgcgttgtggcggaattctcaacaccgtcgctccgatccacgccgctagcaatgcaccgcacgagatggcacaacattggtcgttccttccaagcctcatgagtagcctcgtacggagtattatggtaaatcccgatcagcgatagaggcttccagtcagcggaggcaggccgcgatcggttcttctcagattacggtaaatcccgattagcctcgcccggctgatctggtccctgacgtcggtgattcggcgaaaggaaaatacccactttacgtatatcaactagttgaggacttggagggtttgactttcatcgacgttcctcgaccacagaaccgattatattatatttgtcaaccttttaaaaacggtgaaaatagtagtggccacctcttgagcaggtcgggtgaccatccgagctccgccactgccgtcttcactattagagtgtgtttagttcacgcgaaaattgaaagtttggttgaaattaaaatgatgtgatgaaaaagttgaaagttcgaagaaaaagtttgaaactaaacaaggccttagtagctcgggtttgatagtgtcactggcttcaccattgagtgtaaatcgagtcacttaacgttgcattagctaaaacagctctcatcacgtcactaaacaaaactatgtttcaattcgcatcggtttcactaaacaaagtagactcgattcgcatgggttttagaaattaagggaaactctagcgacacgaatgaatactaaacctctagtagatagagggatcctgagtagacttattcgttcggtgaaatgctcgggctcgtttcattgcgtcaaccgaaatagcccgggattgggaacgttcaaggtcacggcctagttaccccgacttcagcagaattgcacaggacaacccatgggcctaactaacagttgctacttgtctgccacggccgacgggcctggcctatattcccccatcactaagacccaaacagatcgcgtattgcctaacatttcaacacgccggctcaacgcatgaaaaattcgtgtcttttgccccaatttgagagttgagacgatcagcaatgggatgtgcaatgccgctcatatgctcgcagcgcaaatccgagaagaactcaagaacctgagcacccatcgtcgatgaacggtcgatgcaacgatcgatcgcgcgtgataaaacagattaggggtttccagttacattcatcccagctaaaacaagccaacaacggacgtcgtgtccgaaatgcagcagttttgagctacatcccaacctgcaagaacactgcaggaaactacaaacaacagcagatcgacatgctactgtttttacgtcgacgaaatatacctaagcaagtacattgatacatacgaacagatcagacgccatgacaactgcctgaactaaaacggtaaaaactacaagaagctacagcatgtcagattcacagcaaacgacacggacgacgaagagttttgagcctagcagacgctggctatctggaggcgacgtgccaggtgcacgaggtgccacgtcagcgccatcaggcacagcacgttgcacagagacgagtagccgttcagcttcttgagccgctggttcagcgtcgccacccggctcttggacgtctgctcgtccaccggcgccgccgccgccgccgacttcgccgccatattgttgttgcctgccggcttgcgcgccgccgccgtgggaacggtggtggtggtggccgtgttgcccgccgcgacggtgaccgttggcgggtcgacgatgtcggccatgtccctccccctgccttcctccttctccaccttcatcctctcgaacatcacctgtgcaagaacgcaaggaatcgatcataaaactatgaaaagaattgggtgatcgatgaagtgaggtgagcttacgtactttggtggcttttggctccaggagcagcatgttggcgaggaccagggcgagcgcggcgaggaggttgacgctctgggcgcgcgcggcgagggagctgcgctcgcggccgagcaggtgcgccgcgagcgcgaggccgacgccgtacgccacggcgcggaagtacatcgggaacagcttgctctgcaccatggcgagctgctgccggggcagcgccgcggcgaggacgtagctggacacgaacgtcacccacagggacgcgccgtacgccgcggcgaaccccagcaggtgcatcaccgccgtcgcggtgcgcgccgcctccctgggcccgccgccgaggaggtgcgcggcggcgtcggacgccacgtcgcgcgccctccgcgcgatgtcggagaggttgctggccgcctcgccggccttcgccttcacggcctcctcggcccgcgccgccttctgcgccgcgcgccccgcggcgtcctccgtgcactgctcggctctctcggcgacgtcggagaccctgtccttggcgtccatggcgcgctccctagcgctctcccgggcatgtctcgcggcgtgagagaccttgtccttggcattcctcacggtctctgctgctccgtgctggacgtgagacgccctctccttggctttgcccgccgcttcggagaccttgtccttggctcccacggcggtctccttcactttggacgcagcgtcgaacaccttgtcctcagctatctccttagcatgcgagagcgcctcctctgcacctctcgccgcctcctccgcgccgtgctcgcctgccgacgccttgtccttcgcgccctcctccgcctccctggccgcgccgcagagcctgtccttgcaccgcttcaccgcgccgaacaccttccccgtcgcgctctccttggcgtcggacatcttctccttgccgccctccgccgcgtcggccaccctgtcggccgcgtcggagactgcgcccctggccttgtccgtgagcctgccctcgccgccgtcgagggagtcagggggcaggacgtgcgtctccttcacggcgtcgccggggtacagcgggtgctcccgctcgtactcgacgatgaccacgcggcgtccctcccggacgacgtgctcgccggccgtggacggcggtggcgtcggcgccggcgaccacacgccggccgcggccagggtggagagcacgagcccgatggccaccacgttcatcatggcgagagcggcacgccgtggcattggacgaacactcgtaagcttccagttccagtgagtggagtggagggagctcagtgcgaagaagcataagctaccgcggtaaaagtgcattgctggttcgaccacgccgcctaatgacgggcttaaattcgcgcgctcgctgagccgccgatggttgtagaagcgcccggcggccgcggcggccgaggccgtggcgcgctgccgcggcgtacgcgtggacgcgccgcagtggatgcggtggcgagctcggcgtcgccgcgaggcgacacgcgtgggcgggacgtggccgcgcgtcgcgcggtttcggttctcgcgcgcgtgcgggcgcggccggtggaaaggtggggcggcccaaaaaatcgaattgggtgggcttcgtctcggcctgcaaaggatagcccacaaagcgggcccaaaccgagaagcccactttcactcgcgtcgtcgcgacgcaagcgagaaaccctactcggtcggggaagccaccagcccacgacgactcgcctggacgcgccgccgccgtcgccgccgccgccgcagcagcagcagccgccggagatggagatggaggacatcgaggacgtgctggggccggccgggatcgccggcggcggggcggctccggggctccgtctcccgctcgccgccgtcgccgtgaagcccaagcgtccgagatcgtccagggtcgcgcagacccggccgcagcccgaggcccggatccccgggacgcaggtgaaaccgccgccgtagctcgagctccaatgagcgtgttgctgcgtttccacgtttaatctgatgcgcttgatggtttcgttttgttgcagacgatatatgtgaagacgttcgggtgctcgcataaccaggcaagcttcgtccacatttatttctgcagaattttggcacgctagcttacagaatactgatatgaattatgaagtgctatatgattcgttaaatgctgttacttccactagcaaatgaagaaattctggttgaagtgctgaaacaagtagtgatccactgatagtgtgtggttctagcgggcttattcattgtgctgatgctaggaagccaatggttctgctgttgttagctatgtaaaataaccagttgatcattcctgctctgcagagtgacagtgagtacatgtcagggcagctgtcagcgtttggatatgcgatcactgaagagcccgaaggagcggatttgtggctaattaacacgtatggttttagtttctttcttctcttatttgtttctttccatctattacctcctgacgttcattaaaagtacacatgagttgaatttaacctgtgatggtttcaaactggtgctgctctggatttgtgttgtggaaaactagctacgctattttttgcactagaatatgccatgagctgtgtaaacttgggataataagcataaatccaacttgcagtgccgaagagtgagatatatattgacacgtaggggcaaaccttcaaattaacttcagaggtgaagaatatattgtgaccgacacctattttgccatttcagatgcactgtgaaaaacccaagtcagtctgccatgacaactctcatatcgaagtgcaagagtgcaaacaagcctttggttgtggctggatgtgtaccacaaggaagccgggatctgaaagagcttgaaggtattagcgttattggagtgcaacagattgaccgcgttgttgaagttgttgaagaaaccttaaaaggccatgaggttcggttgttgagtcggaaaacactgccctcacttgatttacctaaggtacaactcatatttctgtacatgatgttatatgtatcaatcttttatggctagtatagtgccaatgttatgtgctattacctttttaccactgacagatgtaatatactaatatcattcctgatgactgaccacagctacaatttccaggtaaggaagaacaaatttatcgagattcttcctattaatgttgggtgtttgggtgcttgcacatactgcaagacaaagcatgctcgtggtcatcttggaagctatactatagaaagtttggtacgttcatagatgttttgtttcctgtaggaagttttgcttatttatttaaatctcaagcatgaaaattggtttgctactctaggtagatcgtgtgaaaattgttgtctctgaaggtgtccgagaaatatggttgagtagtgaggatactggtgcttatggtaataccattgtccagatctttttggattccttctgagagataagccatagaattattatggcaatttgctcctctgactttgcgaggttttcaggcagggatatcggtacaaatcttccaaatctattaaatggaattgctgctgagcttcctgcggacagaagcacgatgcttcgcattggcatgaccaatcctcctttcatattggagcatttgaaggagattgctagtgttttgtgccatccctgtgtttattctttcctccacgttcctgtacaatcaggaagtgatgcagttttaacggtatgcttgaacttacagcaacatatggatataaaacccaaatataattgggtaattatttgcttgtaacctatctgtagtgtttgcgcctggccctgacttattccacaactatacatctcaggcaatgaatcgtgaatacactgtgagtgaattcaggagggtagttgacactctttgtgagcttgtccctggaatgcaaattgctacagatattatttgtggattccccggtaaaataaatatcttggtttagctattcaaccttacttaaagtgatcatttatgaataaccttcatctttgtttattaaatcattcaaagatgtcgatagtagtttaagctaaagtataatcttgccatttttcaggtgagactgatgaggatttctctcaaactgttaaccttgtaaaacaatatctattccctcaggttcacatatcacaattctaccccagaccaggtatctttttctaacttttgttttctagaaatattcttcatcagttttcccccatgtctttgtctataatgttgtttctttgtgttctgtaggaacacctgctgctaggatgaaaaaggttccaagcgttgaagtgaagaaaaggagccgtgaattgacctcagttttcgagtcattttcaccctaccaaggaatggaaggcaaagtagagaggatatggatcactgaaatagctactgatggtgttcatttggtaagcgtgtcattattgctggcaatcttatcatcgatggtgtttgtgcgagttgccacatttatagtcacataaactttttcctgaaattatcttttgctgcacaggttggacataccaaaggatatatccaggtgcttgtcattgctcctgatagcatgttaggaacatcagcagatgtgaagatcacatctgttgggagatggtctgtgtttggtgaagtgatagaaggatccgttgtagcaaaggaaacacagaagcataatcacagtgaactgcaagaagaatacaggccaagtcaggttgaggaagccacttgctgcggcacggactcttgtggtgcctgcacatgctctgatgcagcacagcaatgcaatcccggtccagagcgatccgaaaattcgacgccccaatcctgtggtgatgctactcatcaggaagctgttcagtctaaacttgtgagaagaaatgttgaaggagcggtgaaaagtagcgaaagtgatacagcgaaacaggtaggggagattcagcgactaaatgtagcagctaggaggttcccagatgttgatacgattctgtggggtggtttggccgtgagctttgccacgacagtaaccctcattgcactgctagcttacaagatttcttccacgccctcctactagtaagtctggtgcatgtgtaactgtagttgagctgtgtgttactgctcagttttgaccatttttctgtatccatcctcgatccttctgtttgccgcaaagatatgcaatggaactgtaattcattatctcaacaagttctctaataacctttccccccgacctttctaaataactagaagatacaattagtatttttaagattaatgatgaacaaggagagttggtgatctaactcgtaattgcgtttatctgagctcgaagaaaagccttatcttttcgcttatgcttatgcttatcaactaaaatttgaattttcaaccttaaatttagagcaaattttaaggtttttcatcgaagtttattttttaacctttgcttttagatcgctaagaacatgtatataaaagttttatttacaaaatactttcgtttgcaaatatgctatttcgcttattccgtaaataagtgaaacgatggctctgttctggcttcctgcatttaaaaagcaatggaagtagtcatggtgttcttggcttgcaccatgaaggatttgaacatttgatacatgcgttctttagaaactcgctacattccaggttgtggttggcacaggacggtctctgaaaggaccaagggattggagtgagcctctcaagtcatttggtagtcgtactagtagtcatttgctcaagggagacgctctgccagtctgatgaagtaatgatgatgagtaggagtacttgctagtccttttcttttaagaaaaaaaaaagagttattgcgtactccctccgtcctttaaaaaaaaaaagacaagtcacacataaaatactcaacgtttgatcgtccgtcttatttgaaaaaattataaaaataattgaaaagacaagtcacgcataaaatattaattatgttttatcatttaacaacaataaaaatacgaattataaaaaaatttaatataagacggacaatcaaaattgaacacggaaactcagggtttgccttttttttttggacggagggagtattgacaatgtccagattctagtacaaattatcaagaaattggatttcatctgcaattcatcatggccacaccaatatctgtactcgtagaagtacaacttttcggaaaatttcactttgcgtaactttttattaccgttgttttgttttgtactgtcttttaactaatatttttactttagattgggttatcttacctttattttattttggaccaccctaaagtattttatgtatatgcatccacttgtcatatgtcagaacaatagtttaaatgtattattggagttcagtgataaataggagccgacatactcgaaatcattcatatgaaaatattggttaaagaatgatctaaaatgagacaccgataataaaatattaaaagataacctaaactaaaatttacaaacttttatgttttttcttttgttctccttccctccaaaacgggttctgttttggatgttagcaatgccatcgttttcctttttgcaggaatcatatagtacatttatttatcgagttaactaggagcgattaagatcaaaattacactcatccagattcacccagttaacgcatctgatgggagtaaaacttgccaaacatcagaatttgcatgacaaaccaaaaacgttgttgcagaagtgcagaattcagtacaagaaaaggcgaacagcaagttagcaaggcagaggagtaaaaaaaaagatcaattatcagagccgggtttcgatcctgagacctgtgggttatgggcccaccacgcttccgctgcgccactctgatgttgttgtactaagcagcaaggaaacaattttgtcctgttcttactaaacgatcaccatagcgtggcaaatgccttcgcctgtagtactagcaaacacgcggcgaggcgagcaacgagccaagcgcccaggccgggtcaccacgtggcgttggcgacgcaaagccggcaaggcaacggccgctcgctcatctcacctaccaccgcctgcacagctcgtactactacttattactggtaagctcggcgcctctatatccaaatccggcaagtaattgttttaaccgcgcgcaggcaaatcctgcatgtgtgcatgccctcgcggtgccttcccggagtggacacagcggtggcgcgcacatgtcgtcgcgacgtcgattttcgattcgcaccgcgcgccgcatcggcctacgctacgtacgtcgcgcgtgtgtcggccactgggagagactagagagcgcgcgggtgacagggccgggcacacacggacgcagctagacaccgtagcttggctcgaactcgaaggccatgccacccacccaccccgcgcgttcccgagaacggaaaggccgcgcgcgcgcgcaaggcaaacggccgacgcgcgtacgtacgcccgcgcggcccgtgcatcggccattccgccccccaatccccaccaccagtgtgggttccacgtacgtctttgacggacaccaccgcgtgctgcgtgcatcgtgcggcttgcccttcgcttcgctttcgcgaatttccagctgccgcctgccggatgcatggccgcggcttcgcaggggagagcagtgcgcaccagggtttacgatttctaagatggccttccatttcagggctctggcagaacgacggtttctgtgaaatccgataaaaagccggtagattccaaacaaatttcataaaccaaaatttgaatacagattccttgagtttaccgataagctcgcgaaaatcggtcggctttgacgaaattctgagcgaaatcatcgaaatttcaatcattaactagaaaaagagataaactgaaattgtttttcttttttttaagttcgttattcttttatttcctacttcaaatttcagtaaatacacggaatacatcaattttttttttgaaaatttatatccaatagattttatgaatattatactatttataagattttatttgattttttttcttttatttatcaatttaaatttgaatttggatgaaactcatcgaaatctcagacagcttttactttcgagccttatcgaaacctcaaaattttgcggaattcgaccggttttcgttggaatcatgaaccctggtgcgcacccgcatcgtacgtttgccatcgatcggccgccccgccaaagatggcgacgcacccatatctcaggcgtggccacatgctggaagggatgaggaaataagagatgactggcctttttttctctctctctttctaatttcaaccggccgtcaatttaaatgtatatagtttaaggaagaaaaataaaccagtaataatttcaagtaggtttgtattacggctagtagttccatggagtatatataagagaaatatactcccctcttggttgataattcattcttatcgttttaaacaatgacacggtctctaaaaaacaactttgaccaatatttttcattataatatatataaaagggttaacaaatatataattttattaaagtactttttaagattaatctatacatgtattcaccatatttgaaagacaaatattttaaaaattattcataatcaaagattctaaaatttgatctcgactttatctaaaataacaagtattatcgctccagaggaagtacctatcttaaagtcatggcatgacacggcacaagatacgttttgagtaagatgtcttggtatgaaccttagtttagtgacttagaattgttgctaaccatgaatgccctctattactaaaaaaaggggtgaaatttgaagtaattccatattaatgataggttgacttttaaaatctgggcttttagtatttcttttctacttgctcggtaagtcaaataaccacaaccgatcgaacaattatcattacattttatcgatcatatggtctggtatgaactatgccgagacgtggcatataaatattcgaatcttaatccatctatctctctttagcttgatgcccaagtcagaacatggaagtagcaaccaaatgtagaggtcgcatgtatcatgcaacgtattagaatctgaatccattggtggagaaatgctctttactcctgatttagaaccttttgtagtcccggttttccaaccgggattatgaatccgggactaaagatcgctatatttagttccgatttaaatacatgagattaaagatcgatctttagtcccgattagtaacaccaaccgagagtaaagtagggaatctttagtccggttggtaactggactaaagagggggtagcggcagtccctcgaggtccctttttcttcttcttttttcattgttgatttgctaatggctagagttaatccctgtattttatgcacatcccgaatcagcatcctaaatcttaagttacttatacacactgacggagcgtggggctcctcactgggagaccgcgcgggcccccctttgccggttcggccggggacgctaggtgaggttctaagccctcgatttgtggaatgtttcgcgagagagcaaatgcacaagacacgggcgatgtagacaggttcgggccgctgagaagcgtaataccctactcctgtgttctggtggatctgtgtatgaaggagttacaaagagctggagagcaagagagttcaaactctagagaccctctccctctctctctcctctatgagctccgctcttccttttacgagctctccttttcttctcccttttcttttcctctttctccttttttttctttctcctctcttggtaggcatggtcctccttttatatctcaaggggataccacatacaccatttctacctatccttcttttgggtggggacccattctactttgaccaaaacatggctcatgccttcgcctcacaccgggataaccctgtccttccttcatttatgggcggagatttgcaatggctgctgtccgaatgaccctccgatgggatgggtcataccaacctccagatgacggaggcaggtgcaacgtgggagcacggttgtttgctgatgacgtgaccggcgtcagaccagtcacaaaccggtcattcttgtctaccacgcgtcagtttagcatgccacgcgttagcccttcttcataaaatgacttccttgtaatggttgcgatgaagcctggtatgaatctagccgggaccgacgtgctaactccaggagttcccacgccagctccgtctagggacgagtgcctagaggctctcatcattccgacgggacggggcgaggcgtgcgacaggccgcctgttgccacctaacccgcgatctgaccggtctgtgaccggtcacatgccgcgactggtcacaaaccggataagcatgcgctgcgccgcattgaatgcggcgtgacgcgctcgtctaacccgctataaatgtggttaggtgagggccgctatgctcacctaacccacacacgtggcgccaacaccacagggggttggggcgccccagccctcggggccgaaacgggagcggcccgacccctcggggagacagagggaggggtggccatgtcaccgtcgggcccgaccccctcggggggtcgggccacgtgagtgatcgcggctacccaagcctctagtcacgatacccccggccccatgtcaccgacagtagcccccggcgtcacgccagggcgaccgcccccctcgagggaggcgatcgggcgagatgccactccttaggcccggtgacaggtggggccggtccccacaggcgggcagaaacccaacggtcgcaaatcgcgcgcatcggcaagggagaaaccgatcgacaataatgagcggcctcttcaagaccgctacattacttgagtagcgcgcgaatcgggacgaaccggttcgtttcgcctagtgatgtgatgatggtgcatcggtcagcgagcgtagttaacgcgcgcacgatatgtcccatcttgactgccacggccgcacatccgcctcgtgcgccgcaaacgggcgaacgggattagtggaggagtgggcgcgagaaacgagggggcgagatagtgggagcgggaagcgaggagccgggcatagcgttggcaagggtataaagacgccgaggaagagatttgtttccttcctctcgccactcttccccttgccttcgccacttgtgctctgacactccgtttcctgcgccctacccttgccatactcactcgctctcaagctcctcctccgccggggagtacaccgggtccgaggactacatgaggacccaccaggggcgcaaatgggactgggaccctgaggacttcaggatagtggtccaacgggtgctgaatctcagctccgtggaggcatccctcatccctcaaggcgttctccccctctgcagcgatccagagcgcgctaacatcctgaccatcatgcaggcggtcggggcgtcaggggagcgggctcctcgaggccacgatggcgcgagcgggagccgcaggggggaacaatctacctcgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcacccggagggtgctgcgccgacgtcgtagcccgagggggagcgaaaaaaaaagcggctccgcaagatgggggggggaccgaaccatgccggggaaacctcatctcccccccaaggtggtcgtttagccgacctcctcgcaggttcgtccccgcgcccactgcggccgtattcattctcccatctcccaaggcaagttttcactcacctgtttttcgtcttctggtttttcttctgcctcagcgagatcccgtcgcgcccttcccgccattccaagtccggccggtctgaggccgaggagacggtgaccgcggaggcccggaggcgggaagctgaccggcgagaagccgcaaactgcctccgggaagccgaggaagctgcccaggaggctgtccgggctcgccaggctgaggaagccgctcgggaggaggccagactccgccgggccgaggagtccgtccgggagacggaggcggcacacgcacgcagggcggcctgccaagcccccgacccgactccacccgaggcgacaacgacttccgaggccgcccacgacgaggccgcgggcgcgccgctcgggcccgacccctcgggcgacgttcgggacgagcccgcttcgggggacgcccccgagttcggcacgtcgatcggtgggccgagccgtgcggcatccttaccgaggcggctctcccccacgccttccgctgccccactgagcgcggagccccttctgcaggccttggccgccgcgaacaccacggtgttggacgggttaagtgcccagatggaggtcctgcaggcagagcgggcggagctcgacgcggcgtgggcgcgtgtcgaagaggggcgacgctcggtggaggccatggtggaggcgggccgcaaggcacaccgccggcacgcctcagagctcgaggcccgtcgtagggacctggcggagatcgccagggaggtggaggaggagcgggagactgccctcattgccaccgccgtgttcaacacggcacgggacgacctctgcctccaatacgggagccgggcggcggagctagagaagaagctcgacgcgtcccggcagcgcgaagaggcccttgaggctcgcgccacggtgctggaggagctcgcccgcaccctggacacgaaggagagggaactggtgggtcgcgaggccgccgtcgccatccgggaggcaacgctggcggtgcacgaggccgcctgcgccgaagaggagtccgcactccgcctccgcgaggacgagctcactgagcgggagcgagctctcaaggaggccgaggtcgcggcgcagctgcgggaggagcaggcgcgcctcaatctggaaggcgcccgcgccgagagggccgcactggatgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctggcaatcaaaaataaacagtagcggactagcgggcctacggctccatcttcacaggcgttcaactggggtataagccaggactccacctaagacatcttctccaaagcttctcttactgaagaggggaaagattgagcaagaatgagtacaaccacagtactcagcaagccacaccggagatgcataattaatgcaagggagtacaaggggataataatataggggttaacttttgcagtaaacagcatttagaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtccctagccatcccaggacaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcaggcagaattgagccccctagcagcaggacactggccctgtgccatgacatctcgactaccgggccacagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactagcatgcacccaaaccccaccgaaaaacaggttttaggggctttgaaagaggaagagaggggtatgtccaattccacaataagccaaccattccatagtatccaagtgatatgagaattccccaagtctaaagttataaaaccacctaatgttgcgtaattaaacagcgaagcatctacctaaattcatactagtggaaccatgaatagagtgtccactagttggggttttgtttattctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacagaagctacgcgaagcacacaagcaaagctacaagcctataaagaagcaataacaacacataaaaagaaagcacacagttctttaggttataacaaacattaagagacttgaacgggtcgattcggagctcgtatgaccaagatatgatcatccgaagtttaatgctgttatatggagatttgcggattattataattaagctttgcaactataaaacatgtgtaagcgctagcctggaaaagacaggaaggctgcgccgttgacatgcggaccccacatgtcaacctaaaggaccgcggtaaactgagtacacagagacggtccacgggtcgacggaagcagatcccgtgtgtcaaccgaggcgagtggccgacaaacggactccactagacaccacacgggctgcacgcgtggaaaccacgcggctaccgagcgggcacactaacacggtcaccacacgcacaagcgaacgactaccgacaccggtacacaggtaccggggtcgacaaccgcacgacagacacgggcgacaccgaaaggacgaggacggggcagcgagggagagggatccttaccaccacgcgacgaggcgtgggaacgacaacgacgaacgggcgcggcggagacggccgggaacgacagagacgaacggcgaggggacgacttcagcggcgatccttggacaaaggcgagacgcggctggcacgaggcttgacgacgcagagccgaggacgaagacgacgacggggcctgcagcgaccttgacgaaacaccgaggacggacgagaacggctcgatggagggacgaacgccacgacgaccgggaacgacgagaggacgacgacgatgatgaccggggccggcgaggaggcgacgagggcagctggcagcggctgcacggagacgaggacggcgtgttccacgccgctgcaatgccgacgacagaggcggcgccgcgagatgacgagccggcgaggaggaacgatgatgacgacgacgaacaccggcggggttcggtcgaaggggaggcgaggccgagggcgaccttgctgcagcgatgccggaggtggagatggcgacgtcggccggcgcacgggcacggcggaagaggctgccgaaggcgacgtcgacgaggaggaaggagaggccggcgcgggcgacggcgttccggtgaaacagaggagcagctggaggagaggacaacgctgcgacgtcgatggaggagacggcgacgtacaggagccgaccgaagacggggaggtactggacgccgacgaggaggccactccggcgagcttcgggcgaggaggaggtgatgccggggatgagggcggcgtcgcggagccgagggaggtggtggcgacgtcgaccggcgctcaggcagggagacagaggcggctggaggtggtacagtggcggcaacgccactggacaacggcgggaacgcgcctccggtggtcaccgcgcgaaacggagggcaggccgggggagaggaggcggctgcgacgccgcggaaggcgacggcacggccggccggcgcacggtcgaggagggagaggcggctggaagcgcccggcgcggggaaaagagaagggcgacggcggggaggtggctagggaccacgggagatcgcgggaaggggctaaaacgagagaacggggcgagggggttccattttataggagaggagagggagccggccacgggggaggtcggaacggcggcggtaaaggcggccggcggccatggaagttggccggagttggcgcgggcgttcccggcgattgggggcacgattcaagggggaaattgggggcaactgaagaggattcaatggggattaaaaccccccaattaatttggaaagagccggcttgaatggggcggatttggaggaggaacggcgctaggtttgcacgggagagagaagaggccggctgggggaggaagacgggtccgacaggcgggacccgcctgccaggcgcggtcaacgcgcgtgggcgcgcgcgtgacaggcgcgtgcgcacgcgggaggagggcggctcgggcaggggcgcggcgtgggccgggcggccggcccaggaggagaggaggggaggggtggcccggggagagagggaggaggagggagtgggccggggaaggaggaagggcggcccaagagagagagagggaaggaaaaagagagggaggagggaaggacttcggccgcgggccgggggagagagagggaggctttgggccagacttggcccaaaggagggagagggattattcttaggtttttctttttaataaactttgataattgtttttgttgtttaataaatatttccggtgctctgaaaattcaagtaaaatttgagggctccttttagaccaaggagaatttaacaaaaattctccgggccacattcgaatttttctggcacgtattttagtgtttgccaatttcttttcgacttttaattaattctattattccttttagagaatgaattttatttcggaatgaatttatcaggacgtgacactggatcagcgggccgctgaattcgaggcgcgggcgaaggagctggacgcgagagcgcgcagcggcggggcggccgcgggcgacggcgacctagccgcccgcctcgcagccgccgaacacaccatcgccgagctgcagggcgcgctggactcgtccgccggggaggtcgaagccctccgcttgatgggcgaggtagggcctggcatgcttcgggacgccgtctcccgtctagaccgcgccgggcggcaggcgggcctctggggcgggcggaccgcgaaatatgccgccaaccaggggggcctcgcccagcgcctctcagagatggctgggaccatccagcggctccccgaggagctcgaggagacgatcaagtcatcctcgagggacctcgcccggggggcggtggagctcgtactggcaagctaccaggccagggaccctgacttctccccgtaggcagcgctggacgagttccctcctggaaccgaggatggcgcgcgcgcacaggtccgggatgccgccgaccacatcgtccacagcttcgagggtacggcccctcggctcgcgttcgccctcgactccgacgaggagggcgatgacggtggtgcggacgacagcgacgacgaggccggcagcccgggcgcgtcggcgtgagcccccaggcccccgccaatcttaaatagctttttctttcttcttctgaggccttcgggctcccttcttgtataaactaattcaatctgcaatcaaataaagaggaaatttttgtgtcagctctgtttgttgtgtgtatgagacgaggatggtctgtgccgcggtccttctgtgtcttggcttgaacgagggctcgtgcccaggtcccagcctcaaatggcgcgggtcggggctagtgcctggggagatccgcgtgtcgagactggccaggccgggaacgtggtgaccgagggttatggatgacccgattgtgggcctttgccgattctcccccggagttcaccacgccccggggcacggctcggttctgggccccgtttggcgattttagccggcccgggccaccgagggcaggatcgagcacgagcatgctaattcaagccaagattcttcgaaaggaaacaatggcacagacacagtccttaggaaatcgaaaatgcttttattgaaatacggaagaaaaaaatataagcttatgcatgtggaagcccccggccaaccctgcacgcccgggggggtgcggggttggcccgagcccgagacctgacacccgacccccactaggggtagaagcgacgaaggtgttcgatgttccacggattaggcagctctgtgccgtcacccgtggctagccgaacggagcccggccggggaacgccgatcactcgatacggaccctcccacattggtgagagtttgctcagtccagcacgcgtttggacgcggcgtaggacgaggtcgtcgacgcagagtgatcgggcccggacgtggcgctgatggtagcaccgcaggctctgctggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcctccgcgccgtagacgaggaagaaaggtgtttccccggttgctcggcttggcgtggttcggttcgcccagagcaccgctggcaactcctcgatccacgagtcgccgtgcttcttgaggatgttgaaggttttggttttgaggcccttgaggatttctgcgttggcgcgctccacttggccattgcttctggggtgggtgggagaggcgaagcagagcttgatgcccatatctttgcagtagtcaccgaagagttcactagtgaactgggtgccgttatccgtaatgatatgattaggcaccctaaaccgagcagtaatgcccctgatgaatttaagcgcggagtgcttatcgatcttgatgaccgggtaagcctcgggccacttagtgaacttgtcgacagcgacatacagatattcgaacccgcccggggcccgcctaaacggacctaggatatcgagcccccagacagcaaacggccatgaaagaggtatggtctgcagggcctgggccggctgatgggtttgctttgcgtggaactggcacgccctgcaccgccggaccaggtcaaccgcatcgttgagagccgtcggccaatagaaaccctggcgaaaggccttgccaaccaaggtgcgtgaggcggagtgggctctgcactcgccttcatggatatcggcaagaagctcgacaccttgttcccgaggaatgcacttcaggaggactccgttagccgcgcgccgatagagggtctcttccaccagcacgtagcgcttggagatgcgctggacgcgttcactcccttcgcggtcctcgggtagagtcttatctgtgaggtacgcctggatctcagtgatccaagcaatcaatctaagggagctgggagcgctcccctcgggtcccgaggcctggacttcgacgggcctcgggggccgttcaggcgcgtccgtctcccctagggggtcgggtcgcaccgacggctgggcaagcctttcttcaaaggcgcctggtggggtctgggctcacgaggaagcgagccttgagagctcgtcggcgaccgcgttatcccgcctgggcacgtgccgaagctctatcccgtcaaaatggcgctccatacgccgaacctggcgcacgtaagcgtccatctgcgggtcagagcactggtactccttggagacctggttgacgaccaactgggagtcgcctaacaccaggaggcggcggatccccagtccagctaccactctgagtcccgcaaggagtccctcgtactccgccatattattggtcgcccgaaaatcgaggcgaaccatgtatctgaggacgtctaagctcggcgaggtcaacgtgccccccgcaccggtgccttgaagagacaaggagccgtcgaactgcatcacccagtaggcggtgtgaggcagctgcgaggggcccaagctggcctcgggggcggagacgtgctcaggggccggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaagacgtaaccaccgtgacccgatgcgcctgaaaataatggcgcaacttcctcgaagccatcagaatagcgtaaagcatcttctgggcctgagggtatcgggtcttagcgtcccggagggcctcgctaacgaagtagacgggccgctgcatctttcggcggggccgatcctcttcgctaggggccgcatctccagggcgctcttcgtccgagaggccgcgcggggcgcactcggcttctgtgccgacgacctcggggtcggagggcgacaggcgcggccttcccgcagtggccccggggccatcctgggggtcgggggcacctggcaccgtcggacaaacgtgcgaagggccagctccggccgtcgggggcctcgggccgccgttcggctcgggggcctctcctccctgctctctcccgggtcgagtcgacacagggtggggatgcgcggggtgagggttgtcctcgtcgcgctccacaaccaacgccgcgctgaccacctgcggggtttccgccaggtagagtagcaatggctcatctggctccggggcgaccaggactgggggagaactgaggtacgccttcaactgagtgaaggcccgctcagcctcctccgtccagataaacggcccggagcgtttgaggagcttaaataggggtagcgtcttctctcccagcctcgatatgaaccgacttagaacggccatgcagccggtgacgcattgcacatccctaagcttgctggggggggcgcatccgctctatagctcgtatcttctcggggttggcctcgatgcctcgggcagagaccaagaacccgagaagctagcccgcaggcacgccgaacacgcacttatcggggttcagctttatgcgggcggagcggagactttcgaaagtttccgctagatccaagagtaaggtctcttggttgcgcgtcttcacaaccaagtcatcaacataggcctcaacattacgtcctatttggctacccaaagaaattcgagtagtacgctgaaaagtaggacctgcattctttaacccgaaaggcattgtcgtataacaataagttcctataggggtaatgaatgcaattttttcctcatcctccctagccatgcgaatctgatgataaccagagtatgcatctagaaaacacaaaaggtcgcaccccgcggtggagtcaacaatctgatctatgcgtggcagggggtaagggtccttaggacatgccttgttaaggtcggttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacctttgagaatttgataaaacagttaagtaattaaacaatattaatccaacgctatacaacatgccctgttgtataggcccaaccattctgaacaaccaccccggctgcacagttctatctccaaaccaggaatgtaccattccaaaccaggagctaaacaaattattaccagtttaagcatctcttacaatgatgagaggtgtgagactaatcacgaaagacattgttagacccgcccataaccgcgggcacggctattcgaatagttttactttggccagaggtgtaccactgtacccacaagacacaaccccacatcatgtcaccatgtgcctcaataccaccacggtacctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcattaaataatagtgagtcattagttatcccgaatgtgtactaatgtttctaagcagggctaagcaattatatctaatatctagttgaaccaatataaataaagctcaactagtcaaattataataacccatggtatcaaggaataaggtaatcaagaacaaaagggctataacaaacaataggttaattccacccaatgacattcgaaaataaatgcaatagttgaaaagaaacaatagctttaaataggatcaacatgctcaaagggttgtttgggatctgtgtgacttgccttgctggccttggaattcttcaaactcttcttctgcgaaaacggactctccggaaacgacagaatctaagcagaaaagagcaaaatcaccaaaacagcacataaacaagcatgaacagtacatgtggatatttttaatgtgtagatctcaattttagaaaaaattagagacttgaaccgactaaatcggagctaagatgaattagttatgaatttttaaagattaaaccggattaaaacacttaaatcggtttaaattgaattacgacgcaataatgaattatttttgaaaaggaaaaggggatttattgcgtcagcggctagggtttgggtggaccgggcgcacgggcggcggttcacgcgaacggacggccgagatcgatccatccaaaacggacggccgagatcgatcgggtccacggcggctcacggcggacgaccccgatgacatcagcgacgacgtcagcgacagcggcggcggctcggcggagaagacggctcgaacggcgcacgctcgccggcgaacggcggcgcgaggacgcaaacggagggcaccaagacgtagaggacaacacggcgaactcaccggtgacctaaacggcggcggaagaccaacagacggcgacggcgacgaggaggaagcggcgggaaccttcgggtcgacgacggcgaagctgctccggtgatctccggcgacggcgaaggggcggacgaggacggcgacaacttggcgagcacgatggtggtcttcccgagcgacggcgacggctgaaacgacggcggcgcacggctggagcggcggcggcgacggcgaagctagggcacacggcgctagagcgattccgacgactagaggcgaaggcgagggtggcgacgggaagaggagactccgggggtccttttaaaggggctcggaggcggcggcgaaggcccacggcgacggcaacggcgaaggaaagctcgggaagaacaaatccgagacgaactcgaatccaactctttccaaaacgatttagccaaagattccaaaggagaaaaggtagaggagatcccgaggatcatttcccctctttcaattcggccggagaaggaaaggaacggccggatttggaaaggaaacggcggcggcgcgaaactagggtttcggcggcggcggccgaaggtagacgacgactgacaggtgggccccacctgtcagcgagcgagggcgcgcgcgggcggcggactgggccggctgggtcgaggagagagaagagaggttttgggccgactttcggcccaaagccaaaagaagactttttaaaacctttttcaattaaaattatttcttaaatgcaattccatttattaaaaatacttccttagctcaaataaatcccagaaaaatctaggaattatagaattaagcaaagtatttaatgaaattttatctggcccaattttatattggaatttattaattaaaacttaggttttcttttcaagacttttaaaattaattctaaaaattccatttaaacaacaatttatatattttgaattttcagggtgtgacatcggtgtagtcgatgcacatccgaagcttgccgttcgccttgggaacgacgatcgggttcgccagccactccggatggatgacctcacggatgaatccggcctccagaagtcgcgccacctcctcgcggatgaaggcttgacgttccggggcctgccgccgcactttctgccggaccggccttgcgcccgtctgcacggcgagacggtgctcaatcaccttcctggggaccccgggcatgtccgccggtctccaggcgaagacgtcggcgtttgcccgcaggaaggagacgagcgcgtcttcctatttgccgtccagaagaccaccgattcgtgtggtcttggacgggccgtcgcccagggcaacctccttgaccgggacctcgtcgcacgtgatcatccgctgcctcggggcggctgggacggaggtgctgagcctctcgttgccaccctcgggcttggacgcggcggcgaggtggtccgcgcgctgctccatacaagcaagcgcgactttgaggtcgccatggacagagatggggccaccggggcccggcatcttcatctggaggtaggcatagtggaccgccgccatgaacttcaccaacgcgggcctcccaggaccgcgttgtaaggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccgaagcaccatccccgggaccttgatggcgtcaaaggctgcgggggaaaggatgttgagggctgcacccccgtctatgaggacacgccccaacttcatgttgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccgacgagaagcgtgagcgcacgctcctccatcgacggtggcgatggtggccccaggctcctggaaccctaggtcatcgtcgtcatcgtcgacgtcctcggcgggggccttctgcttggcctcacttcgccggttgccggagggagccgccggggccttgccctcacggcgctcctgcctcctctcctcctcccacttcctcgtccgctcagccaaacttttgaccgcgcggcagtccgtgaggtcgtggagggaggtgttgtgcacggtgcaacagggagcgccggcctccttctatttgtcgctcgcaggcctcccctttcgggtggcccgcgaagcgccctcgacggcgaggacgtgtctctcgtcgtcggaatgggccgacctcttcttcctcctcctgtcccgccgtcctgaccgagcggcggatccgggggcggccgaagctgccacaccggaaccggtggagttccaggtccaggcctcctccttgcgagccacacggtccgcgagctgaaaaagctccgcagtggtctggggctccttggaggcgatcttttcgagcatgcggttgtgccgcacgcccccccctgaacgtgtagatcaccgcgtgtgcggggatgcatggtatggtgttgcggacctgacagaaccgctgaatgtacgagcgaagagactcatcgtcccttcgctgtaccgcatgcaagtccgcttcttcatctgggcgcggatatgtgccttggaagttcatggtgaactgctggcacaaatcctcccaagagtggaccgacacgggcggcaagttcattagccaaccccgcgcctgtcccttcagggccatggggaagaagttcgccatgaccctgtcgtcacccccggcggcctcgatcccggtcgtgtagacctagagaaactcggccaggtcccgatagaggtggcggcgggctagaagtccgagaggcggaggaggattacaatgttggcagcggccctatgggcagcagaggcttaggaattcgacgaagcatatcctttcagctcgcgtctggtcggctagttctgactggacgacaatggatgaaggtggactacccggcggcgtgtggcatcggcttacttgaagcagatgaagatggcaccagtggagattcgctgcgataacgcactaggggcggtggcgactagacgactttcaatcgtcgatttcgactgtttcatgagagaatgttgggatgcagggatgtgttgaggttgtaggtttttcggttttttggttgtattctcctctttgctgaggtctgagtctcagtgctctcgtatccttttggctgtgtatatccctcatagatatagaggccagattaataaaaatcctttatctaaaaaaaatcggacacaatgaacataagtaatacatagctgtatcggacccacaaaataattttatacatacagtcataaccattatcagtggctagcaataaaccttgctcatgccctatacccatacccgcaagcgccatgtgattatccatattcatgctgatttacccattagagataggatttcatccccacaacatacctacagatataacaaagaactacctgatactagggtcatttacccacgatcaaacgggtttatagggcgtgattgccattcctaaccagaatgccaaccaaacaaattacatgtactcccttcgtttcataatataataatttaatattggatatgatattttatagtacagcgaatctggacaggaggatgtctagattcattatactataaaatatcccatcatataggttactatactatgtgacggagggagtaggttgttttttaaatgctcaacaacacctaggttttgatatatcaatagccgcactgaaccacatatgatagggtgggcgatcgaaaaacaagtactcctaccaacacaatggtcttgtttagctgggggaaatttttgggtttagttatcacatcgaatatgtgtacagacatttgaagtattaaacgtagtctaataacaaaacaaattacagattccgccaggaaactgcgagacgaatttattaagcttaattaatctgttattagcaaatgtttactgtagcactacattgtcaaatcatggcacagttaggcttaaaagattcgtctagcaagttatacgcaatctgtgtaattttttccccctatatttaatactacatgtatgtgtccaaacatttgatgttacagcatgaaaatttttgttttgagaactaagcagggtgtgtttggttgctcgcatcactcctagcctggcccgtgtgagccatccaggctctccagggcctgggtgagtaggtgcgaaagggtttgttcggtagatggtatgagatagtgtttgcttggttgtacaacggatgctgttcatcagagtttttgtttggttgattgcatatgggctgagtttggttacctcatgtttcttatgtggtgagattaccccttgcaattccatgaaaaaaaaatagggtgcatagcatattttaaccgacagttgagaactaaaattggtgaattccctacatcaatcatagcaaggcccaatcaaaactttcggtatatgttgaccggtcaggaaaaaaatgaaaatgaaatcaaaacttacggtatatgttgaccggtcaaggaaaataggaaaaataaaaaggaaaatgaaagaaaaaagtggatatcgtcgcccaatgactcggacgaggcgacctccatcgctgccacatcgctactctgcgcagccgacttccaccgctgctgcgatctctccacctcatttgcgccaccccgttcttccttctaccacgccagttgcagccctcctcagccacgctgctctccatattcccctccaccctctgtcgcttgctaccgttggtggacagatccgacggctgtgagctcgtagccgccggatccggcggtctggcgactagagaagggaggggagggcggtggcaatgacggggaccgctcttctcgctccatgcagttcgtcaccgtcatcggggatctagaagccgaagctcgttgtttttggaatctggtgcgtgggtgggagctcatcaagggaggaagcaaccggcgaggaagacggtgccgccgacggtgaggatgggaagagaaaggcaatggaggctgtggcggcggcgccccttgacctcgagtgtctagatacatcatcgacttcttcatcttccttcttcctactgaatcgtgtgtgagcaaatgtgagaaggtggtgaggggatgcaagccggccctgcctgcgttcctcctcggcctggctcggagaggcaattttgcacccgcccatcctggctcgctcctccgtccaggcaaccaaacagtgagctcgctgcatgcaccgtaccggtgcgagccaccgttgatgcgggcaaccaaacacatcctacatgttcatgttcaacagtcaaaatcccgcccacatagaaagctcccagacccgttctcatggatccacgtgatccgtcagcagtcatcagacggccagagtaccacccaacatccatccaagcgtcaaaacacccctgccacccgtcgtacgcaagtacgcaccacatgtaaaacacaccacaccaccccctccggaggcccccacccactgacaagcacacgtaaaacggaggcggatccgtttgcgccgcttgcctttgacacagggacagagagagagagagagagagagaggagttttgagcgcgcgtcccggagcagagtgagtgaagtgccttcactgttcggttcggtggtggtgagagtgacgaggagcgaggcgaggcggcaacttccatggagaggaggagttggcggtagattaactcccaccacctgaccggaggaggagacgaggccgccggacgagagggatcaacgccgccgcttcctgccgctgccgcgagcagaggcacaggtacgcgacgcccacccgcgcgccctcctctgctcgtcgccattgcagccgccgcaccgcagcgcgggttttttttttccttgcttgttcctggtggcatatatatgccgggggcggttaatttgttcccgcggtgaatacgcgcgggtttcgtttcctatcatcaggtggcggttggttgcatcgttgcgttatattgtgtgtgtttttctctctcggttttgttgatggataaggttgggggagggagatttggaggaaatgtgcgttttggtctaatcgggatgtggagttgattcgtggcgcgaggcgattaaggacgatgcgttgggtagacaagttcttgggttttttctttctttttttgttcttattattgttttggatttatatagtaggtgcctgatgcatttctgagctctctcgtgggggtcattgtgttgtgattctttccattggaatgcttatcatctgatctatgatttcagtgatgaaatgttatctgtctgcgccgaggtaatttcagataaaagaagaagaaaagggttccacactcaactcatctatgtggtgtggcttcagtgtgtttgttttattttaaaaaagattttaactttttttttgtaatagcaaagaagaaaagatttcaacttcttttttgtgttcctggaaggacgcaaatgcaactgctaccagcctatcatttctggttcatgattcatccagttcactccggttgcagttgccatttttagttaggcggctatgcttttcatgggtggactgacgtggtaaaagcttctatttttggatatcgttgtttatctcgtttggtgcttcaggtggccattttctgcatttcgcgactgacgagttcgggtagtgtctcaatatggcattattagttggaattgtcatgctttcattttttttttcagtctgcattgtcagatatggactgatgttgcactttttttttttgctctgatttttcttcatcatttctcattttcgtcttgcctttgtgaactgatgctcatatgtttactctttcattgcagtctgatcgcttcgatcatcgcggtgattgccggagcttggttcgacctgcattgtagtactcttgctgcttactttcgtaaagaatcaggactgcttgccttttgggttcaagctctggctagtaatcaacagaatggatgcgaaagacttggtggaaataggcatgaaggaggaggacattacaacaatgctgtttggaaagaaggttatcgagctgacggaagacgcatttgatggttcgaaagaagaaaggaagatctttgaggagctcttctgcagaacaggcactagcggagcaagcacccgccatccacgccgggatggaaagagcagttcactgagagatgcaagcaaagaattgatatcaactaacacaccttcgagctctgcctccaatcacaagtcggcgcgctgccgtgtggttgagtcttttacatatggcaacttatcaagctatcttgtgttctgcaacaatgacaaacaaaaaatgcagaagacagtgggctttccggatatggccagtgcttctgatctcgtgatacagtggacaccgccttccgttgagagggtgtacacccgtagggcagtggctcgcaggaaccaaagagcaaaactttgcagtgttcttgatctggagagggttgacattaccagtgttagacagcgtagggacagagggcagcataagtatggccacagccatgcagtgctttgggatcatctccgtctacacgctaatcttctgatgatggatgctgggtggaagattgatggcaaggaaagatgggacaagagtaaggttgatcatatttatgagtcacctgacaaagtaatgcgcctgttttctcttcccagggcatggaaatgctttggccagtggttgcttattaattcatccggctttggtggaaatgactacggtcggatatggttcaacatccatgactttctgagtgatttgaagaatacactgctatgcttagaatatgaagtccggctcccgaagcaatctctatcttttctcaaccagtggcagctccttgaccctttcatggcagtagtttgcattgataagaaggttagagccctgaagaagggagtagcactgaaagctgtaaacagcactgttacatttgtcagctgcatcgagagtgagctgtcaaatccccggaatgccgacaatccacttggtctaaaccattcgaacaattttaacagcacacatcccaggtcacggaaaaatcttctgccactgcttcaatctgatgacctcgatggaaattcttcgcgcagcaaacatccttctactgttggaaaacgtaaatctagccaatataaaatggatgaaagattgccaatcatggcagaaatacaagaaaaaagcatcagaagtactgctcatcgtatagtgatgggtctccaagattcaacagcttttcctggttcaaggactagtttaaatatgaaaaataagccttcatacagcaagtctaatttgacacagagcattcaagacaaatctgatccactatattttccacctaattattctcccagtgatcttgttgaaaatgctgaaataaatgatccgagttttcatgcctatgacatgatagaatctgcaaacgtggacaattctgcagatagtcctgacgagttgctcctaggagcaaacttactgttttctcacgaagtggacgagatgctccttgacgacagggctgcaggaa

SEQ ID NO: 67502 - DNA, 8898 bp, Oryza sativa
ctttcctgctcctctgttcttgtacagtttttccctcatctataatataaaaccagcatgctgtattcttcaaaaaaaacgtgtaacaaaagagaaaacgattggacattggctgttaacaaactgcaacatgttcagatggttcaaatatgcccagctaacatagcactcccctgttcaaaaatattttaaactccaatcaagattcaaagattaggtgatatctaattaagtactagattgttatattaagattagacgatatctaaacaaaaactagattgttatgttatgaaacaaaagagtagcattctttttttctcatgacatggaagacatgcaacaatacacatacacatcacaaaaacaccgtgtctcctaacacagaaagtcataccatgcacacacctgttcttttagataatacacgcctgttgagtgtcccctaaactaaataggttcttattggaaatgtacttacataatacaaagaaacgtatacagataatacatacttgtttagcgtatactatggtgccaaatctagttctagatagctatattttggaacggatgtgttatcagggtgcagcttcatacgaaaaatagcaatcataagatccacaccgacacaacctttatttccgaatcaccgaatcagacagcagtatatttttttcagaaggcatggcactattttacttttaattggctctctttaacaaagcttctctctcttggtgcccctgcttgggtgtagcgaggccgttgaagcgcaaggtggaagataaataggacgagtagtcggtttcagaagaacaaagcccttgtcttctgagaaaccgggcttctgtcctgagaaagaggcaaagtacgtttgcacagggaacataatttagcaaaacagaacaacgcaggttgggcaagccgtaagcaagtctctatgaattgacgtaccgttcatgctagatccagaatggctcctttttatgtgacgcttactgatattgctgtcctccgggaggtctagaacatctctcccaagagcagaagcgatcatcagatcagcgatgagtagaaacaacactgccaagacgagagcgactgtgttcttcattgttgctatgagtgctgggagttgttcttcttcacaatttatacccaatagaacttgttacctaggtggtagcttaatgtcattgaattggtaaaggagaagccccatttccatgtcccaacgagcaatgaattgtttagcattaaatgaacatcatgcagcatgtggggaacgagaatcaaaatctcaagctggggccatagagcaatagctccctaatttcccaacatgtcataataggccctgtttgaaatatgggaaatcaaaacctaggaaaacaaacaagaaataaaaagaaaagcatagaaagtatatggatacgtgtgtttggaaaacaagaaaattattgcgatggtttctaggacttcaattggaaattcagaataagattttgtggactggcctgatgagatgcggttctacctgcatagcaccagttatcagagggcatatcaggatgttgagccccatcgtggacgagtgcagtaacccagtctggaaagttctctccagtttcaccaaggtaaggaaggttatggcttttctttcttcttaatataaaaatatgcagatctcctgcgtatttaagaaaaaaggaaggtaatggctgaagttgcatcttgaagaccataaaaagttattttaaaaacatcaagttaagccgaatggagatatttcgctcaaaagaagaatgggggttgtaatatgaaaaaacagcatgtaaaaattgttttttacgataactgtggggctgaggtaagaccacatatcatgcatacctgggcagttgatatgtggcagccatcttatgtgtgatgtgtccctctggtcttctaggagggaaagaaagcatagaaatattttgtttaaattatcacaggccattccatggctgagatatacaacttctcattggattcatgtttcaaagaagtgtatctgggtagctattcactaacctggctataggcaccaaatggattcactaaattgaatgcatgaaagtgaagcagctcaggatacccttccttgtcaaaagccccttgtggaatcaagaaggaactgaatagattgatgaaacaacgatagaagagactgactcccaggataggaacctgtcaatctgtggagattgagggcagtcaacattcagagagagcaacaaccatgattccctgaatgaaatccaagagctgagtctgacatcctcttcaatttaagttgtctataaaacagatagctaacgtaggtgcaaatttaatgcacaaaactatcactgtagcacgtgcctgtttcaggtgccagcattcttgctgcaatgacagcatatcgatagtaattcacttggttaataaagaggaaagctcttagtctagaaaaaaaaattaagaatatttaaaattgctacgttaaataccaaaatattcaacatttctgacagaagtagcctcataaacgaaaactaatcaaggtgaacattcttgaatctggacataccgaagcatcatagatcacatggtcacattgtagagtagttgcactcttgaaagtgcattcatgtttcctccaagtgtgcagattttatttagtgtctcaaaaactaccaacacagtttccatgtgttgtcaagaaaggggaatgtgtgtttgtgtttctccacatttaggagaactgattcttgatggtaattgcaactactgagttaaagcagaccttttattccatgtcctacggatagaatacacaagttaagaaaagtctgttccaggccttattccttctgttggaactcaagtggatataaataagacatggtaccaggtacatctaattttacctgtaatctttgagtcagacagactgttggccactgagtatttacctgggatcaacataagacaagacagtaaggacagtctgtgcaacagtgcagaaaagcacgataacaccagccaaccctgccacggccagccaagggttactaagatggttgtgcttcaaccatgcaatccacctgtgcagacgattctggtaatgtgcctccaaggctaaagacaggggcatgaggtaataattcccatagaaatcaaataccacacctttcgtcagcttcgtaaagagctgcgatacatctctgtcagtgcgcaaatggtgggcaatgatcccctttctagccaacagtgctacatcatcaggcatgttcataagcttagccatgaaaataacataggcagtaacatcgtttcctacttttggacatgtttgctccagcgctacaaagttcctaaaaagaaagctggtgctttcatccacaagcaaaaatggaatttccaagacagcatctctgagctttatatccaggagagaatggcgattggactcgctatatgctctcctcctaaattcaatgccagcttcatgatactgcgatgcccggcgccaccgatatggaaaatgaccattctgtgacgaacctaaattagctgcctcctgcttgtaagtaagatgtagataatcccatcctagctgaagaaaatgacgaatgtggtgccccgtatgaccatgatgctcatcctggtttggactgggtctgacgtacatatgacataagtgtaacaaatgatcaaaatcttttggacgattggattctcttattgcttttggataacatggtacaaactgttcaatgcattgaacaatactccttcttagtgcagtagtagttgtcaatttacttgcaagttttgaaacaactatctcgtgtattccctgaattacaaaaagtgaaatttggttctctaacaggagcaagtcatgtggaacaaacatgccataccactgtccaatctgctggctggggtcctgatactggccactgatttccgaagataactcaatatcagagattgaatattcttccatagagtgcctgtcatgatccaattgagtgttcttcatcgcactctgcttccccttgtttacttgttgactttcatttctcccagttactttctgatgatccccaaaactcaaagctccctcaaatgttttgtcattcgaaggagaaggtatatatctgagggaatcaggccacaaaaattcattgtattgacttagagagacaagtacaaagcatccatcaagcaagagagtctgcaagaactttctcttattcattttaatatctccagaatagcatgaccttgctcgtttttctagtctgtttatgatggtcaagtaatctttcagacctttttgacagcttaacttaaggatatagtccaagcagttccatttttttctctccatgaaagaaagtgctgaagacccattgtgatatgggccaatcgacaaaattagtggttcataagaatctctgtctatcatacggatatgctcatggattcttggaatcaagcagaactcagatccatcagcatgcacagtatccaatgacatgtattttttcagtttatccttcattgagttacccagctcctctatctcaacatcagatataccgtcttccatttcagtcattttctacctctcctaaaagcctttacatttccttcttaactgatcgacagagctcatgccttacattttagaaaagagaatcattacattagtaaaatcaatgtaatggaagaagcccggattacaaacaagtggaggtatagcttgaaggagagattctgaaccctggcctggcacattgaacataagctagtaaaaattttccaagagtgaagaagaagacgagcttgccgttgcgaaaattgtagagtggaggctagttgcaacgcatccgaaagataacaacaatagccgagggaaacaaaacaagtgaataaccctaaaacattactacctcgtacgaacgagaatagatccacgaaaagttgatcgattattttactttgttcacggtgagatccgacagaatgccgtacctcgggacacggagcgagctccagcggccgcgggaggaaaaatacgccggtgggaagtggtcgccggtgtccggagaatccgggaggcggaaggtgatcgaagatggggtgagggtagtggaatgcggtggacgacagcgtcggagggatcaatgtggtgggagactttgggctcctttgggccgggttagccgggccgcgtgacaagggacccgacatgaccgggttttggctgatgtaacgactaagtggctccttttaactaagttttcgtgtcacgtggcattgacgtagcacttacatgtcaatttaacctggaaaagtaattaaaaccatagaacctacatgtcagttacacatacaaaataataatagatagtggggcccacatggtcccacatgtcaccatcacattcccgtcttctctcacccatgccaactcgccacttcgctaggaggcggagcggagcaggtggggtgacgtgcgggcaaagccggcaaacgggtggagtggctgatgaggatgttaggtcccgatcttccgataggtattgataaatagtcgatttgggcggagtcgagacacaactcgattcggcttttgaacgaacacgctcttgagccccacaatcgcaacaccacgtctcctctgtttatcaaccgtgccgaaacccagttgacctcgccgagaaggctaatccctgcatgcgaatcgaagaacacaagcaagaataacatagattgcaaaacaattgcatatgaatgattaagcactcgaatttggggtttcacaaaccgatctagcggcgaaactgttcttgacagattaatctaagcaaaactccactccaaacaatgacggttactgaataaatattattagggacgtcctagggttgtcctagggcgcacacccctatgggctaagcccacgacacaattacaaggcccaaaactcaaatcagattcagactggatgaggtacatgacttattttgcagattcccaacagctcggtaggaattttgacgtgggaccaaaaccatatgaaagtggactccataagctttccaacaagtactcatgggccacgatcgaaattccttctagatgagcggctaggtccgtttgaagttgatgctgtcaggaggcccgaatcctaatccaaaacgtatagaactttatctcttgtcttctatgaaccaaaagtaacatggtgaggtagaagtagacttggagaaggtcttggtttggtctctaatcaatttctttaatcatccatgtattccttacgcacggtctcttttctttcgcccaagcaagtacctctgtaaacgaaaacatacaaaactcatttgtgtagcaacgtttgttcaaatatataacaagtaaaactaatatagaatatatacacctttggttgattaatacataaggtagtcatggttatatctgagctagttgtgtccttattagtggcggcggtggacagagcagtccagcggagccgagcgggcgacggcgagcgaaaccggcaggcgggtggaggagaccagcggagccgagtgggtggcggcgagcgaaaccagtaggcgggtggagcagaccagcggagccgagcgggtggagagctggcggcggcggggtgagtaggccggtggagccgagcgagcggagctgtggcgcgcaaagccgggcttcccgccaacgggctggcgagctcaagctcgtggcaggcacgaagtggaggattagggggtgctgcccgtgctcgttgccgttgccgtcctcctcaccatgctccaatggccgtgaatagagatgcacagagggaggatggcgctcaatattcaatgacaagtaatttctcagttcatccttcattgaattacccagttcctctatctcaacgtcagatatactgtcctccatttcagtcattttttaattctccttaaaacatttacattagccacacgcaaagattaaacagcaactgttatgacaaggtggttattatggtcatatggtttatttggttggttcagaatggcaagatttccaatgggattgatgagccattctttcaagcatggaaatatcttttcaaggaattttccatgattatccgtagagtgcaagcagagtaatttctgattattgagaaccactccctccgttacaggttataatacgtttttactttgatcgaaatcaaaccgattaaagtttgaccaaatttatagaaaaaagtagtaacattttcaacccaataaaaatttattataaaatatattcaattattaatttgatgaaactaatttaatattataaatattactatatatatttgtctatggacctagtcaaccttaaaatagtttgactttgaccaaagtcaaagacgtcttataatctaaaacagagggagtagctaactagcttgccgtgattttattttttaatagccttgcatattataatttcttaaatatattaatacactaggagtcgctcttcggaaaaatcatttgaagtatttagattgaatacatcaaaatcgtaagtgtagatttatctaaaaaaaatcatagtattatagttctgtagggtactaaaaataaatttgcaatataaattagcggtcacaatattatattccgaggaccatgctcatgttgtaatccacatatacttgtgaccggatgggtatttccaatgagctaaagggcataacctcccactttttggaattagttgtgaactaacccccaccatcttcaacctcggcatgcaatgacattcaaatctatctccagcataggcatgtcctgttgtggcgacctttttagctcacctttggtgcgtccttgattcgaacgacacctcccacctaggaggagagagtcactttcacgtgttatgatggaaagatttcctttcatgttattcagcaacttcaccatgctgcagcattatctgatcgtccaactaatcgcgattaatcgtcctgatcaattactgtgatgcacaaaggaaagtttatgcagtttgcagttcagtacacaagtactctgttgtaattgtaaatctccctcattactgtacttggtatataacattcgaaagattttgggatgataaatttgcagaagaaggcaagtgtgggggtaatgggagcagagtgaaggagaggttaagccaaaattctggtgaagttctgattgaacagaaaccagtaaattttcccataaatcacacaatcacgtatgtttgcaatcgtcaacaatggcatgcatccccggatgacagagcattaacgaattaatttcctgatatctaggcgttccaaaagcgctggaacaaaggaagaaggcgcccttgtattcgttgtaaaaatagcagattaatcagacctgacgacgcatccaaaaaaaaaaaaactcgctaatacctagcgaggatcacgggaaaacaatctaaaacaccaatcactttcttcaaggcgcactgcgacagaatgccgtacctcggagaagcggaggagatccgtcgccggcggccgcagcagcagcaggagacgccgttgcggtggaggcggacggcaacgtccgacgatgtgggggaaatggggatggcgagagacactgggaattggggatggcgagcggcggatggaacaagttcacctgcggtccctcaatttgttgctgagttcgaaattcgtccctgagcgcagaacaaggtacaactcatcgcccaacttacgaaaccgtgcaaataaggtccctaggcagtatttgtgtccggttttggttgtcgtgg

SEQ ID NO: 67503 - DNA, 9760 bp, Oryza sativa
ggcggcgcgcgaggtgtaggacataaataccggcacgagacggggttagcgtcgcgagaccgagacgacgattgctactaccgtgcgcgcgaggaaagcggagttggggcggtcgatcgatcgatcgatccgcgggcgatgcgatgcgacgcggcgacgcccgcgggcggcagatgggagagggcacggggcatcgtcgccgccgtacgacgtgtttacggcgacacacgatcgcggggcaggcagcaggtggcgtctctacacgaggtgcccgtagcactgtagcagcagctagaagccggcagccggggggcgtcgtcgccctggctgattggtcatatgctgcattgctgcctcgtgtcaaatgcatgcgtgcaaaaagaatgaaacttgcgtgtgtgcgccggtgcaaataactcggctgcctactgactaacgggcagccatggatcgtgccaaggaaacggaaagcagtttggtgcattggtactgtaacaaactactagtagcaggaggaaaccacgagatcgttggaaggcagcgggtagcagtgcaggcgcaatgtaaattatggtcaggtgggggtagtacgtataggagtagtaggcagctagcggtcccggtgccggcggcacgcgtgaatgcgtgataccggtgtgcaggggaggggaggggagggggccggcgacgttccataaataaccttcacctacttgggcggcggcagtgcagatcagatcactctatacgtacgggtgtgggatcgccgggttgccagataaacggcgagacgcatttggaggtcccttggattaaaatgggttaattgaattcatatattaaaaatttacaggttttaaaaatactattactatgtactccctccctacaattctaatattgttgacgttttgggatagaaaccaaagtatgcaatttttttgaagttttaggccctgtttagatcccactccaaaatttaacaccatgtcacatcgaacgtttgaacacatgcatgaagtattaaatataagctaaaaaaataactaattgcataaattgcggctaatttacgatacgaatcttttaagcctaattgttctatgatttgacaatgtggtgctacagtaaacatttgctaatgacagattaattaggcttaataaattcatctcgcagtttactgaactaattagttttttttattagtacccgaacaccctatgcgacaccctgtataatacccgatgtgacgcttcaaaactttacacccctgtatctaaacacccccttagtctctgcctaagccctgtttagattcaaacttttttctttaaactttcaactttttcatcacatcgaactttcctacacatataaacttctaacttttccattatatcgttacaatttctttaaacttccaattttgatgtgtaactaaacacagccctatatataaagaacttacttgctcctgcatgcatgcatcccattacttcagagtgcttcgtttctcgaagataggttccaaaccacctaggatatacaacttgttgattccaattagcacaccggcacatttaatatgggtaaagtagaaattaggcatataataaatcattccttggtacgtaagattatgtctaaaacgtcaattaaattagaaccggagggagtatctatttatagttatgctattaaaatttaatggttactcaatacattcatcataatatttaggtcattttgttctcgtctctctgtttttccctgttacctctctctcatttctagtgaacccgacctgatgaattgatttggattggtgcccattaagacctttcctaccgccggctatgtcactacgctgcaaaacaagatatcttcagctgattttgccgatgcatatggtagagaaggtgacagacaggcaacgggcatgcatgctgcacatggcaccaccgcagctgcggtaactagggttgaggaagctgaagagcatcccctgttagtacaagtacgacatgagcgtgcattgccagatctccttcacctccgcctgcctgcttgccttacagctactcgtgtgtgtcgacctcacctgtcatcacgatttctcctaggaaatgcacagcctctcgccgcgacatcccccgccatgacactacctgtcactccttgccgcctcaccggggacccaggcatctagcgcacgtcacaaattttcaagagaaatttgataaaaataccacctaatactcgcaatttggttatttaccacctaatccgtacgttttctttaatatgcaactagtattgcaaattgctctattttgataccattttttcctttttttttcttctcgggttgttggacatttttatccctgaccccacatgttgtatgaaaggaggtttttattacacatcgatcgatggaaaaatatatgatggaaacttagaaactatcgttggatcaaaatatgtacgtctaagatttatccacgtcatcactgagtaaaaatattactcatgagtaaatctaagaataaaatttttagttgtgatgacttggacgaatagcatccatttttcgattcatttgcactacacatgtggcttgctatacatattttccctcgatcgatccattcaccgctcccgcgacgccaagcgttcgcaccagcggcaccggtctcgccgccatgcgcccaagccgccgagcgctactccagccaccggcccatgccccatcccgcgctgccgtaggtacaaatttataatggcatgggtataattaacctaaaaaagcagacatttgtaggaagtgcagactgcagacgggtaagaaccctagaccagatcagagttttagccgaagtgcgagaggatagagggaggcggcgcgatcattcactaccggagcaccccttatgtggggcgcttccacggcttcgtgatgatggcggctagggctagggccaagcgtaggtaagatacagatagggagttctttgttgatgggatcgaagagatggaggaggagggtacaactacaatgtcgatgccgtggccatggattgtcaaataccatggtaaactttaccatccataacttgttatcatgggatttgatctggaaattgtaacctaatcgatgcaaaatagctaacgggcaatcgatcgcccctagcgcgcccccctcttctccacgtggtttccttttttgcaccacattacttttcaattttagtaaatttatgcacctaaagtttgtacacctcaagtttacatatctaaagtttagagacccaaagtttataaatcaaaagtttatatatccgattcaaatttgaatttgaattcaaatactttttatatatagtatttctatacatctaaagtttatacacctaaagtttatagacccaaagtttataaatcaaaagtttacatacccgattcaaatttgaatttgaattcaaatattttttatatatagtatttctatacatctaaagtttatacacctacagtttatagacccaaagtttataagtcaaaagtttacatacccgattcaaatttgaatttgaattcaaatatagtttatagacccaaagttttataagttaaaagtttacatacacattttaaattttaatttgaattcaatttttttatatatagtatttctatatataaattttttcaactttatttttttaaaaaaaaattatggtgtactgtagtaggaagagaagaaggggaggaggaagggggagaggaagagcgtatagggggaaggacaggtgatcgctaggaggatagggaagcaatcacccgcccactagcaatatcctaatcgatgtatgtattcccccgatttttttttattttttagaccttttaatgctttgattttattaatagactttctaaaagtatttttaagaaataaaccttttggccacgcctgcctggcagtggcagggtggtttggccatgccagctacagtgcgtggcagacaccggctgcgtgtggcgtgagagttatttgggcaccaaaagaaagattcatttcttgaaaatacttttagaaatggtctattaataaaattaaaacattaaaaggtctaaaaataaaaataaaattatattcccccttcacccttttgttcgttattgatgaaatcttagcgtgctgatgtgctaaatttcttaatgctccttgactttctattccgcccatgcccattaccttttcctgttagcgactatttccttaattgtttttagtcttgttagggcatgtacaatggtctttattagcggtctctttttattgtcatgcaagcatatttggtgacgtgaaagagagaggaagaaggaaagagaaagatagttgctacacatgacaacggcatagagtcgactcttaacatttattagaattttttttgttgcattaagtctaataaaggaaagataactagtaagaaagtattttggtacattaatagttagagaccgtattgttttaactattgtaaacgtgatagtctctaattaatgtaattaacgtaccggtctctatctttatacttgcccttataatatttttgatgatctgtttggcaaacatgataagtcaagagcttaccatgtcaatgatttcatctttttttttccctttttgggtagtttgtactgtttggaaagatcttttggcgcgagcattgggatggaacaaactcttgctcacaaacttgaatgggacaaagatcttatcggtatcgataacagatcacttggatcatttcaatttgcgatacggtagctcatggcatttacctatatatggtcttagtgcatttttatatttttgaagaattccatctatttttagataatgtaccaaacttgtttttggaaaacaaaggcgtaagctctgccttagagatacacatcgacggctcacaccgaaaacaccatcctacaagaccaaacttagggcccctttgaaaagcaggataggaaaaatacaggaataggaaaaacgtaggaattgaagttgtatgtttttccaatcctacaggaattgaaaacataggaaatggagagaagagccatttgattacaccacaggatacactcaacaaaggaaagtttcacaagaggtctaacctcttgcttattttcctatggaattgatcataggaatacaatcctatggaagttttcctatcctcttcctatgaatcaaagggctctataggaaaaaatccttaggaaaataaatccttcaaaattcctttgctaatcctccatttcaaagggacccttactctcaaaatgcaaacacggcaagcatagctcaagcttttgcggtcttcagtcttcaccagccagttctgctctcataagcaaaaaccgtgtactagaacacgtggtgataaaacttctttgtgcataattttcatgtcttagctcactattgtattttttaagagtaattcaagcttttagcaagatgtacgtatatagggcatttagtttattgtggttactccatcgatgttgcaacttgtaacataatctccatactggtggtatggatgaatagtgctatgcctgcatgactgcgtcctttgcttacctggttacttcacttacccttttagcacaagcaagaagacaagattacacaagtcttcaacttctagcaatgttgaataaatgctggtcattagtcgcacttgctgcgtcacaagtatatcatgaaggaggcttcaatgcttcaaagggtaccaaaaaatagcttccattgaatgagatcagatttcgattacatacaggcaatcaatgaaaacgctatggccgacgactgctcgccttgatcagcaaaactgcagcatgctaaaatggtatttcccagctgcacaagagctctatttcgctaacaggaaacgacaccacaaggttaactcatctaattctatagtatgtacacggtgacatgggatacctatacacgggatggggctaccaggtctaaatgttagttgccaccactatctacaagcatcgactagaaaacatccagagtcatgcacggcgatcaaatgattctgatgtatcaacaccatgcctgctgacagaaagattgcctttcctgtcacgttaggaagcaatcaagcttatgcggttgcatgtagcgtctgatgaagcccagaatgttcaggttcaagagcagagctgctgcttcatatctcccaggtaccggcatattgctgcagcaaacacctgaaatggttgcgaggtcagttagctgaatccctttatttgcatccgaggcaagctttttgcaaaaactaattccagtttggagccggactaaagcattaaagtagcactgcaatattctcttgcactgatcgagtaggaagcatggaactactcaaatgttttacaaggatcatctacttaccattatctgatcctcttgaacccacagctggaatctgcatcacttgaaccccaaaggagcctgggccagcaacagcaaggcacagctaccagcagcgaacacatctagtatgaatcttgcattaaacagcttctagcttgattggtgcttttgtaaaaactgataaaacaaaaggtgcttcctctccaggatggatggttgtgggcacaattgtgtatccttttggataaggctccaacactaattcacatgatatctcccttgagttaacataatctgttccacccactgattcatgcatgtagatattgtaagcagcacggcagccccgtgtcttgagtatcctcattccaatgtaaaacatagaagagtcatggctagattgatagttccggaaaccatttgtctttctagaaaaaccaacaccctggcaaagcatggaatttgtttatatcaacatcatagtgaaatctccaagtacattaacattcaggatggaatatacctgcgtaagggtaataaatacatgtacaggatacagtgcatcccgtcctgttactctaagccggtactgaggattttgatgccatgagtcataatcttggcaaccacctgcactataaccacgccattggccatggacagagtaacgcatctcgggtggataaacacgacagacatatattgaccgaaagtggatctgaaaatcttgccaagacatccagaataccccattctttgactgcaaaaacaaatatgggtagggtcaaaactgcacacggaaataaagttgggaaaatatattttgtttttgtaggtacaatgccttaagctgaaatcaacaaactggaggggtgacaatcaacacatcggtttttttctcattctattttaaattaaactgtagtgtgctcactcaagagcacagtcaacgagataagcaacagaccaacaattttatcatgctaaaaggaaccagtatttggtgggttcatctattaaatttgacgcagttgtgtatctttctaatcacaattagtggaataccagctgttcaagtacacggtcacagagaagagcaagtacctgtggaacatgcttaagtttgtgcttcattcgctcagtccactcttgtgatgagtctgaccacggaccattccattcaacttcatttgcccacggatttctaatttgcacgagcttatggccatcaacttctcttacctgtaacatacaatataaatttgtctagcgcaaaaagaatgggaactaagtgattgccaaaagatacagacaagtcagagcaaacctgcaaaattgagtaagcatgtccctgaacaatgccacttgatgaaatatgagcatccgagccagaaggacttccagcaccaagaagaaagccctcttgtttaaaatgcaacaactgagaccacaatcttccactagcaagatcaatctgcgcttgggggctccgcatgtcaatctcttcaccagctcctcctgtgagatccactagagcatcttgcacaagcccaccctccaatgcctcataagagccatgaagctttgcataagctttttcaagaatggatacccacagctcattttgctttctactagtagcaaatgccggtttccccggagactcacaggggatccaatcatcaaccaccactgccacccattcaccctagtaatttacagaacattgaaatataagctcagatcaaactggtcaaagatagttcttcacaggacaatctcaagtcttttttgtgttggtgggaaatactccctccttcccaaaatgatcatcatatatgtttgtgcaccaagaccaaggataatttaaatcacatcaatcaagacaccatacacacattctcccacaatgcatgcatcgatcaaaacaccatgccaattacacctagcatgcacacattctcccatgctgcattaattgtattctgataaaatccgcgtctatgcggttatatgatgatcaatttgagaaattttgaattccattacatgatgatcaatttgggaaggagggagtaatccacaaggtctggtgaatatgagctatttatactattatttcacttttatcaacttacctttgagtttcatcgtaaaatttacaagcatatactgcatatgtaagttgtgcattagtgacttgttcactcatggttttcaatgttgtttatgcagggcataatgcacatgtgtaattgtatatattgtgtcattccatttgggaatttccctaaaactcgagcaagataatggtatgcattatgttcttcatggtggtatgccccttactagggtctcgcaatgttagcatttcagaagacgttggcattcttatatgcaccctatggaatatgaatagcaaatctaaagtcatgaatcccatttttcttaattaaagcatataggttgtaagcctatgtataaatatatattagacagctctaacaactgtttatgtatttatgtagtatcaacttgtccaaattaattatttcgaactagcggaatttatccaaactaaaatctgcaagtcaaggtttcactgagcctctaacagcactattaggtagcacacatatccaccatagctctagtaacttgtggctgttgtattatttctgattagaacttctttcccacaatgcagaagaaaatggcttgttgatatatgttgaacacaaagtaacaaagagaatcaacttgcagctcacaaatctgttagtttgcttaaccaattcaactttgatatttaactctgtatgagactaaaatgttaaatctcaccaagatggtgtgctctaccaatatactttaccaaaggaacaacccaagaaaatggaatggaggacagatgggtcagatcattgaatacctggatacagaatctgacagtgtaaatcccttcttcattatactcaggagtgattataacttcagatatacgggccatctctgtcaaaactgcaacagcgctcaagaaccaacagtcgcccaaccgaccctgaaaagaacaatcggacaaattggattgtgtgtcatgtataggaagatggaaatgtataaagttgaaattctagtataggggaagaccccacatcagcacaaagcaaaatctgcgtacctgacacacatctgacgaattcacagaaccagaaaataagcacggttgtgaactgatagatacctccttcgcaatatcagaaggcctcatccactcagagacaa

SEQ ID NO: 67504 - DNA, 25745 bp, Oryza sativa
cctggtggcatcgactgtggtatatggcttataattctttcactcagtaaagtcgtcctccaaccacgatgccacatttttaacaattttatccttttaaaatttataagcatgtctctataaaatttattctagacataacccaaagctcggcgtcgacgatccttgtgccaagttttggcgctaggttagggccaatggtgacccttggcatggagctagcatagatgcgggtcgacattagtctcattgacaccaacatcccacaccttcggtctcacacatactcccgcttatgaaacaaacacttcctagggtttcattctgaactctaaatccaataaaaatgaaaatagattgaaataagtggagaggataccttgctttgtcaatttcactataacattcaatgctacatcaataggatgtgtgaatagactggttgaggagagagggaatttgtcccatctcgaaggtaaagttccatcccaatctcaaacttcatccaataaatagaaaataattttgaaaaccaattttgctacaaaatcaattgataaaataaccagatttgaagagagagaggagtcagtcccttctcggaggtcagcaccaacgacgttgtctcaattggatagaaataaaaaaaacatacaaattgaaatgataatttagttttgtgccgaccttagcgtcaaagagacgggtgccatgcaaatgtgtagggcggtattgcggccacgatttaggtgccaagacgttttcgggcaatagggtcctaggcaccgtgctatcttttttttatatttttttataagggcttagttgtaaaaatacagcctttttgccaaggctaagggtgtcttcggaactatatgttgtcaacttctactcccttgtttttcttaagcacatgcttctcaaacagtacggtgtgctttttactagaaaaaatataggaaagttattgttttaaaaagtcatattaatccactattaagttataatagcatttaattaataatgtgctaatgagttaattatcctattttacgtgcgtagggaagaagttcacaaccttctatccgaacgtttcgaacgttttggagccagcacaacttctcttgttctctgtgacctttgtgtgttttggacctttggtactactgcacagtgcacattttagcagaccccatctctcaaaagtaacagcacaaaaccttatagagatattggagatcgaccatgaatgacactaacgaaggtatggcaacctaacgaagaagcatattctacccttgtagagtgctgattgcttgaaattaatatatcgaacactgcactaatccaaaactagcgtatacatgatactaaaattctgggactgatgaaggatcacctgaactttcgaaacttccatccgtcatggtcatgcaaaggcaaaaacagaataaatgaacaaaataagacgaacaatgcattatcagcataagaacagacatacatcggtatgctttctcgttcgacaagtacaaattttaaaggtatccgggtggaatgtttcaaaagtttttgccatttttcacaaagtgcacagattacacgtaggctaccaacggtgataaatacaagaacaagtgtagatgcgatcattgggcgtggagaaaatcaaataagtcattaaggtaatatatcttataatgtagcaacaattacttcccattacaatgtcaaacattataatcgctaatattcagttacttgtataacagttcaaagacaattagtaaatcagtaaacttagtaaaacaaaagaggcaaacacagacaatctatctcctatatccacataaagaaaaaccaaaaacctttctaagttggtataagagttccactctctgcacaaaggaccaaacacgtctgcaacagctaatagaaaaccatcagtttaactgctaaatattgtataattctacagttgggacatttagtagaaagcttacatatcaacttgagtcaaaatactgttgctcaatcaggtaacgaaactggggtttatttagttctttttacaatgacgccactgtagtcaaagaaatccatgtcagcaccaattacccttcattgcatatatagcagaataaatgcagaaagcacaactacttcatcaaaactttaataacttggattcatctgagagcagccaatactatgcattgtgaagtatgattaatcatggtaccaacataatgttacttgtggttcgatgtcgtatccaaaacagccaagatttatcatagaaagatctctgaaggtcatttattcttttataaataatagtgttacttcaacctttatgtgtctagtgtatctactgatcgatttgtcgcaatgagcaaatgcagaaacagtctctacttaataaaaacatcatcacatatttaatagaaacaattgcacatttccgctccccaaacatccaataatcaaatttgcatgaactatgtggcaagcatggaactatgaacctatgacataatcatgctaaaaaaccaaatatcatgttctgatgtcatatccgagacatggaaaaaaaaattatctggcctcctggagatatctcaggaaccaatcatcggcttacattatgctacttccacttcacagctttgttataaaatctgcagatggcaagtgcatgaagaaacaaccacgagtttatctttaatttcatatatggtaagaggaggaaccacatattgtgcatgaagttacaaaggaacgatgcaaattacctgatatgatgtttcaatttcacatgtatactgcatcaggaattgcacaagtaatatttagcattgggcaattgttttatgctatcacactgaatacacaatagctgattcagagatgcaaatgactcaaccatttgttgagacaagactgaccccctatgctgatccgaatattttctgagacgagtaaaaacaaggaaaaagcttcttgggctaaagaaaggtatgcacatgtgcaaaacacctatcaatcacacataaacagaaaccaatgcaattagcaatcacacggtggattgagctggctacatacagatacatatacaggtttatctggagcagcatcacccatgacacaccccagttccccagaagtacacagacaggactaacaggcagcagaacactattctgaaacaaaaccagatgaggtgcctagttcaatcaggaaaagtgtttgtcacactcagaatgaatgatcacctccatatagtgggtggcacacataacagcttgctaatctcagaaaggacataataccagggtttttttaaaaacaaaatgtctacaaggccgcttacgtatacaaggaacaggtactccaaccttgtaccgcttaagacacataagcggtcgattataccgcataagcagccagttatgctacataagcactacaaggtggggtaaccgaacgaaaccgcttaccgctttttaaaacattgcataatactctacaatcatttcacactagcatgacagacaatataatgaatgaagcatctggggctgcaaaatctagattaccactatgttcacacttttcgttggcaatagcataagccagcagcttctagagaaacactgtttttctactaaaattttcttatcaatagcacacgcaagcagcttcaaggggaacaagtgcacccacaaaaaagtactacatattagctgagcagcagtaattgtcactagaaactaacgcaagcacacaggtaggctgagatgagtactacaggtgcagataatggtattagaattgaaaattttgcatcattcaggacaagattgggaagcacaaaacataattcacagcatattttagtagcggaaccagtcgggaacgtcacgtcgccttcttcttcttcttctactcggtcatggcggccccttcccccttctcctccagctccacccccttgccctcgccctcctccaccggggccgccgccgcggcgggctcctcgacggccctgtccgccggggcagcggagttctcctcgtcggggtcgcgcgcggggtcggtgttgcgggtgagcgcgccgcggaggcggtcgaggaagggcttgaacgcggactccatggtgaaccaggcgaggacgaggccgccggtcacgaccaccgccgtcttcagcgcgttgccctctcgctgccctcctcctcctcctctcgccatggctgctcgtggattggattgcgatgggacgggtggtgtgggatgctctccgcgctcgaggtttgggggggttttgttgtgagttggggaaggttttttttttttttttttgtcttgcacgaaagggaaaggcgagacgaggaagaagaaagaaagcgacgcgaggaaggcacgtaatttcgcggaaacgtgaggggcaaaacggaaaaaagtttagcacgggaccaacgtggcacaccgctaccgcgatcaagacaaaaaaccgtcgaaacgggacagcgacgcagcgagcaacgtgacgcgagagacaagaactttttttccaaaaaaaaaaaagaacggaacgggggatatggaacaacgtgaaaggaaaagagaaaaacaaaaaaggaagtgtcatttcccgacttgggctgggttgggttgggttgggccccagctttcgtgcacgatccattttggaagccaggagattggaaattttgtaaccagttgggcctggtttttatgggccaaagtccgttcctttctccatcgaaggctggaggaatgcacgagcaaaaagtacagcatcgcctaaatgaaaactgtgccactctcaccgaaccactaattttcttgtgcttcacaagaggacactttcatgatgtaatactaacacacatggtgacagattccgacctcctgcctacctgttcagtcgtgacacctcacctgtaatctccctttttttgtgagattaattgttagattcaccagctattcttgatcttcatacaccaaacacatgtaactactcaaagatgctaaaatgatcatggtaaagagaaagatggtagctcattacaatgagaactcagatctgagctgaaactctgcaagatcatcccaagaacaaataaacaagcaccatatttcattagctttttatttactgcaggaggcaaaagcataaggaatttgaccggagacatttacatcgcccaacgaactccaaaaagaattgaaagaacgaacatacattcggcctctacaggacactagatctacacaaaaaacagatcacgtagtgagctacaatttttttttcatcattcatcaaatttaccgtgtaattttacatgtaatcgtagttgcatcttcatcaccatatattatatcaatctccctgagcttcttcttcatttggatcccatggagacggcgaccaagaaaaggtcatgtttctcactggaggaacatgtgagaagctctcagtacgccatggcggtttgcccgctgtggaagctctgggtgtagttgaacgtggccgccggcttgcactgggccgacgccgacgccgccgccgccgccctgtgcgtggtgggcagcgagtgcgaggtgacgagccgccggacgccggagcgcatcttgtagaggatgtggccccagctgcccctgctgccgcggccgagggcggccacctcctcctcgttcatctcgaggtcggtggcgaacccgggcttcttggacatgagccagccgacgccccagtcccaccaccgcttcagcgggccgccggcgaacgcgcccagcgacggcgccgacttggaccgccggaacgcccactccgccgacgcggaggagatgggctggatcttgtcggagaaggaggacagcctcttcctcagccccatcaggtggctctcctttccacccccaccgccaccgccgccgccgccgccctggaacgtcggcagctcgtccttgagcggccttgtcggcaagaacctcgccttctggatgttctccaggatggtcgccatgtcccaagaaagagaagatgaatggaggaagaggagaaggtcaggtggcaatggcctcctacctcttcttctccagatctctccttctcctcttcttgagaatgtgatggcgcaatgtttgtcttcacagctatggcctggacaggctggttttattcatgcaagaggggtgggtggggccacgacgaggtgtgtgtagttgaaagctttgtgctgtgcagttgcgagcatgtttacagagaggcgaagcgccgaagccggcgatgtgaactgaacattttggctgttttgtttttgttttcttttttttttaggcagctcagataaactggagccgtgttggcgaaatgatgggtgggtggcagctgccggtgcggtggcgctgccaccgtgccatgtgtggggtggattgccgatttgctgggtgctctggggctttgacatccatgatgaattccatccaccatgtgggctgtggcgtcttgcctgcctgcccatctatttgactctcttgcaaattgcaatatgttgggttgattctggccaaatcgatgcaaagcttcccaatgtggtgaaagagcactcaatgatgtagtgtgtgtcctaggatacattatcaaacagcattgatgctcttcataatctacattgaaataccttaaattgtcttttagaaaacctgaaactgaaggttttcagtccttgtctatcccattgcgcagtttttatcataagcttcctactctgattcttcttggagggtcacagtgtgatatacctttgtgctcggtgtttttaactgtgttcagtgttcataaggaggcaaatgtttccatttgttcttgctagtttcactggagccttttgattatcactaattttcagaaaggaaagggtgttctgtgtttggttagcatctaatactcaaacaaacgggagaggcagctgccgtgtcaccaaaagcaaaagggtatatatcacatgagaacatgggggaaggaatcatccaatgaaacatttgctccctccctcttcctaccgaagctgtttgtcatcttccggttgcacctagacttttcaaggccttttcagcaattggactctgccttttctacgcaggaaacaatcaaacatgccagccattgcaaccatcacaaacatcattctcatcagtacaatgcaaaaactgaaactgcatgcctacatttctcatcagcacaaatgcaagcgtgtgtcacgttttgttcctacgatatgtttctgcccaattctttccaagatcagaggactttgaccttacttacaccatatattccttgcggcaacgtgcaatcatcccattcagtcaaaccgaaaaatcaatcgacagaaaaattatctcatacgccaattcattcgacagaaaaatcatctcatacagtcaaaccgaagggacctgaaatgtgatctggaagaagcacgcgagccacacacaaatcgacggattgcgcggctgcagttcacaagtcgttcacaagtccaactccgataataacactcgggcctcacctcacctattcttcttcttttcattcggttgcttcctctcgccgccgacactggcttttattaaatgaagggcaaaggttggttgcgaggttggtagaagaatcagacgagtggaggggcacaacacagctgcaagcctgcaacaactcatttttctcatggaagcagtttaactgacctgtcgtcactctgccatcaggctgtaatatgcttgtagttcttgggacttccagttcagaggtaggtagatagctgcagagaaggaacaaagaccaatccaagagtactccagttctgcattggcaaaagacagggtttgtgctgtatatgtacgtaactgacaggcaagagaagctggcttttgttcagctttccaattattgatttatagttcagtttcaaagcataggaggtacagtatggtatagcctccaaacatatgccaattgtaacaatgacaacttacaactccattatgttcaattgttctctccagtcccaaaacaaatgccatctaagctaatggtacaagctgcaactctaacaatgtgctgtgtggtttggcttcatgcaagatcgaaaaccatggctgaatacctactatcatagaagaccatgggttctgcacactctgcttctcaagactgacagaagtcacatatgactcagaaaaatgaagttccacagcagttaaaagtgcatatgctgaggcatttcagctagaaattactgttgaagatttcctgacaaagtgaagggaataacagcacaaatctactctctcattctcttaagcagataccgaagagaaaagaacccgagcatgaatgtttgccaaaaccaacctgtagcattcctcgggtcatacttctttgccaagaaccaagcataaacagcttcaccaacgtgcaatgcagttgctatcacaaagactaaccgaatcaccaactttgatcggaaaacaaataaatggaggtcaagcacccatttcaatggaccgacgggtggaaggtaagcagcagaaaacaatgccagcatgccaattgttacaaacagccaaggaaatatggttgggccatctagttcttttctcttcctctcctgccagtaggaaatagttgcagccaatccttctcgcgggctcaccataggtacatagccgatttcctctctagctttcaaatatgaaaagtagtgtgtaacacccacctgtcacagcgaactatcaacattagcttcgactatgggtttgacatcatgtttattcccactcagctataaaaatagaattgcaattatgtaattctacatttctacttgcctagtcaagaaattactaaagatcaacagaaaatgattaatttatatataaaaaaggataaaatagctgtaagcaatactgcacatccatcattacatcttagcactatattacgcttaacaagattcaaactcctaccaaacaaattagatcttattacccctcactcatcatgattaacaacagagttgccgtcacatgagaagatagtaacagtgtaaaggcatatttccataatggactacattaggtaaagtcattggaacatgataaataagccgaccttgtatacttcagcaggaaggagaagaggctgaggaatccatttactatccaaccatggatagagtagtgtatacatgaacacaaaaaatcttgagatggcaagagcaactgaggtatccattctaactcgtggaactgtgtaatccaaactttgaaatagaggactgagaaattcaaaagtattgacaggcgatcctgcaaacaaccaatagtttcttgttaagaaaatgcaacatttctttcaaattacaaacaacaaacattaagagcaattctggtaaggaatataagtgtaattgctcaagttgctaaaggagtaatggttcagtattgaatgtaaatatattcaacagagcatccagtagactcattacgtatgatctgtaagcaataaaaatttcaactccctctaaaagaaaaaaggtttcaacctcagaataagcaaaacaaataaatagctaaaacgagctatgcagtaaatcattttgaatagatatcctcaacaaagacaccaatgcagaacacaagagtgtaaactactgtttttttatggtagcattcagcttagtagtctagtgttcaacagttcagatttatcaatatgacaagacaaaaataaaaatggctgcactcctattcaaaagatggaaataaaattcagaacatagtgccatggtatcagaaaaggttaaccagtaatatagttgccctacaggctaactgcacttaccatcacatatgaaatatgcttgaccagcagctacaggaattcccttcctgtcaggaatatcatctaaaagtcccatgcttgccaatatcagtgcaagaacaagattatccacatagacccaatctgacttcacatttggatccccaatcttgaagaatgctaatcccaacttcgcaagggatagtatccttggaagatgccgctcttcacctggaccatagatagcggcgggacgtattgagcatgtataaagacgactgcttttatcactcctgtataaaaacatcaaatcagtaagacagcctgtatattaccaatgttcaacttaagtcccaagccaaaatgaaataattggtggtggatcttgacacatggaaagtagaaaatacgctcatcataggtgaaaacaacacatttgaagatattatatgaagggtatcggccgacccggcaaaattatatgaagggtatgtaagtggcagatatacatggcaatgaggcagacataagaatcatggcaaaaatggctcaacttacttagtttgccggccattactcttcagcaccaactgttcagcaattgatttgctacgcgcataggcatcaacatggtcttcaacagggaaataaggcagcgcctcgttcccattgacaatcggctctcctccaaaaaccacattatacgtgcttacatacacgagccttctaacaccatgctcgtggcaagcgtccagcacattgcatgtaccatttatattgacctcgtcggctcgcccagcctgtaccatttccttccctgacatgccatacgaagcgagatggaaaacacagtccacaccgcgcaaagccttccccacatcttccttctttctaacatcccctgcaacacaggttcaccgatcaggtatttgataacttaattcgtgcatcggaaatgcagagccgactgcaatggacacacaagttaacaagctaaccaggcaattatgcgcagtacatcatgggtattgttggtgttactaacttactgtcactgtgttgagaaaacaaaattcaagattccctaactactccaagagccaaaacatatgtactagctaatagcacagaggcagtagtttactccaatttcacactagttagcaacaaatccggaggtagaactatagccaagcaaagcagcgcagcgctagcgctccagtgcgtcttacttctaagaaaaaactcagtgaccgcgtcagttacagtgaaggaaaagccaaaaccactgtagtgaggatgaactcgagatggcggaccttggaagaagcggacgccggcgccgagcagctggtcggaccagggggaggaggcgcggaggtcgagggagcggacctcccgggcgccgcggcggagcagctcgaggcacagtgcggagccgacgaagccctggccgcccgtcaccgcgaaccgcacgccctcgatcccctcgttctcgctcagatgcatctctgactctccccccaagccgccgacgccgagatgcgctcggtggcggagaaaacgagggcgagtggaacagtatggctgtatgggtcgccggcgacggcgaccgcgctttactacctgtccgggtggagatcgtcggatgggaactcgaaaggcctatctctcatgggctcatgggccatggcccacgcggaatgttttttctaaaaaaaaatataaacaaccaacctgtttgtagaactaggcaagaattattttaagagctattttttagataagaaaataaccctctaaaaaaatagccctaagttgtttggattcaagggttgcttttatgtatcttcctatggagagagatagagagaaaagacgttttttcagtgagccccacccgaaataggctcaattagcaccccttgggtagaataattttttttgagtgggttatttccaaatagctcacccttttggatctttttggctatttggactattttttagggagggctaaaaaatatcccttggatccaaacagggccattgccactgtcttttaacatacgacgttattaacttttatgacattcgtcttatttaaaatttttatgtaaatattaagatatttttgtcatgcttaaaaaatatttaataataaatcaagttttaaataagatgaatgtttaaactatcttaaaatattaacagtattatatgtttaaaaaaaggaggaagtaaattggaacgtatcatggctttcatatcagaaaatttcattgcaaatgattgcatgattgcgtcactgtagcagacgctggagaaaagtagtggtgtggataagattttttaaataaaaattataaacaagaactggatgtgatttttaaaaagcatgtctgggaaaatgaatagacgagaaatgtgaaaagtggctgacaattttttttgattgacctgaggaggagaaaagagggaaaataaaatgtgtaaaatataggctgacaatttttttattgacctgaggaggagaaaagagggaaaataaaatgtgaaaaatatacggaagagaatagacgagaaatgtctgctgagaagcaaaaaaaataaaagaatatatcaaggtcccaccgagatttgaactcgggttactggattcagagtccaatgtcctgaccactagaccatgggaccattttgcttaaaaacccaagctgtcattatataataaaccattgctgtgctgcttaagagctccactccgaagcatccaggaattgcacagcgttgcttaggccggttctttcttgtcagagacaaatggattacaagatcgcctacaaaactagctatgaaccccagccagtgacgtttttggttgggtaagaagcaatcttgtatatgtcacagactccctccggcttgccggtgcccctcctgatcctgaaatacccttgctctccccagttcttgccccacgagttcttcatgatgatgtagtcctggccgtagtacgagccgtagcccacggccgtcagtgcatgatccggttgaatgccacattccccatcaaagatcccctgcatccagtattcagatacacccattttgtcagtttaatgtttttgtgctgatctgtactgtatcatggtgaatgaagattgaagaacagctgataattttgtttacccctttgtagaactgaaagtctctgctcccagctgctatccccacactgacaggctgatgagccagtgccttcagtaggcttgtctcgctgttcgccgggacatcctcgtagccggttatggtgatgactttggaatgaggctaaccaccagtcatcagttcatcacagcagataaattcaactgttagagatcctgctagatcactacatgtgtttacagctgaattgcctctgaagaagaagtggttttcatgtttctacctgcttttctctgcagtagccttcttccatgaggtatgggtagtcttcctctgtgtagatcccctggttccccattatgtatgcgaaggcgaagtccatcagcccacctcgacagccatgattgaaggtgttgtcgcagtccatcagttcctgctctgatagtgataccaacttgccggtcacaatctggtttatcccctcaacagctgccaccgttgaaaaagcccagcaacttcctgcaagagaccgttttctcttacagcattttcatggaacaaattgcatcatatcatacactatttcagatagtgatttagtattaatatgctgaaacagactgtgtgcactctcagtttcaggcattgagtatcgatgcgatgaaatagattgtgcacattttcaggcattcagcattaatatgctgaaattgattgtgtgcagggattcagtatcaccgtgctgaaataaattgtgtgcattttcaggcattcggcctcaatatgctgaatagatcgtgtgcattttcagggattcagtatcactatgctaaatagatagtgtgcatttttcagacattgagcttaccacattctccttggttcttgaccggtgtcactgctcccttcttcctccagtccactgcccagggcaagttaacggcgttcgcgtacctgaatgttgttgaaccatgtggctgagcatcccttcttgctaaccctggcttcagtcccaggtaactggccttgaattcttcatgtgcaatgtcagcaaaatgatttaagccgagccaatagctgccatttctcctgttcgtctccacaatgtgcctcaggtttcgcttgaagatctcatacctcttgaccttctcctttgggcttgcatagatcttgctatgttttactgaccatgatgtgaagagaccaacaagcttatttggcaatgcaagatcctcctgcgagtatccgacaacggaaggatcatggtgactagcagtggcagaacatgccacaaagcctagcaacaagaagagcatggagagcttggagtccatggcaagaaggctattgtttcctgccatggcatgcctagaattcatgaacactctttataatgaccagccatgtttcttgcaagtaattcactacacctgaaatctgaatacctgacaagggcccttctggctcaagctgtgaaggagtggtactagtaccttgctttatgaagaagctgcagttgcaggtatacttttgctctatagtttattcagaaaattgcttgatgtattactttattgttctattgatgacctcttatcatgtttaaattttgatttatgttaaaatagaagtttcttatgcttgcagccttgcaaacctctgaattggagataacttgctcaaccatgcgaagcaggtgcacaggcagcagtggatttttggaaggatggacaagtatcctttgcttatctgctcaagtcatcaccaaacagaagtacaccaaactattctattaccagatcaaccaaccattagtattttcccagttcgagcttggtgtacgtgctcataggaatgcagaattggctgggatgagatatctaaaagaatatagagaaagagaaatgtcttgaaaaaaagaagcaccatgggaaagaaagaactaaaaaatagacgcggctttgcctatgaaatactccatccgtttcatattgatcatcatttaacacaaattgaattttttaaattgatcatcatgttatcatagccccttcgtttgacgtgtaatattattgcatttaagcatgaaaattgagtatgcatgcatgtatgtaggaattcgaggtagtaaagctatcgtttcttagagcaagtttaatagtatagtcaaccactgacttcaaatcatctatagtcaatttagtaggaaattcatatactcctataaacatcactacacaatttatacttggtcgcacctgtcatacatacatgtatcttggagtctgtgctacagctggctacaaatctatagcccactgctcttctctcttctgttttatctcatcgaaatgtgtttataattggacctgctcttatgtatggggcctaagaggagttaaagtgtgcatgtttcttgatttttccctaccacatactcacattaaatgaaatataggaaagttaatacttttttttgtcttggtgaaaaagttatatggtaatcaatatggaacggagggagtaaatgatatggtatgataagtacacttaatttctttatctatttaatgcctgaaattatggaaactatgcccttttattcatatattaatttaaagcagcgagacattgaattcatagacataagttggaagtcgaatatatgcgcacaaattccaaattccaacgaaaccaaagtaatgaaactacttactcccttcttctaaaagtctaaaacttattctattctttggtttttccaaaagtttaagtcctatttatagtcattatgttttaaattaaattattgatcggaacccaataaaccattttattacttattggttacatgcttattggttttgtcacattgtaaataaattaattactccttggtcttggtgccaaaagaaataattcctccatcccaaaataaacttaattcctgggtttttgtgtctaacgtttgatcatccgtcttatttgaaaaaaaatatgaaaaattttaaaaagataagtcatgcataaagtattattcatattttatcatctaacaataataaaaaatagtaatcataaaaaatatttcatataagacggacggtcaaatgttgggcacgaaaacccaagaattgagtccttttggaatggagggagtaggtcttagacttttggatggagggagtattttcattttatctcctggcggagctaaaaagattttttgagcccaagcaaactatacttctagtatttattatataaatttcatcatcaattcattcaataacatataaatttaatggagtttttgtcggtgagtttgcgcggccgcctgcgatagccaggtgtggcttcacccctgcctccacatgtctgtaaaaatcaagaaaatccttttttaaaaaataattttatcttcttattctttaaacataacgttctaaaagtgcataacattaaaaaattctatttgcacaataaagaagagtaaggaataaattatttgtttgaaaatttggaattgcgttgagctcaagctaaagcaaaagatactggtacctccttattctcttctactacttaattatatcctggatactccctaaaaaaattatatcctggataaatgattgcaaagaggctttatctgcccattgcaacttgtatgtgcagccgaactgtggtccgcatcgtttgcttatttcctaataagccaaaacggcttattagaaaataaaaataaatttgtaggtaaaacttttataaatgtattcttggtgacttaaaagccaatgttgaaaaagaaactacgttgaaaatatctcaaaattaagcttgaaaattcaaaatttagttttttctttagctgattaggccatccgatgggagcctgtaagtgtcaactgagagcacaatcaaatgatataataagatctttagtttttctcccccacactatctgaatgtaatactcactgttttttcatttagatggcaacgtcatgcaaaaaatcagagccgtccgtctgtacattgatctagccgttcgtacgatgtcttcagttgcaggcttgcagctaaataaagtcatatatatatatatatatatatatatatatatatatatatatatatatatatatatatatatatatatatatatatatatatatatatatttgtccttcccagtccccagcccccgttcctagtcgtcgacgactccgctgctctccagtctccattcctcaatctgctccttgctcctcagcgtctccatcttcgccacggtgccgctgcgacaacggacagtatatggcatcctttgcaggaagttcgatggcgcctgtgtctaaaagatcgaagtagcgccgtcaacatgagcgaggagaagtctgcgatgcgctccctgtcctccacctcctgcaatccctcctgctcctcgggccgtcgacgggtggttcgccgcagcgtcatagccgcgacgtgcaggtgacagaggatccggcgcgacgccaccacttacccgtgcacgccgcctcctctcctccgctagctagcgccccctcccttctcctgatccggcctccgggtcgacggccaccaccgctactcttctcttcattgggctcaatggatcttgccgaagtttgtatcgtcgacggctatcgcgtgcttgaggtgactcctgcaacatggcgacaaccccgcgtgtcaaggaagggcagcagcatggcggcggggagcgcaggggagggcaaggtggccgggtggtggtgaagaagacgagcccgcgccttgagggaggacatgagtgggtggtccgctgcggcacgcgggtggcggaggatccggtgggcggcgaggcgtgcatcgggaggagggatgggtggattaagggtcgagcgcttttgccagaaaaaatcaagcttcgttggtccatcgcagtgaactttcggagagcaaggagacacatggcagattttcggagatgagaagcttaatttataggacgccacatggcccaatctctaaccagggatagagccctgatatcggtattagagatgagcattatagaaacactcggaatgtcacctcatgtgactaccccatacttaggcattttttacgtttttaatccctgtgaatacgtcttaacctcaaccgaataaatagtattttaaagatatcactatgcgttgtttaaaaaacaacactatgctgatcaattaaggttttggttcaaatggatttttttgcgtattattgagggagattatatactatattaacaagataaattaatactccctccttctatttatatatatgatgttttttagttaaaaatgaactaaccaacttcatatataagtggaaggatggagtaatttgagaaataaaatttagaaataacctagagcaagaggtacgaacaaaacaataaaagatttgttttttgagaatttgtatttgtataagcatggagaatatattgatatttgtaaaagcatggagaaaataatcattggcaatttttttaaagaaaaagtgaaaagaacagggcctagactcaggtttttccatcgtcacggacaatagaaaatcttggcttattcctagcactaggttagttttaacccaatatattaattaattccaaactaaaagtgatacaatgttttatccttaaggcccacttaaattatcctctgaattattactacatattatctgcctgattatgtgaaaaataaacttaacaggtggtatgaaacaagtcgactaggcattacagtagaggaaagtattttgaaaaaaaaacatataccaagtaatatgtgtaataatttgatgaagtggcaaaaagaaagaagacattgtcagggttatggataccacatacctaatagtagttgactaaatctcagcagtatccaccacataccatgtcctatacggaaacaacctgcggatataggaggagtttcggataaggaaagacaaccagagttctatatggaaacgacaagaactactcggattgtatccatattggtttccctagttctacttggacaagaggacacctatgggtataaatacaagaccccctaggaggagaggggacgccacaaagccataagccaatacaagccaacatacaccaagataagacgccggatatcgacttcagggataagcacggctaggatactgtcaggagagacgaaagcgctatctctgatctcgccgggtacggattcgaggaggaagactaacctgttgtcgaccacgagttagaccttcagatcaccatgccaacaacagttagataggctaccccaaatattgtactggtgtgattatggtgaataagagcaataccggcttcggccaacaagatgtagggttattgcctgataattcaggggcccgaacctgtataaaaatccttgtctccgtctcttttacctcagtctcgcgtatatcctaataccaacgatcctcatactatgcaaataccggaatcgcgacatcaaacgtcgacagacatataaaagtggtactcaacaatatttacacattcaaaaaggagtgtaacttaggctgtgtttagttcgtgtgacaaaatttttaaagtatatggacatacatttgaagtattaaacataaactaataataaaacaaattacagattccgcctataaactacgagacgaatctattaaacctaattaattcgttattagtaaatgtttactgtaacaccacattgtcaaatcataacgcaattaagctcaaaagatacgtctcgcgatttacatacaaactgtgtaattgattttttccgtccacatttaatgtttcatgcatgtgtctaaacatttgatatgatgaaaaagttaaaaaatttaaagaaaaaagttcgaatctaaacgataatattataggctaaaagttagcctgcgcgccaacgggagcgctcattttctagtatactaatctcaagctggccgttgtgccagaatttgattggtccacgtggcttaatcaattgcgaatgaattggtgaattcgaggggtcgttccttgagaaagaaaacgaaaacctctagacaagcgtaaccaaattctccaacattacacaagcgtaaagagaaaaaaaaaaaaaaagctccgagcacttagttgggcctagctagcccagtcgctcacctggacctgcccactcggtgcccctcactatgttgatgtatgcaagtgacgcgttgccaattcatctcctcctctcctcccttcctccttcccttcttctcttcctaatatagtctacagtataccataaaaaattttaaaaaacaaaaaattagaaaaatttatgtatagaaatactatatataaaaaaattaaattcaaattcaaatttaaatcaggtatataaacttttaacttataaactttgggtctataaactttaggtgtataaactttagatgtacagaaatactatatatatagaaaacatttgaattcaaattcaaattttaattagatataattcaaatttaaattttaatcgggtatataaactttaggtctataaactttaggtctataaactttaggtgtataaactttagatgtatagaaatactatatatgaaaaatatttgaattcaaattcaaatttgaatcagatatataaacttttgacttataaacttttagtctctaaactttagatgtgtaaacttgaggtgtataaatttactaaaataggaaagtaatgcggtgtaaaaaaaagaaaccaagtagagagaggggggggagaatctcgcccagtagcatttctgcctcaacagttgcgtgcgtgaacaaggaaaaggaattatgaggaaaacgaaaaaggaggaaaaaaattaaatacaagaaagaaagaagtaaaaatattttatataaattatatactatggcttgaatcggaaattgaggcagctaccctaacttcttcttcttctttttttcagggaagctaccctaaccaaatcgatatatttctggaaattaaagacaacaaaaagaatgagaggaacaatgcgaacttatatcataatttgttgtcacgataaccatgttttaaaatatgcatttttcacaaatacactacacatttgataatctctactaatatagaaagtacgaattcattaaacacctctctttcctaaccctcagatttagggcattcaacccatagtgtccataagcagcaatgtctatggtgccatatcaataagacatcacaatagaaactatactctacaacccatggtttcttaaagtgggctattaataaatacatcatttctctcctctacccacggattgccatgcatttggcactgactttccccgccctttttcgtaacaactccaaataaagatggcaccaaaatgatagttaccgccatagacaaggattcatttgtgaatgataaataaaagttacccatatcaagaccaaataatggatcaatgaaaaattgatccaaggggcttgaaattattggtccgccgcttccagggataactcatatttattcttcatctattataaagtcactattcttttccaatacaaaacttgatagtgtctagtgcataggttctcatgttgaagctgtgtcttgcatgagatccagtttcttcctctcttcactctctcttaattaatatagtgccacataagataaaagtcctacatggcaatatagttaatgccatagacaccatcctaaatggagggttaggaccgcccttattcatccaacgaatttatggctgtgtttagaacttcagctcccaacccctctctcgcgcacgcttttaaactgttaaacggtgtattttttaaaaatatttctatatgaaaattgtttaaaaaatcaaattaatttattttttaaaataattactaatatttaattaatcaagtattaatgtatcgctccgttttcgttctgaggatttgggttcccaacccgggctgaacaaacacagaaattagcgatcccactccgtgtgaacggttatagaaattaattagcgatccatctccccctcccctgccccgccaccttctccaccggcgccgacgcctcctcgcgcctaccccgtcgcccgccgccggcagccgcgaaccccgccgccgacgcctcctcacgcctatcacgccttcatcgcctgccgccttctccaccgccgccgtctcctccaccgccgctccttgccgccactgcatcctctacgtctccccgcacgggtggacgctcgccatcgaccccaccgacctcgccgcgtcgctcctccacctcttcaccggagccgtccgcgccctcccgccgctcccggccttcttcgccgagacggacgacctggcctgggactggtcgccgcatggcgtcatggcgtcctgcggcgagggactcctcttctacgcctccgacccgcccgccgccgcctgggcccctatcgccgccatggccgactgcaacgcgagcagcatcaactactccggtggcgagttctttgtcttcgaggacgacgtctgctactgctgcaccaccatcgtcgacgccctcaccctccccatcgccgccgtcatcccggtgcccgccgtcgagctccccgccgaggcgcgcatcgcggtggcaggcgacgagctcttccttctcatcaagtccaaaggatgtacctcttcggcgacgacatcgacttctccaaggcttccggacagctttgacttggcctgacaggagctcaccggcatcggcggccgcgccctgtttgtcgattcctgcacggatttgccatggagaccgcgggattcgagaacctcgagggcaacaccatctactcggtgaccaccaaggaggtgaacgatcggcattccaccacgatgaagtacagtcggtgttcagcctggagaaccggagcttcaagaagctcgcctgctgcctcaacaagctggagatggccctctgcggcgagacgccgtcctggatcataccaagctggaacgaaggatgaacggaatcagagattgccggattggtggttcttgaagcaatggtggtcgacaaatctctgtctcactctcagaggatggattctaatctctcttttcttgcattccacttaaataattatgaaaaaattttaaaaaaatttacaagatagattaatacgtaatatattacttcacaaacatgtaagttcaagttcgacttctataagttgtaacaaaaataacaaattaaactctaactagtatatgtatatttacagtcaaatttgttatttttgttacaatttgtagaagttgaatttgaacttgcatgcttgtgaagtgatacatactaacctatcatgtcaattttttaaaattttttcataactatttagataacattgataaccgcagcatcactattgcataggacgccggccaccttatcctccaggaggaccggtgcgcctgacatgcctttcgccgtcggcaaattggtaggggagaattcatttagatcatcagaatctgttggaaagaccactgcttcgcccctgcacatgcatgttgtgaaacagacagcgtcaaacagcattagttacctactaggagcagtaggtttgcatcagcgtgtacagtaattaacaaagctattgcattgaacatacatatacatatgtagtttcataaagaaaaatgtgaaagaaaggctctcgttaattacagtatgtggccgcgcgatgttcccggatcaatacacatggaggtgccgtcaagtccgaagaatccaatcgcgacaacctccttcccagacaaatcagcctcatcggagaatcccagaggaatgcagttaggcgccccttggacacggatcagagcaagatcaacgtgttctgagacgtgcaccaatcgagcagaggcgatatgatccgcaccaaaccgaacggacagttccttaggctgtgttcctcctgacacggagaacaaagcacacgatttagtgagattaattaagtattagctaaaaaaaacttgaaaaatggattaatataattttttaaaacaactttcatatagaaaacttttaaaaaaatacatcgtttgacagtttgaaaaatgtgtacgtgaaaaacgagtgaagggagttgggaaagagggaaaaagaacatagcttactccgcttaggatcgattacgtgggcacaggttaataccaagcacgacgctccatcgttgtgaacaacaaagccagttcccacgccaagtttcctgccttctttggtaaccagcacgcacgtcacctggactaccgaaacgcggtgttcgtcgtacacgcgctgttccggcgtccgcgacggcggcgaatcaccttggtaagcaacacaagagcaaaaagaagcggtacgttaaccacaagcaaattttttatttttttttaaaaaaaccattttcttttcttgcaagaggatcaatgaaattaagaacaaagcgctagttgcaaaggataggagtgcaagatttgtaactaacttctcttgcaagagatcgaatgaatgaaagaacagttaagttgtagatgagtgcagattcaaaactagcagcgccacagtaggatcttttggccttaattcaacagtaaatgggagggaaaaaaaaaagaacagctggcctacctgttggcgctgatgaggacatcttgacttgttggacttgcggaagaatgggacggagtatcggcatgtagagcgctgtttgtccttatatcatcgcccgccggacagagctgtccaaaaggctcgagacgcaagctagttcggctcgtttcaagcttgtttggagctcggctcggcaagaaatcaaacgccgagcccgttatgctgtgcgctttaataacttacgcttttacccccttcatcagccaagccatccaccccacaggccacagggaggttaagatgttgggttattaccccctttagtgtgctcaacatggacactgtcgatggccgctattgtcaccatatatacgagcccccacgtcgcgcaggaaccacgcccgtctgttcggcgccggtgttccaggaggtgcacccgccgtctgaggctaccatgcagtggcggacgcaggatttcaacaatgggggtacgaagttacagactacggactgtgtacatagtaccaaggaaacagttcgacgatgaaaatatactcaaaccactaatgaacactcaatcgaagcgcaggcatgcatatataaacaaagtatatctcaatctttatacataacttgttgtgaatgatttgtagtgaacaatgaacgaaaaaaatagtacagaagacacaactaaccgttgcgattgtagcgattatatggctgcaccacccataaagattggatccaatctagaggaagaaaataccattgaatgatacccaattatctctattatctagaagaagaaaataccattggacggatggttgtattgcttttttcaaagcctacaaatattttggcctaatgatctgtatacatagtatatattatcttttttgttaccaaaaatttt

SEQ ID NO: 67505 - DNA, 8663 bp, Oryza sativa
gcaccggtttaacagtttaggcagttaagatatctggttttgtagttcagggtcacggattagattcgtgtcacttaaaatatcttgttttgtagttcagggccacggattagattcgtgtcaattttaagggagtcaaattgaacctattccctcaagctatgcaggttcttcttccttctgcactcgcttccagccctaaccctagccacgcgcacttcaaaatttcctcatcaaggagatcttcttcttccgctcgtaatgctggatggatggatggacgtgctgatgtgatgatcccttcttattgttgcgccaacgccgcgaacgagccgccctatgatgggtgagggtgagttggttctttcccctctctgtgggtggggaattttctttctttgttcgatcgccaaaatgggccgcattgatgaatctgatatttcctcttccgttcttgattttttagcatagtgaatctgcccctacctgtatttggaggcggacaggaataacttgtagggcaatcgcgcggtgaatcggcagttgaaggtgccaaatgacaaaaccgcatttggttttactgttcatgcagggcttatttgtattgttcaggactcaggagattagtcagggttcagagtcattggatctaattcatgtgatttgtgcgttcctctgtcagtataatccacgctgatgacaatgggcataaattttccccaagagatgtcttcccatcaaattgagctatctaatacttattttttagattgttagtgcattgaaatttaaaagaaattaatttatcggttgattattttctttctccccaaccttttcatgatagcagttttcttaatcactatttgaaagtaccgattttcatttcttaacagatatgttgactgaacaatatgacaatactgatgatgttgacattgatgagctagctggttccatgagggcagatctaaatcgtcgcattgcactgaatgagtatcgagggaatggaaacaaatgctgccttatatgcaaaatagtatgctgaattcgtcagaatgataggaacgcatatgaaccaagtgttctctcaattggcccttatcaccattcagagttgcctctgcttgccatggaaacagagaagtggatatgtgtagactacattcttaagctaaaccatcatgttagcttgcgtgagtacccgagcttgctttctgggctggagaaacaggtaagaggctgttacagtgaggacatagacatggacagtaaggagttcttgcagatgcttctgctggatagctgcttcattcttgtttatcttggaggtatgcaagggatttgcagggctaaagacacacatgaagcttctgttgatggtcatgggatccaagaagatagtgatactgttgatggtataatagttctgctgtgtatgacctactgctgctggagaatcaaattcccttcttcgttattagggccatttatcagctgttctctcgtgataccatggcgactacaccattacttacaagtgatatttctgaattcatggaaggcattctttaccatttcccaaaagcaatcactgaggagaataggccagtagacttttaccatctgctacatctgtgccgtatgtacctgaagcctggtcacaaggtggaggataaacagcatcatggtcatgctggaaagtctcactactttgactatatatctgattttggccaaaaggtcttctgtgttggacaggagcaaaacatgttatatgaattaagcaagttgaattcaccagagcatgtttatcggtggcgtagagcagtggactatcatgaggcaggaatagaattcaagaaacgggactttcatgaagaagaccctcattctttgttggacattagattcaggaaaggagtcatggaaataccatgtttgccaatcgatgataaatcttctttgcttttcagaaatcttgttgctcttgagcaaacatgtcctcaagtcagcgacgacatcactgcttacattgtgctcatgtctgaatttgtcagtacagctgctgatgttgcacttcttgcacagaaagggataatagtccatcagatggaaagcgatgaggaagtgtcgactctcttcaccaaactttttgagtatgtggcatttgactttagaggtgaacactacctgaaatccttatattgtgccatggaagcacattaccaaagtcgtctaaataggtggaatgcatggctgtggcacaatcatttcagcaatccgtggttaggttttgctgcaataacttccgctttcatagtattatgcagtattttgcaaactgttcttgctttcttatcgtacacagcataaacctagataaagcaaaagagtatgtttcaggtgcatcccgccttcgcaccgcttttttttttttttatatggaatgattccattacctcatagacccagtgatatcactgctcaccaaaacctccacccctgggggaatatcgtcccacctaaggatgtcatagagttccacattacatctcagcaccgcttttttttttatcaacgcgtcctcgagtagtacctgttaatgaccaaatttggtaatatcagcatcggaagaggagtctagatcgaggtggagtcgaaggcggagattgattcgagaacagagcaagaatcggctgaagtccagatcggctacgattaggatcggctgggtctaagtcgggctaggtaggccgatgcagccgattccgacagtataatttggtatatgacattgggttgaattgaggtgcttcaagatgattgccgcacatggatagagtcctgataaggcaattgtatctattaattaggatgttttatgtaacttccttagagatatgtttgggcaaaagtctgccgcaaagacttatggtatcttagagtttgttagagatagtggtcgtgtccggtatggacatatcttgtaattctcgggtataaatagaccccgagccctatgtatttttaacacacacgttcaatacaatttcggcgcatcgccacctttttgctttagttttgtttcgacgagttcttgctttcgggttgagctgcatcggtttcgatcttcaacaagaggtaaaacttgttatgacgacttgtgttctcgagattagtgcttccatctttatgacactctaatcttgtctatataattcgtcaagttgtcatatatcttacataatccttggcaatatcatcatctaatttacaatcggctaacatctgttaatagaaggcagccgattatgttaaatagcgacgttgtcctagatcatataagatatctaccactttatgaaacacccagcggcttgattgtctagatattgttcttcttttcatacctaatgctgcatcagttgagtttgatctattaagtcgtgcttagaatatcaatctctagcatgtcctctgattgccgattagggtagtatcggagtttcagccgatcttatctgatttaaccatattcgatctatatgcttcaatgacatgttaaatccgccctttatgtcaggatcttattgtatttaagtatattaagcttttgtttggtatattatatttggtttgatatctttatataaagtagtatcggagtattaaccgatacatgctagatctatccgatcggctatgctataaacatatataatcctgttattaatatatatttcgatctaagtgatttatactatctcggcatgatgaccgatctatcccaatcacttgattaaagtatatattaatataagaactatatatcgttaatatctacagccgatcgaatagatttagttccttactatctatttataaccgccgatcgattcatagatgacatcggctcaaagataaatgatatttcatcggcacctagccgatcggctatcatttatagatttaaccacgaattctttgtctctatttcttgttgattataggatcaaatcaactggcacgctcatacattcgaaggcaagctttggacctgcactggagttaagcagatctcccaggcctcgtgttttctgtcaacagtaccatgaggtaccactttttttattataaatttggtacctcatagtacctacctaggtacctctacctagataccaagaggtactaaattttacactaaatttttggtacctcatggtatctcctcaagaaccgtagaattgctcaacaacttctattaagagctagttaggtgctaggattaagatcacaccctgttatggtaatacattgttttcaaatgttgttgtaatagatacactgttattcatttttaggttaagaaaacgtgcaattccttatatttatatgtcactaaatacttcctaatatttttcatatactaatgatgccaaattgatatatagatgcagtttaatgacctcttcggagacctggtaagtgcaaaaacaaggggactacatggcgattagacacagataaattattgattttcgtttcctcatgttgattagtattcttacactccatgtgataccctcatccccattgtaatccagtccccggtgtaatatattactacctcctcgatttttataggccgtattttatttttaaaaagtctaaaggatcacgctttggccattgatttctcataaatatattgttgatacctttaaaaccaacattttgttaaagtattttgagatgttaatatattggtataattttggtacattaaattgactaattgttgctcaaaatccaaaagaagttgaccttttcaaatcaaaatacaccttgtaaaaatctacagggagagtagtgatccttagggtgggttcgctcacctccaccgtacgtaaaacgaagcgacacattttgttatccctaagtattttttttttgaaaaatagattaatatgatgttttaaagaaactttcgtataattttttttttgcaaaaaaaaaccttttatcaatttgaaaagcatacgcgtggaatacgtggaaggtgagtgggaaagttagtgaaagaactcggttcccgtacttttaatcgttggtctgatcagcagggcacaagtcccttccttctacagccctagcaatctggtgtaacaaatcaaagtgcattttcatattctcttctttatcaggataatttatcaactcatctcatgtaatcatgttatgccgtacattaccactgatatctctgaattcatggaagagattctttagcatttacttgaagtaatcactgaggcgaataagccaactttttaccatcagctacatctctgtcgtatatgtacccaaaacctggtcggaagctagagaatgaacaacatcatgataatggaataaatgatagcttttgtttcaagaaaactatagccacttattgcataattctctcaaaagagagtaaacattcaggcgacccataaagactggcttctaacaaacacactttaagagaaaataattattgaagtatgtttgtaaatctccagccgaaaattctatatctgatattggccaaaaactcttctgttttggatgggaggaaaacatgctgcatcgacgattagtgagtttatttcacccctgcaggtcaatcggtggaatagagcaatggaggacacgtccaaacactagctgcttccgtccagaatgtcatctttgatatcccaaaaggctgtcctgctgtgcgcgacttctggtaaaaacaccttgttcctttcctttcctcagcaaagtgcgtcgaaggatttctggtagctgatccggaacgggatactcgcatcgagccaccaatctctcatgctgaggcctgagtctcccgaagacctgcattttcaccttttaatgtttttggattctattctaggaatatacctctaaaaaaacttattctaggaatatatctctacaaatattattctataaatatattcttttcgacacaccaatgtcattggcgccgtccccattgctcctcggtgaaaactaattcactaatatgaaggggacgacgccaatatcattggcgccgatgagctatttataattttttgaaaaggggacttatttgtaataaaaaaaattacaaaacaggacctatttgtaatttttttattacaactatatccttttatgttacaaattggttctttttgagtttttttggaaataggtcctcagcgtcaaagatactagtgtcgtccccgttcacattagtggcttagctccaccgaagggcaatggggatggcgtcaaagtcattggtgccgtcatattggatcacgacgccaatgacgtagccgatgcgaaaagggatcatttctagaataaatatttttaagggatctattggtagaataagtttaaaggaataaaaggtaaaaaaaaatccaggttggaagactgaggaattgatgacgtaacaacgcgtttcttttcccctaagtgacaactgaatgagtagtatgcagatcagcagatgtatgcacaatgcacacacgcattttttgtttcaaggaagtgtatagggacgcattcgcatatataaagtagtgatgtaaatgggttggcccatgggtttgtaactttttaccgaccaaaaactagggttaatcgaacttaaccctgaaaacaacgaggtagaaaaaaaatctacatttggtctataatttacctaataaaaaaaagaagtgggataaaaggttctagaataccgtgtgtatgaaaatggtaacagaaaatataagtggaaccattttctaccattacctttttgtcacgcataaaacttaacttttttagtgttgtatttatatcaaaactgaatagttaaattaacaaatatgatcaattaccaacttatcaaatgtcgttttgaaatagattttatcgattccaaacgtttttgaccgtttttatcctcaagtaggcaaacttgtgtgcctaatatgaggtgcggtggtgtgcgtgcagcattggactagaatgagtggtgcaacgatacgtgtaagagatcagtttttgaagcaataacaaacaacgtttggaatgacactccaactgcttcaggaatacataagcgtttgggaagtacttagcaacacgggaccgtgatctaggaagggactgaggatacaatccaatggagatggtcggccagcggctcgtacacggcaagctctgtgtatatcatgcaattatgggaaaaacaagatcggaatcagcgggcctcgtatggaagacttgggcaccggagaaacacaagttcttcgcttggcttcttgttcaaaatagaatatggacagcagaccgcttaggccattcacaatgcatcgccatggcgttcagcctcgacacgccaacacggatttgagccgccacgtttgccactgtcatactcctgccaggaactcggagcctaaggccctgtttagatgggactaaaacttttaagtccctatcacatcggatgtttgaatattaattataaatattaaacgtagactattaataaaactcatccataatcttggactaattcgcgagacgaatctattgagcctaactaatccatgattagcctatgtgatgctacagtaaacattctctaattatagattaattaggcttaaaaaaattgtctcgtgaattagctttcatttatgtaattagttttctaagtagtctatatttaatactctaaattagtgtctaaagacagggactaaagttaagtccctggatccagacaccacctaagttggctccccgttcttcgtcagaattgcgtctgggcccacaacattgtttcctacgccatcaagaaacagagagagaggacaggaagggaggcaccacagcgccgagctcgtcggggtggtggcggcgacccatcccgatctacgccgtcgttattaggggaggagagggcgacggagagggagaggaagacatgagggaggagagggcgaccgagatccgcagctcggcgccaccaccgttccactgccgctctgctcggcgcctcgccgccgctgcgccgccgtcatccacagcttccgcccccacgaggagaggtggaagcagggagagctgtcgcggcggtcgggaaaggggagctgcgccggcgatggtggggaaggggaactgccccgggctagatccggtcgccctgctgctgctccgcctagcgccgtcaccgctccgcccagcgccgtcaccgctccgtccggcgtcgtcgccgcttcggccaactctttgcccgggcgccgtcgccgagaaggacgccccgagccaccgccttccagatccacctcgacgcggtgtggtagggagagcggtggagggggagaggggcgccggcggtgggtgggagagagaggggcgctggcggcgcaatgactgaaggaggagggggagcggttcatgggatgtggggaaaggcagagagagagagaggggagagataacaagtgaggagagagaacgggtgggacccactgtgaagaaaaaagtagaccacatgcactgtggaggatgttgctcacgaagttcttagtctaggtggcagttttggctcctca

SEQ ID NO: 67506 - DNA, 21984 bp, Oryza sativa
tgccatgatggattggtatttggtgttgccagacagagaggaatgaggaaaccagagactcaagatctatccgttttccccctgttcgatgcatgtacccatccactgaaaaagcttcatttgcgaggaaaatgatgtcatgttgaacttcactgatatcagagtgacaagagatgtcatgttgaacttcactgatatcagagtaccttgtcacgagggcatatcagagagaatatcagacaaaactgctgcttataagcaccaattattcacagattggaatactagatgtgatacatcactgtcaatccgtacgcagaattgatactacaaaaagcatcctactcagactatactatgatttctaagaatgcatagctataacgtccacttattcgagcagtaatcgccagcaaaatggaacagcatcccttgatctccaaaaggcatccctcttctattgctagaccttggaacttcagaggggaaataagcgtcgcctactctgaaatctgacactgggttgctacatccaccaaaagttggtgtcgacagcaacatagaattaccagcactgaaacaaggatccggtgagaactcggagccatatcctgaaagagacagatttgccctgaaatgatttgagaggttttcccgacttgttgctgtcaaactgaaccttgaatgatagccatcagctgaacacaactcattttgagcaaaagagtctgttggcaaccggaacaaaccagcaaggcccaccggcactttcacgtcatcccgtggtatgatcctgctgcgatactctgctggttctggtagcgccaatatttcctggctaggaaacgttgacatgcaaagtgaaagctctgtgtctctgactggcgaatcatccgttgcgtagtgatactctggtgctggaagtgctaacatttccaggctaggtggacttggtttgctcagcttttctctaagggacatcttggcacgttgaagggcctccaaaacacctcccacaccatcacttgaaggttgatgcatctgtgtgtcaatctggttatcagtgtggttgtgaaagcatgatgagctccattcagagactttgctttaggggtgtcacttgatcggctagcaactgatggtgtgttgatgtagtgctcataagagcaagcatttacatggtagcctggaccaccgtctgagctttcatctactccatcttcattatgtcttgcattttggacactttcgtagtttctttgtagtgaagaggacaacttctctatattattcccacttccttcaataatttcagtgaaacttttgtctaccaactcatccttcctaatctgtgggccactatcaacagaaacaactgttgaagtagcttccccaaaatcatgatcacactcagtaactttgcaatgcttaatagcattttcttctggtgcattttggggcactccggaaacagaatcagttgacaaacattcagagggactgtcattggcaaagagatttttgtcacttggccctcccacttcagaaacttctttatccttgatctgagcagctttgtccctctgctcacaagccttttcaatttgatttagcttattgcatagctcaacatcaccctggaaatcagaacacaaatgcacaagtgaaaataacaataattttagatattttaatttttatcaagtcaactgcaagttcaacagctttgagaaaaacaaagttaaggaaaattgcttggtttactatattgacagcaagtataccatcagataaaaacattgacagcaagtatctctaacaaaagaaattatatggttatcggcatattggcatccatctaagaagctaaaataaccactgaaccaccaaatacatgctattttgttaaacagatcttatgcctatatgaaacagcattttgtgattaagaaggacagcgcataccgcagttgaatcacgggaattgttgaatttcctttcccactccctctgagcatattcttcttcctcgtattgctcaattaactctgcctgcttttcaagaactctctccatctccccatccttctcatactcaacagtatatggattgtcatcatctccatctcttccattgccacaggaaccctgcccatcttggctcacctcaccatcaatatcaggctgctcatcagtacagacagtacaatctgatctctcgtgcccctcctcagtactttccatggcattgtccttcccctcgtctccttcagtgtgaagcctgaaaatgcagtacagctacatttatgtcagcttagcaatgcgcagacagggatgaacaattatcgcaaatttgggtaatttcccggtgtatggacctcagctccttcctcttgaccttccggcacgattgccctgggtggtacttgggcgacgaatccgcggccaccaagtaaaagtagcctctcctatggctatgcctcggcctaagatgcctgcctttcagttgctgctgctgctgctgccgccgcctctgcgactcgtggctcgcggcgcggcccttccacgacagccccccggccgccgccgcagtagcagtgcctccaaactctgaccccgacagcgcatcctccgcgtccccacgagccttgctgccgctctcggcggactcgaggccgtcctcatcgtcggaacctgaaccggaatccgccacatcggagaagcgggcgaggccctgggactcgaggatggcgagcacctcccccgcggcacgctccgccttccggcgctgcgccgtcaccgcccgcacctgctcctccagctccgccacctgcagcagcagcagcgacaccgtgagccggagagaaaatgcggtcgatagggagagtgactgcagctcacgcacccgcttggtgagctggtcggcgcgctccttggcggcgcgggagacggagcgctcggagaggaggcgcgcgcggaggaagtcgattgtcatcgccgtcgtcgcgtccgccgccgccgccatctcgaacccctcctctccgctgccttctcgtcgcagctcagggtgccgctcgtgccgccccgccggcgccgggaagcccctacaccgctcgacgccggaccgcgccaccccgacctcaccgcggcggtcggaggacgaggaggagaggcatggcggccggaggaggggagaggagcggcggaggtcccgggaggccacgccggcgcccccccggggaaggggggggggggagggccgcgtcacgccagatccgccctgtcgggctcccgctagccgccggtcggaggaggaggatgggtggagccccgctcgtcgccggcgccgcgcggctaccgctccgctcggtgccggcgcacacctcgcttcctccaccggggagagaaaaaggaacgatgcgactatgcgaggcgagagatggagttgaagagaaaattgatatttagccattttcaaaaaacggtttcgctgaagtgccatgctgaaaacgtttttcgttaaaatgtcaatataaagcgcgcactcaccgtcactttaccattttagctattttgtgcattttcgatgaaatgcggcttaatgagaccaaattgcccttgctcaccagctgaaagaggatcgatccagttcatgggagaaagaggacgagcgcggcgaggtggtccgcgtggccgaaatagaggaggtggcaagcgaaagcaaagcagcggtggcgacgacggcaacgccgcagcgaagggagacgcacggcctccatgccaacgacaacgatgccttgtcctccggcgtctccaccgctcgatgccggactcgtgcagccgcgatctgttggcggggacctccacaccccacttcctcgtcgacacgacgagcatctgcgtgatcctcgttagcgggttatcaccggggcgctagtgcctgcacagcagcgtgccgacgaagaagctgacgacggcgacggccatgatgtcgccgaacccccgacaaagaagctgacgatggctaccgtcggcggctgcccctcgacgccctcctgtgctagcgccgctccatggtccccggtctccatcgccaccgaggggagggccgccgccgccatcctcctccactcccttagtcccttctccgccacccggatgccacgccgccttcgttcgccatgccggacgccgtttctccggagaccggggggacaagcgcccgccctggagggcctcgccgccagagccgggtgcttgtggccatcgccgaccggcgtgccggccatcatccgcgagccaggacggctcgggctctgccccgcttaatccacgtcgcctaggtcaccgtgatgccaaggtgttgtgtcccctgctcgccacgctcacgacacacctgaaggacaatttcgtctcatcatccggtggaggagcgaaaatgattttgaaaatgcataaaatagccaaaatagcaaagtggcgatgagtgcgtgtttcatattggtattttagcgaaacacattttcagaatggcattccagcgaaaaccgctttttgaaaatggctaaatgtccattttctcggagttgaaaaagtaaaagtaaaggagagagagatggtgggacccaccgctacatgtagcttgtactgtggtgctgtaagagcaagtttaatagtatagtccactactagctctaattcatctatagccaatctaatagccaatttataaatagttgcctattatactattaatatatggtcccatctgttatctgtggaggatgtggtttgtatcgttattgatctatgtggcacggaaagaatggtaaaatttggtgacgtagtgtgaatggccttacaatgcccgcctctccggtccgcggcgacaacgcgatgcggtgtgtgtgattctgtgccagaccggccggtgtgcctccttttttgtcgcgcagtgtcactcacaggccaccgtcctgccgtgccgtgacgggcgtgtgcgcggtgtcgttggttgtgtgcgcccccacgcgatcacgtgacgctggtgtgcttttctcccccgtacgtcgctttacccctcggcccgccccgccccgcgcgactccttctccgtgacgactcggcaaaatcgcgcgccgtggtggcgaccgtaaccgacgaaggctcaccgatgcctccaccggcagtgtgccgccgatctgaccacatgagcgcgtgccttgcaacttgcaagccccgcaacgtgcagtacgggtgcgctggtacacaggctccacccgtgtagacgcacttcggctacgggcaagtggtactaaactctacccaactctgttgtgtgtgtttgtgactttgttctcactgggacgagacgggacgtgtgttcggtggatccgaggaggggagaatagctacgacttcacacgttccacaggggggctttgattggttcggatagtcaaggtcaactcgcctgccgcgcacaaaacgaaagctaaactccattgcggccgtagtagactcgttaaacatcttttgacgtcgtacagggcatcatttatttgctgctctctccgccccaaaatataaaaagtttttaaattagacacggttattaaaaatagttgatagaattaaatgggggatgtcataattggttgagaagtgaatgtagatggaaaaagtgaatggtgaaaggtttgattggttggtaagagaatgttggtgataaattttaaatgctagaaggttatattttaagacggaagataggattattacgttatttgcaagttacgttcaaccgtctgcacatctcacgtcaggtacccaagaccccaagactattgcagtccgcagttgacaccttaactattacagtccgatttctccgtagttgtcaattgaaaccttgttctcaaccttgactattgcagtccgatttctccgtagttgccaattgaaaccaaccctcttctcaaccttgactattgtagtctgatttctccgtagttgctaattgaaacctacttctcaagaggcatttaactacttgtctagattttgggacggacggcgtacaagactactccagtaaacatcctcaagcagggagatatttaactatttgttactcttatacccccgtcccaaaaaaaaaagcccaatactagctactaatctggacatatagtttgtctttgctttgtctttttttgagacggagtagtaagtgccaattaaggatttgtcactagactcgtatgtcatagacacatgagggccacatgtcatagacctaagtcttaaacctaagtctagacaagtagaacctaaaatcggatgagacatttcttaatatttagacaagtagtctattcagattgtagtactataaaatattccattggaaggagagagtacatagaacggcgagcaatgacctttggtattaagagcaagtttaatagcatacccaactactggctctaaatcatctatagctaatctaatagcccattcatgcaatagttaactataaaaatatactacaccatcaatacccggtcccacctctcatacacacataacgtcttggagtcagtgttacagctggctacaaatctgtagtccgctttcttctctctcttcttttttcttctcaatatgtggttatagctggcttatagcctgctattatacctgctctaaacccaattgttatccaggcagccggtggacgggtggagaggatgtgatactgtcaagtcacaaacaataagaaccaagagtccaagaagcgtgatacagtatattgcagaaaacctgataactcaacatcatcctaatacctctgtagcaaggaagtgttcatacagtagtattgtagtaagtaggtctagcggggtacagtaatccatcaaacttccagctagtttctactgaaccatttgcgaacacaacatgttgagaaatcgtcattactcaccagacacatgccatagcccaagagtttacagtacaccacacgaatcgcctgattatatggtcatatggtgcttgtcttaacagagatcaaacacaaggaaacatctcgagcgattactctcagattatttgtagccacaggacagcgacttcaatcaccactggcacaccctctgcacccacaatggacacactctataaccttttcttccctgaggtgcttggggaccctacagacacaagtggttgcaaagttgtggtctcgtgtctgtatgcatcggaggcagcaaagacgctcataacctggctgcaaatgtttcagaaaaaaagatggatagcagtgagcaatcagaatgctgatttgtagattcaaggacttctgatatctacgaaagaacataaaaatgagcatagcccaaagagtacataccactcaattgtctcaactttagctttatactaccctaaaaaaaacttaagctacataccacccaaatagttgagcacactaaaatcccgttaatgaagtagtcatgtcattgttaagaacttcagataaagagggattgcacaaatgagaactcaagcctagcagtctctcagagcagctgggttattgcccatcaggatattcataaaaccacaactgttacaagattctagagagaataggtatgcacctgtatttctctgaaaatttgtttttggcccaaacttatttcttcatgctaatcatgtccaaatcagtgacttatatctgtgatccattcagtatgcagacagtgttacgagattatttctttagtagatgtgggcgttctcagtaaagcattatagatgtgctcttggttggttaattgaaatctataggctcattgtgaagcctactagttcctgagtaaacttttgtagaggaaagactaaaaagacgtagcatatccagatgttctaaaaaattttatggctgttttggtgaatcatattttgttctgtttgtacaaggaattggaacatcacattggctgcagtgtgcacaatcaaatagtgtctcagctgttcgaatttgtgttgaatagatttaagagaagattgtgtacgtgagaatcaaaatttcaagattgtagcattttaattttagcaatggtttgaatcttttggctgtatatagtgaagccagattcttttcatgatagcaaaagtttgggttttcagggctatatacccaattttctcttaaagagtgcactttgccgttataaaattcacacgaaatattttacatcttaagacaaattctacaattacataggtttcagtgatcacattgttttctacagtctcatttttcaaatagaaagccaaaccttttttttgtcaacattaccgtgacacagacatagtgttaaacataggtacatctggaatggcattagcatcactcttgctatttttttcatgaggatgacataagttcagatattataatatacaagaattggaacataaactgcatactccaaagtttaaagaccacgtatgcttacctttttccacttcgcgatcagatttttatcagcatgaccttggtccaaacaaaattcatacagctcttttgatatctcctttcttcgatagtaaagatcatatatgtaacggcttttttgatgagaaatacgaaagattggccagagagcttcgcacttcctcttcccatcatgtggatcattctcggctgcatccgaaaatcacattaccttttagcaatcagaaaatcacatcattaccaccctgtggtaggaaataataaataacaatatatatactgggaaaagaaatcgacgaactgttacatattacagatatgtgcataccttccctcatcttggcttccaaatcacgcagagttggttctataagctcccatccttcaggatacttgacacggcttgtctttatcttaggcatgtcgtctcaacgaacaaacctaattacctaaatacctaacagaagtcagaagaccacgaacatgtgaaatacctaaggaaaaagagaaaaacctagcttccagatctcgaatataagataaggttaatgcaaattcgaaagaaagaggatgtgcatgcgtaggaactggtcctcaccggaggcggaagcagcaggaggacggcacccaccgctgctcccctccgcaggatggactgaaatcgacgcaggcggcgcggcgggcgaactagcgaggagacgggagttgaggccgagaagacagacggggagattgacttggcgcaaagagtcagaggggagagtatgcgtagcaggacgccggcaccagggccggccctggccctatgtagccgaccgccgggggcctatgatggtggaggggccaacacctaatactagtagtctagtacctcatccgatgttgagatcaatgatttttattcagaattaaaggtgtgattcttggatgttcgcgcctgagattctgaagttcattatggatgcagattgctatccaaatgttttagttgcctatcgaaatctattaactgtacctatgacggtagcttcaactgaaagaagtttctcaaacttgaagttttgaagaactatttgagatcaactatgtcacaagaaaggttaaatggcttggctatgtgcacaattgagaaggatatcttgaacactattgattttaataccgttattgataattttgcatcaagaaatgtccgaagaagtatcttttcatgggagcaacggatatgatggggttttgttcttcattaagttaatgaataatgatattagttccaagttataaatatattgttatttttatttcttcataattactagacatgttaaatttaatatatggatgtatttgttatcgttttgcaagtaaaattattatctatatatcataaaattttatatatagtttagagggcccatcgcgatgagttcgcttagggacctcaaaatcataggaccggccttggccggtaccgctgctcgcagtggcaggcgatggagataggcggcgacagcgcagaaaggagacagatggagcctggtggatgctgtttttttttttaaaaaaaatatttttggaccttttctaaaacttatttcacatatacaccctccgaaaaactaatcccaaaaataaatccctgtctcgacgccaatgtttatcataaagattacacgttacgtcaccatcacctctggcaccgagaatttagcaactacgtgttgatgaaaaatccacgctcggccgatggcaccgaatgtgtgttgacatgaactaagtcgatgaacgcaatggcataggagccgcaacaccgcttgttccaaaatttgcttgtattgtgtcacaactcgcaagcacaaaatttcaggtacatcgtactggggtctgggagcaggaagctggaagcctctcgttgcatagctccaaactagatggtaggtggagagcaccaacggtatatatgcaccaagttacaaaagccaaacggcatgcgttgggcgtgctaacaccacgccttgccaccagacgccgccacctctctcaccatgccagcggcacacggcacgccccggccgtgggcggagctacagtgatgcctgtgtattcccaggaatacctaatattttttaccaaaaaacaactatatctcagtatatacacatgtatggctctgttcgttctggggagataggggagattgattctcgttttcctcgcgcacgcatttcaaactattagacggtacgttttttgcaaaaaaatttatataggaaagttgttttaaaaaattatattaatctatttttaaaatttaaaatagttaatactcaattaatcatgagctaatgacttaactcgttttgcgtatctcctcaatctcttcgatcccttctgctcaaacacaaccagttgtccccactcttcctgagtccctggctcggctcgcgctcacgcctcacgcagtcacgcgctgctcgcccgctccccaattccccatttccaaaccctaggtggtggcgttcggcggcggcgaggtgaccggcgggagcggcagccggcgtccggcgggcggcgacaggattggcgacgggagctagaccggcggcgcagtgaggcgttcggcggcggcgcggcgaggccacgaggcggcaaccgacggccgaccagcgacggcgggagcgaggccgcgaggggcaaggcgccgcggccagcggctgcggctcaacaggacagcgcccggcggcaagcacaacttcaggtgagcaatcaagagttcaagattcaatcagcctaaattcactcatcatgtgtccatgtctttttaccttagtctctgagtagttttttttttctgtacttctgtagttctatagattgaagagctctcaaaatgaagaagaaatcgattgatttgaagacttcgtgggatagacattcaaagtttaggaaggtagggtcaggttctggttctggatcaacagcacagcccgttagaattgacagcgaagttgttgttccttctgttcagccgattacatatgcaaatgtgagtccagttcagattcagattactgcagttgaggttgtgcctgaggtagaaaattagaggtaacatgtaataatttgtagttttatttctcagattatcagtattgacaaattttgaatcattgattttttttactatgaatttttttttgttagacgggaatacccaactttgaaatcctgactctgctgaggctcgtctcacgcagggagatttccgctttcctccgcgatttcctccacattcaccaccggtgttcgctcggctccgcgcctggcacacgacggccacgaaacctgtcaacctcaccgccgctgccatatgccacgccatgccactattcctggcacgacaaccggatggacgaacacactgacacgccagggacagaactgcagagcggtgctattggctgctgcggccatcaatagacagagtcacatagctgaaaaaagacgatatcgttctactccgagtaggtgagaaaaagtgttggaaaaaaaaaagaaaaaatcgcaacgagaaatgaagggaatgtttaaaaaatgggtttgggatatgatttcccaccccctaaagggtaagttttaatcctagccatccattcatatcactccattttatcctattcctccattcatttccatttcccaatcccacctctcctaacccattttccaaacacacccgaagagataatgcaaggcacacattccgagtcatggtggatcccggaggacgctagggaaggggagagatggtggtcgcctttggcatgacccgctttgggaggtgaagctggtggtcgactctgtgcctgtcggtggcatgggaccgggagtatcatgactagaggcttgaggcagacacaatcgcccacgtggcctggcaccctcgggggacgtcgggcccgagggtgatgtgtgcgcccacctcttggtctccccgaggggggggggtcggaccgcttctgcctcgcccccgagggccgaggcgccccgacccctcgcgggttctactccgcgtgaatgggttaggtgagcacagcggggctcacctaaccgcatttattgcggctcggctaaacgtgtcacgccgcacgaaatacagtgcactccactcgtttatccggtctgtgaccagtcacagaccggtcagatcgcgggttaggtggcgacaggcggtctgacgcacgcttcgccccatcccgtcaagacgagagcttctaggcactcgtccccggctggagctagcgtattacatcccagagatggcacgttagccccggtcgatatatgccaggcttcatcctaaccattacaagcaagatgttgtgtgaagaagggcaaacatgcacgttgctaggctgacgcgtggtgggcaagaatgatcgatttgtgaccggtctgacactggtcatgtcgtcggcagacagccactttcccacgacgcgcctgcccccggcagaagtggaggtaggtatgggccgtcccgtcagaaggatgttcggagggcaaccgtgcaaatctccgtccatttatgaaaagaagaaaagtccagtttggaaagagaggggtgcatgtggtatccccttgaaatataaaaggaggacctggcccattaaaaagggggttggattctttccagattgggtagctagaacaaaggggaggttggctcacactttgtagctccttgatacacagatccaccaaaacacaggagtagggtattacgcttctcagcggcccgaacctgtatacatcgcttgcgtttcgtgctctttcgataggtcgcgatctttccacatacagtgagagcttgggatctcaccctgagcccccggccgaaccggcaaaggggggcctgtgcggtctcccggtgaggagccccgcgctccgtcatctggcgcgccaggtaggggcctctgcgagtgattttcggagctcttgcgctctttcgtgagcaccaagcttttcctgttcagcctcatggctgagcaagcgaaggcgcccaacctctctccgagtgtgagtggcgacgacggggagccgaacccacgccgtcgagctcgtactccgccgccccctccacgccaaagtcctgggcgggagaaggcacccaagagggctgaagggtccgcgacttcgacatccacaggagctgggaaagggcggcgagatggggagcgtcgcctcctcgtctatggtgacggcagcacgccccagggcgcgctccaagctgcgggcgcgctcttacgccacccgcctatcatccctgacccggagtctccagcccaacgatggctggacgacgtggccaaattggtcatgacggcgcggcagcgcctagatgctggtgggcggtcctctgccaccaaggcctctggtgctgctaccaccggctctgcgtcgtcaagacggagggcacgacgagcggcagccgctgttcgccattcggctgccactccttcctcgactccttcgacccaggaggatctgcgtggggagcaggacgcccgcaccagcatcgagcgccggcgtaatgaccgacgtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaatagttcaccatgaacttccaaggcacatatccgcgccccggtgaggaagcggacttgcacgctgtacagcgaagggacgacgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccagttccggtgtggcagcttcggccgcccccggatccgccgctcagacagggcggcgtgacaggaggaggaagaagaggtcagtccgttccgacgacgagggtcatgtcctcgccgtcgagggcgcttcgcgggccacccgaaaggggaggcctgcgagcgacaagaagaaggaggccagcgctcccagcagggagcgccccaccggcaagtggtgcaccgtccacaacacttcccttcacgacctcgcggactgccgtgcagtcaaaagtttggctgagcggacgaggaagtgggaggaagagaggaggcaggagcgccgagagggcaagtccccggcggttccttccggccatcggcgaagtgaggccaagcagaaggcccccgccgaggacatcgatgatggcgatgatgacctaggtttccaagagcctggggccaccattgccactgtcgatggaggagcgtgtgctcacgtttctcgccagagcctcaaggccatgaagcgagagcttctggccgcggcccctactcatgaggcgacgcgccgggcgcggtggtcggaggttgccctcactttcgaccagaccgaccacccaccgtgcgttgcccggggagggcagattgcgatggtggtttctcccaccatttgcaacgtgaagttggggcgtgtcctcattgatggaggagcagccctcaacatcctttcccccgcagcctttgatgccatcaaggccccggggatggtgctccggccgtcccagccgattatcggtgtgacgccggggcacacttggccgctaggtcatatcgacctcccggtcaccttcggtggacccgcaaatttccgcacggagcgggtgaacttcgatgtggcggacctcagtctgccctacaacgcggtcctggggaggcccgcgttggtgaagttcatggcagcggtccactacgcctacctccagatgaagatgccgggccccgatggccccatctctgtccatggcgacctcaaagtcgcgctcgcttgcatggagcagcgcgcggaccgcctcgccgtcgtgtccaagcccgagggtggcgacgagaggcttggcacatccgcccccgccgccccgaggcagcggatagtcacgggcgatgaggtcccggtcaaggaggttgtcctgggcgacggcccgtccaagaccacacggatcggtggtctcttggacggcaaataggaagacgcgctcgtctccttcctgcgggcaaacgctgacgtattcgcatggagaccggcggatatgcccggggtccccagggaggtgattgagcaccgtctcgccgtacggccgggcgcaaggccggtccggcagaaagtacggcgccaggccccggaacgtcaagccttcatccgtgaggaggtggcgcgacttctggaggccggattcatccgcgaggtcatccatccggagtggctggcaaacccggtggtcgttcccaaggcgaacggcaagcttcggatgtgcatcgactacaccgaccttaacaaggcatgtcctaaggatccttaccccctgcctcgcatagatcagattgtcgactccaccgcggggtgcgaccttttgtgttttctagatgcatactctggttaccatcagattcgcatggctagggaggatgaagaaaaaactgcgttcattacccctgtaggaacctattgttatacttcaatgccctttgggttaaagaatgcaggtcctacttttcaacgtactactcgaatttctttgggtagccagataggacgtaatgttgaggcttatgtcgatgacttggttgtaaaaacgcgcaaccaagagactttactctcagatctagcggaaacttttgagagtctccgctccgcccgcataaaactaaaccccgataagtgcgtgttcggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccttaagtcggttcatatcgaggctgggagagaaggcgctacccttatttaagctcctcaagcgctctgggccgtttgcctggacggaggaagttgaacgtgccctcactcagctgaaggcatacctcagctctcctccggttttagtcgccccggagccaaatgagcccctgctgctctacttagcggcgaccccccaagtagttagtgcagcgttggttgtggagcgcgatgaggacaatcctcatttcgcgcacccccaccctgtgcagacttggcccgggagcgagcagggaggagaggcccccgagccgaacggtggcctaaggcccctgacgaccggagtcggccctctgcccgctcgacagacggtgctgggtgcccccgaccctcaggaaggccccgaggtcactgcgggaaggccgcacctatcgtcctttgaccccgaggctaaccttgtgcgaactcgacccgggagaaagcagggagaagaggcccccgagccgaacggtggcctaaggcccctgacgaccggagtcggcccttcccccgcttgtccgacgacgccaggagcccccgacccccaggacggtcccgaggccactgtgggaaggccgcctctgtcatcctccgaccccgaggtcatcggcacagaagacgggtgcgccccgagaggccacttggacgaagagcgccccggggatacggcccctagcgaagaggatcggccccaccgaaaggtgcagcggcctgtctactttgttagtgaggccctccgggacgccaagacccgataccctcaggcccagaaaatgctttacgctgttctgatggcctcgaggaaactgcgccattattttcaagcgcatcgggttacggtggttacgtcataccccctcggccaaatcttgcataatcgagagggtacaggacgggtggtaaaatgggcgatcgaactttctgagttcgatttgcactttgaaccacgccacgctatcaagagccaggcccttgccgattttgtggcagagtggaccccggctccagagcctgtctcaatccctgaggtcaactcggacccctcgcagccgccacacaccggccactgggtgatgcagtttgacggctccctgtctcttcagggcgccggtgcgggggtcacgttgacctccccgaccggagacgtcttgagatacctggatcgcctcgactttcgagcgaccaataatatggcagagtacgagggactccttgccggactcagagtggcagccggactggggatccgccgcctcctggtgttaggcgactcccagctagtcgttaaccaagtctgtaaggagtaccggtgctctgacccgcagatggacgcttacgtacgccaagtgcggcgtatggagcaccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacccgaccccctaggggagacgggtgtgcctgaccggcccccgaggcccgtcggagtccaggcctcgggacccgaagggagcgctccaagctcccttagattgattgcttggatctccgagatccaagcatacctcacagataagactctacctgaggaccgcgaagggagtgaacgcgtccaacgcatttccaaacgctacgtgctggtagaagggaccctctatcggcgcgcggctaacggaatcctcctaaagtgcattcctcaggaacaaggcgttgagcttcttgccgatatccatgaaggcgagtgcggagcccattccgcctcgcgcaccttggttggcaaggcctttcgtcaaggattctattggccgactgctctcaatgacgcggtcgacctggtccggcgatgcagagcgtgtcagttccacgccaagcaaatccatcagccggcccaggccctgcagatcataccactttcatggccgttcgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtacctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagaacgaaggcggcgtgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtggtcggtgtcccccggccgggctccatacggctggccacgggcgacggcactgagctgcctaacccgtggaacatcgagcaccttcgtcgcttctacccctgaggggggggtcgggtgtcaggtttcgggctcgggccaaccccgcacccccccctcgggtgtgcagggctggccgggggctaccacacatgcacattctcattttctcttatttcagtatttcaataaaagcagtttcaatttcctaggggctgtatctgtgccgttttttcctttttgaagaattttgacttgaaataaggtcactcgtgctcaaccttgccctcgggggctcggttcggtcagctaaaatcgccaaacggggcctagaaacgagccgtgccctggggcgtggtgaactccgggggggaatcggcaaaaacccacaatcgggtcacccataaccctcggtcatcacgttcccagcctggccagtctcgacatgcggatctccccaggcactagccccgacccgcgcctttcgagaactgggacttgggcacgggccctaaaatcaagctaagacacaaaagagtaccacggcacagatcatcctcatctcattcgcatagcaaaataaaattaacacaaagaattttatggaaattcaggcctgcgccgggggctgactcggaagtcggaggcgcgcttcgtcggcgaggggggtgtagaaccagtcgctcttccagtcatcccacttcttgcggaggacgcaggggatgtagcggttcaacaccggcccccgcggcaggaagtagcagccaccaaccaccgatggcggcgacaccgactgcacggtgaagaaccaccggaacagccgaagagatgggcgcaccccaatgaacatctcgcacagatgtgcgaagatggccaatgtcatcattgcgttgggggtaaggtgcgccatctggagatcgtagaactccaggacatccatgaagaaagaagaaaatggcggaaccagccctgccattgcaaaggggagaaagaagacggaccgccccgggtagtctggcgccgggcgtccctcgcccagcatgactatctcacggccggtggcagattccggcatgaagcggcgcggcaacccagcctgcttctcgctcgtgatgcgggaaggcggcagcacgctaccatcaagcagtgcggagccccgtgccatggcgccggacgaagagaagatggagagcgagcgcgtgtggcgaaagaagggcgcagggaagaaggagttagggcgcaagcggcgaaggcaaggggaatgatggcgaaaggaaggaaacaaatcccatcctcagtgcctttatacccttgccaacgctgtgcccggttcctcgtttctcgcgcccattatttcgccccctcgtttctcgcgcccacgtttccactaaccccattcgctcgcttgcggcgcgtgaggtggatatgcggttgtggcagtcgagatagatcgtatcgtgcgcgcgttaattacgctcgccgaccgaagcgacgttaccatatctccaggcgaagcaaatcggctcgcccagatttgtgcgctgctcaggtgatgtggcagtcttgaagagaccgcccattattgacagccaagttaccattaccgatgcgcatggtttgagaccgttgggtttctgcccaaccatagagaccggtcccacctgtcaccaggctttaggagtggcgtcacgcccgaccgcttcccttgagaagggcgatcgccctggcataacgccgggggctactgtcggtggcatgggaccgggagtatcatgactagaggcttgaggcagacacaatcgcccacgtggcctggcaccctcgggggacgtcgggcccgagggtgatgtgtgcgcccacctcttggtctccccgagggggggggggggtcggaccgcttctacctcgcccccgagggccgaggcgccccgacccctcgcgggttctactccgcgtgaatgggttaggtgagcacagcggggctcacctaaccgcatttattgcggctcggctaaacgtgtcacgccgcacgaaatacagtgcactccactcgtttatccggtctgtgaccagtcacagaccggtcagatcgcgggttaggtggcgacaggcggtctgacgcacgcttcgccccatcccgtcaagacgagagcttctaggcactcgtccccggctggagctagcgtgttacatcccagagatggcacgttagccccggtcgatatatgccaggcttcatcctaaccattacaagcaagatgttgtgtgaagaagggcaaacatgcacgttgctaggctgacgcgtggtgggcaagaatgatcga

SEQ ID NO: 67507 - DNA, 10122 bp, Oryza sativa
aggttggctcacactttgtagctccttgatacacagatccaccaaaacacaggagtagggtattacgcttctcagcggcccgaacctgtatacatcgcttgcgtttcgtgctctttcgataggtcgcgatctttccacatacagtgagagcttgggatctcaccctgagcccccggccgaaccggcaaaggggggcctgtgcggtctcccggtgaggagccccgcgctccgtcagtgccagtggtcgatgcggacaagcaggtgaaactgctgacgcctccgacgacgagatggacgacgacgcgtacctgttgacgagaaaatcgaacacaccggcttgggagatctgcttagctcatgtgcaggtccaaatcttgattagatgcgagcgtgccagtcagtttgatcctgcaactgacaagatatgcaaatagtagatatgcaaatagtagatcaaaacagccgatcggctgacaagccgatggagtagttccagccgatagccgataatagccgatgccgataccagccgatagcgatagggtttaagcaatcggctatatgtccaacgtagataatgatatgaaggcaatcggctgatgaggatgtaataaaataacaataatataatccgatagaaaccaatcggctagaaacaatatataataagcactgatctgaaggttaaagcatacatcggctggaggtccgatgtcattaaatccacaagattagattaaacagtgaaatctatgttgcgatcggctaaatccaacttatatgtatatgcaatccttatgagccgatgtaacgtccaacttatatgtatatgcaatccttatgagccgatgcaacgtccaacttatatgtatatgcagataactcatcggctgaaaccccgataaaacccttattggcaatcaaaaagcaagctagagattatggttctaagcacgacttagtatatcaaacttaactgatgcagcactaagtatgaaaagaaacacaatatctagacaatcaagccgttgactgattttcagggtggtagatgtctaggctaatctactctagcaaggcgatttagccgataccggcagaaaccctaaagcgagagacagccgatagagctaaattgagatgctaggactagattaacatagacatatgataaatagccaggcaaatatattatccaaaccagagtaacccaagaggtcgaatgtactgatgcagccttgaacgacgccgacgtagacgatacaattgcctggaccgacggaacatgggacttatcccttcgccggagatcgaacaccgatgcagccccacgtcaagtgccaagtcccgccggacgataaaataaagtagaaaaggtaaaaggtggcgatgcgccgaattgtattgatcgtggagatagattacatagaccccgggtgtacatatttatacccatgggttgatacaagtccttgtcggacaagaaagaaactaacctaaagataaaaggaaaacataaattccttatcggacactaaacacaccttcctaaagataaaaggaaactaacaaactattcctaattaatagataaactgccatgccgcatcctctttaaactcggtcacttagggataagcttcctttagtagattgatttccttaagcgaatatagcaggaatccgactattggcgacttgataactcccatcggctgattccgagatgctgcagccgataatgattctaagctgatgacgtctttgccgattaccaaatttcactgttaacagtaccccgagtgctacgggcgggccaccgccaccaactcactgctctcggctggcggcgggattgacattgatgagatatcatcaccaccactgtgcatcggcagtaataaggccgtgtttaaggccaatttggattgctaccctaccaaaatttgccctaccaaaattttggttgggttaaaaccaaacacctctactaaaactctatctatgtcataaatttggctttgcctataaacttatctcttataggtaaattttggcttcaatccaaataaacattttcaactctaccctaccaaaattttggtagtaccaaaacttgcccaagatttgacactaccaaaccaaacatgcccttagttcaccccaactaccccaaacttccaactttccatcacatccaaaactttcctacacacataaacttctgacttttttttcaaactttcaacttttctcaaactttcagcttttttttgaactaaatacggcgtaagctgggtgattcatcaaattttcacctctggccggagggaggagtaggagtacgcaattaatgcaatgtggggtgatcaagaagtaaacagtttaagcaaaggcaaaatggctaagagcaagtaattctcctacatgctttttttactatcttccactatcactgtatcacaggaagaaccgggttacatttactagcgacattacattgcgtgatcaatcggagcaacaatggaacacaacacctccgatccaagaatagcagagagatgccgctacaagcctgtaactgccgcttcagtgaacttcatatgttctagtcggaactcagtcctgtacattatactgcaattatatactagcagtatatagaagggtatatttggtatctgtgaacaactggaaaaggctatttaatcatttgaagttcagattaatttatttcaatcgggagtactccctcggtcaaaaaaaaaaaaaaagacaaactctgatttccgtgtccaacttttgaccgtccgtcttattttaaaaaatatatgaaaaaaattaaaaagataagtcacgcataaagtattaatcatgttttatcatctaacaacaatgaaaataataattataaaaaaatttatataagacggatagtcaaacgttggcacaggaacccatagtttgattttttttttgacggaaggagtacttgtcatggatcttgtcgtccgtgcatttggtagcgtttgttccgaagacatctcgtgtggcggtggcttgaacatgatcctcatatgcacagaaatgatggtgctttctggtcataatgcaaggttaattcagtcgtgaaaaataacgaacggttgaacacttgaatgtgagaatatcatctcatcataattactgagatagtcaatttttttttgctagatactccctccgtccttaaaaaaaacaaactctgggttttcatgtccaactttgactgtccgtcttatatgaaaattttttataattcatattttcattgttgttagatgataaaacataattaatattttatgcgtgacttgtctttttaattttttttataattttttcaaataagacggacgatcgaacgttggacacggaaatcaaggtttgtcttttttttttctgacggaggaagtatatccagttagttctcggtatcactacgttaattacttcaaaatttctcattcaattagtttatgacgggatgatttgccagttctattcctgcatggagaggcggcgagtagggcttgcctcctcctactgcctgccccatccctggcggtgcgccttgccccaggtctgctgccgctgcccggatgccctatactgctgctgctgcttcttaggtgcgcgggaatgacagaagaggagaaaaggaggacagtaaggcggtgtttgggtctatggacttaactttagtctctttatttagacactaatttagagtattaaatatagactacttacaaaactaattacataaatgaaagctaatttgcgaaacaaattttttaagcctaattaatccataattagagaatgtttactgtagcatcacatatactaattatgaattaattagactcaatagattcatctcgcgaattagtccaagattatagatgagttttattaatagtctacgtttaatatttataattagtatccaaacattcaatgtgataaggacttcaaagttttagtcccatctaaacagggcctaaatcgaatcaatcctggtttgcggcggcccggggcgcggcgtgctcacggtggctggcagcagcggcggtagcccatgtgatgaaggaaggggaatggagcggatttctcttgattcgccgtttctttcgaacgacaaaccgactggatttctctcgatcggggtctgaccgaataacagaatgcgaaaatataaaaataccccacgcagaaagatgaaaagacaaatatgccctttttaatttatactgcaaagctaactgggtggaatatcagatgaatcttcaccgttagatcgtttatactgctagtatatacttgcagtatagtgtaccgtaaaagtcctcttgaaagaaacggtgtaagattgcacgaaaagcttattttcatcaaatcaattccaacaaaattatagaaacttaacatatatataacgagctaatttacatccttgcctccttggacctcgccgactaccaccaccgcaccaaccctgcccctgcccggctgccccggcagcgcagctgataggcattgatgagatatcatcgccattgccgtcttcaagcagccccgacgacaccaccctgaccctcatccagcagcagcagcaggatggcaagccccagtcccaagcagcggcagcagggcttatcatcggcagagggcagatgcgggcgtcgacgatgctgatgaacctcatctcgtggggcgtctcccattcctccatccaggagctgcaggatgggcaaggccagccacaacgcaaccgtctaccggcctagggtgagcagcgcgactacttccgcggaagcctggtggacaagaagagcagcaagagaaccagcgccggaattgacgagcacgcatgccaccgtcgccaccaatgagggtgcgtgggccacggacggagagcttggcggcgacgagggtgccggggccgagcttgtggacagggccggtcctgtgattttgagggccctaagcgaactcatcgcgataggccctctaaactatatataaaattttatgatatatagataataattttacttgcaaaacgataacaaatacattcatatatttaatttaacatgtctggtaattatgaagaaataaaaataacaatatatttataacttggaactaatatcattatttattaacttaatgaagaacaaaaccccatcatatctgttactcccatgaaaagatacttcttcgggcatttcttgatgcaaaatcatcaataacggtattaaaatcaatagtgttcaagatatccttctcaattgagcacatagccaagccatttaacctttcttgtgacatagttgatctcaaatagttcttcaaaacttcaagtttgagaaacttctttcagctgaagctaccgtcataggtacagttaatagatttcgataggcaactaaaacatttggatagcaatctgcatccataacgaacttcagaatttcaggcgcgaacatcgaagaatcacacctttaattctgaataaaaatcattgatctcaacatcggatgaggtactagactactagtattaggtgttggcccctccaccatcatgggcccccggcggtcgcctcggctgcatagggccagggccgttgtggaaacagatggcatggatgacggccttcgtggagaggatggagctgcagaccaaccgattagcaggagcatgtcctcgctgttgatttcattggtgcgacccgagaccaccgcctagccgtgtgagcagttttattggttacctcgttccacacgcggtcggctgacaagtgagccccacaagttgactcaacagtcaacagggtcaaacatgtcatgtaggacaaaactgtccgaaaagttgatttgtaacggttttaagagttgggagacagattatacctggttttgtggctgagggatacaattacattagggatatgagttaagggatacaaaatgaacttatggagtaggtatatggagtcatggaatcatgggccaaccaataaccaaggcctactaaggacactaggacagtacgtagctacctctccactgctctgctcatttgcttggcttttggctggaagtatacgagtgagccacgtgctctgctttccttctactacatcctttctaaaatatataagcatttttagctatgaatctaaacaactgtgtttctagatttatagccaaaaattaatatattttgggacagagagagtagtagagtattttacatagcatgcacgtccagataaagcacggtcggtgtgcggatgacatgctataccgttgcaacggtatttcggtatatagcagtctttttttttaaaaaaatatatttgattggtttggtgtcactaaaattttaaaacttaacggttcaatcgatgtatatatccgatccgctttcatccctagactgcatggcgcggttcgcaggtaacatcttctagttctatcagctagaaaatggcgaaagacgagaacccgtcttacctccatctgatatttctctcttctcgcatccgtgtcttcatccttgatcctccactctctcttcccctttcccatggtcagtgcgagctgcaggtaggcgtcgcctctgcgagaaggcgcaggcggcggtgtgcacggcgtcctccccttcccgattccgcccgtaccctcctcctccgtggcctgtgcggcctggcgccggcgtgcgcacggccggcgaggaggtttggtgggggatcgatcgacgcggccaacctccttccatctgcctccgtctcggttcgaatcgaaaaaaaaattaggggttcagttgaaccccggcaatccacgttaggttcgcgcctggctatatttttcctcttattttctgggttttggggaggtttttctcgttcccttttcattggttgccttgtcgtttgtatttcgatttgtatgcaatttctcttcttcgtttaggttgtggaagaagcagccaggatccctcagggctcaacctgcaggggaatcctgctgagaaccaggagagctggacctccggcgtgtcagttgggaggggcaccccaaatttgggtgttgggacggccgtggcaggccggagctgcccgtcatcaacattgttcccggggtcctccctgtcgtcgacggcgttgctgaataccatgcacgagggctcctttccacagacagccttggtggcgggttccgtgagcagcgccgatgagcagcatggtgcgccccccgtacggccatcctacaaccttcctgcaggatgcacgcaggtgccgataagtattctggtgttccacaggaggctgacggggaggggatccaggtgccggtcgccgcaatctcgtagctttatgcctgctcctgcactgtccggtgtctcagagggtgagcatttcttgatgtttcttcttttaaggttgttatatggtgttatggatgaatttactgtcacgatcgactgactgccgtttccgattcttcagcagatggagcttatgggccgattcctcaaagtgatttcttgtcgcttcgaggtccatctgaagtttttcctggtgatatggcaatgaatcattcagaaccggccacttcatatgggtacaattcagagtatgcacctatgcatcttcagccaaatggcttatacactgaagcttccaacactgaaagtgaaagagaagctagccaactgcaacaatcagcggaagctgttatctgtgacagcctcagtaagttggaatcggctatggagaaaattcagggtcaaaatcctcaagaatcaagtggcttagttgcagagggttccgctgatgataacattcacaagtaccatcagaaagctaaaagggccaggacacaaatcactcacagtgacaaaatagacttaccaacacaagctgtatctgcatgcaaggaaaaaacaataactcagatagagatgcagattgcagatgctgagagaactgaagcactcaagggtgaggatgccccagcacaaaagctgaagactcgaaggagaaagcacaggcccaaggtaatccgtgaggacaggccagccaaaaagcaaatggccacaacatcagaagaaaaacctctcaatcagaaacccaaaagaaaatatgtgcggaagaatagaaaccccagttctttggagaagtgcgcagaaccttttagtgaccattcaatttctagagaatccagaactaccgttagaagcagcattgcatcagttcgaagaaggctgcaatttgagttcggggagcacggggtgcagagggaccaatcatcaatgaccaattcatggtaccaaaaccaggagaaacctgttaatgctgagagttctttgtgctcagtgactaaatcgtccgtgcaggttgaacatggacaggaattacacatggaaaattcaccagaagggttgttttttggcatcaactccaaactgaacaaaattttagatgagtacatacatttgccagaagccgcaccaaaaccttcagagcaaatcccactggctgcttctggtcatgttagcgaggaactagcaaggaaacaatatgatgtgagacacactcatgatcctgattctacaagttataatatagaaaggagtggtctgatcacaacgaaagggcacaaaaaggacctagacctgaactattctaacacaaatggttttcagatgtattgttcggctagtttgttaccagaaatggactccacaaagggcagtatgactaaggtatcaaaaatggacaagaacaaaaaacgacattatggaggtgagtcctccctagctggcacacagagctccattatcatgagaactgcagctgagatgctagcagtttaccaagcttgtggtattaaaaagaagcgatcggcccgagtccgcaggaattcctttctttctgttatggatcttgagaagaatacttcacaagaatcaacaagattgccgcggtcatgcatggaagccctgtacgagagttcctacataaaatttatgaccaagaaacgttcacagaaggcacggctcaactctcccaattccattcaaccaaatatagatcagaaaaacaggttttcatctgaaaccattttttctggtgggttcaatggattgaaaagatcagaggaaactttccagaaaactttacctcagattccagatgataagaggatcaaccttgacattcattgcgaagtaccagtagaaaactcaccaaatacatcaacgccaccatatatggattaccttcaaggagttacatcaaagtttagatactttgatttgaacactgagcaggtgcataaaactgagatgcatttgtatcaaaccatgccctctctttcttctttaggagcaacaaattatttgccgaatgctctagtcccatatgttggtggggcggtggttccttatcagacacaatttcatttagtcaagaagcaacgccctcgagctaaggttgacttggattttgaaacaacgagagtttggaaccttctgatgggtaaagcagctgaccctgtagatggaactgatgttgataaagagagatggtggaaacaagaaagagaagtttttcaaggtcgtgctaattcattcatagcacgtatgcgcctagttcaaggtacttttagtgctggagtaaatccttttttgaagcccatagtatgctgagctcgttttccgcgagcctactttttaccctgtctattactgtgtagactatctcaggagcttgtcagccatatagaattttctttagaaacaaagggcaaagctcccgccagccatatagaactccttgaaatgttgtcaggttatttgatccattattaaaccacctaatttaaagaatttgtttaaatgcgctgtatatgatcttacaacttggtggaggaggaattacaaaagcatctcttatgctgaagtagctccactgctcaacatggggaaattagcatgcaaaggaacttttgagataatcgtatgtatgtgcttagataatcaaacatatatactttcttttat

SEQ ID NO: 67508 - DNA, 19015 bp, Oryza sativa
gcgatcagatccgtcaaaatagaagtgtaacttttgctcagattatcgagccttcacgatctctctcactttcactggatcgtcgaggaaacgcaagcacttctccttgaggccatcgcaatggtgctcccgggcgaatgcaagcatggaaacaaccgttctcccgttcacgtactcgcacagtttgtgctcgcacaccagcctcagcctctccatcttgtacctgctcgccgccgcgaccaggtccgggagcatcgccgccgcgtcccctcctcctttcgtcgtctctggctccggcagcgagtcggtgtacatgtagcggagcagagcctcgaagtcccgcgcctccatgtcgtcgatgcgtatggcggtgtgatccaccgcgccgccggtcgtggcacccagctccttgcttggcccaaaaagctctgcacggaacaccggagaccgggccgcgagcaccagcctgtgtgccgcgaacgtcttcccgctgacctcgaacgtcacgtcggcgccctccccggtggcgaggaggcctccgaggtgccggtgcaggtccgacggtgggaccaccaccgtaggcggcggcggcggcggcggcgttgcggtgtctacgtcgatgtcctccgtctgcagctccatgaagacggtgaggtcgcacacgatcgtgaggcagtcgtcccggagatactccgatttctccagcacgtccctccggatgaaactcacaaacccccacccgctgcttttgaaggcgtgcgggttgcctcccggcacggtcgagcaagctaaacttgaactgagctttcacgtctacatcgtcgtcgaggttgaggaagatggagatgcagttagctttgtccgagtcgttgccgctgggatagtagctgatgtgccaactatggcctccgacgcggaaagatcgggacttgacgttgctgccgggggtcgggagcttgtccttggtgtgggagtagccgtcgatcttgagaaggtgctggccgctctccgtgccggctatgatggtggaggcagaccgcaccggtttgcggctgccagtggaggttggcatagctatggagattacgcttgattatttatgatcacgagggccacaattcttgctgttcaaggctgcatatgtgtgcggaattaagcaattagtaagggtgacacgcttaattatatagattactccctcgatccgtttcacattatgagtcgtttgacttttttcttagtcaaaacttttagaaaacaatagtaacatttatagcaccaaattagttttattaaatttagcattaaatatattttgacaatatgtttattttgtattaaatatattttcctataaacttagttaaacttaatgaactttgactaagaaaaaaaagtcaaacgacttacaatatgcaatggagggagtacatatttatgcctcattggtatatggtgccaaacattgtctattcagtctagtatttggtcctaatcaacgaggcaatatggagagtcactgttggatccaagtattggtctaggtgggctgtggcatgaggtatagaactaaaaactcgttctattatggacgtaattaatcaatggttgtgtagatttatgagcaactatatatggatggagatttagcaatagtatttccttatgactatgttattcctctctgtatgttgaagtgtttgtgattctttgttatcttatggattttatacattggtagtcttaattatgggctgcaaattatgtaataagtggttgtaaattgaagtaaaggccgagattcccattaactaaaagaactattaatcaatggttgcagatgatgttttttaaaatgttgttactatgaatgcgacctaaattatgctgggtcagcctgggattttatccgaattacgaattacctgggtatatagatgaatatcgaacggatggacaatggaagtaagtgtgagagacaaaactgaatgtctggttaggtgtaaaaaaagaagaagcaaattgtcaaattatccatccattttttcaaaaatagatcaagctgcatatccttttaatttgcttttgcaatgattctactgaaagacagaaagacttctcgcgcggaacttcatggagtacaaataatgcataacacacaaaaatagaagtagaagaagaagggatacaataaaaagtttgagcgtcaaagtcaccaaatgcggccaattaatcatggagcgcaaatgtacaatggatatgtcatcttgatgaagctttgaggcatcaacgaatcagtcaccgtgcaaattaatctagcagagtttcaataggcatatatgaggttcaaacaaagaaaggattttacacacacctgaaggaccatccgaatcaggtcagacttcagagacagagatatgtcgttgattttgtcttggctggagatggtttgatccagctaggattagctgctgttgcagggtcggcagatgtggcatctatcgacacagatttatatcggaagcaacagagagaggaaaaaaaaaggtcattgcttagctaatttaatttgttgttgaatctccagcttccttgcaagctaccgtctactcctagctcacatggatacacgcctgcaagtaatccaaggaatctgggaacctctgcaggtctgcaatcctttgctcccgacaacgggttcctcttcctcctttggtcagggcaaaaacttgggaactcactgagaatgagtataataatacagtaagttaattatagttgggaaaactgatccaaccactagaagggaagaactgattcagatggaccagatattgttggcctcatcagtttgttgttttttctgtgtgtttatttttttaaaaaaaaactgttgtggaaacaaaaacacatcactgaacatgtttgtcagagatgcatacaaagactggcacacataaacaaaaaaaatgctggaggaaattccaaatttacactaaaacaaacatggcagataaattttactacttccaaccaaaaattaccatgtttatccattttcttggattccatagaagatgcacacatacacatatcactatgcagtatacacacacacacaccccatacatccaaacaagtgctcctcctagcatatgttcaaagagggaccgacgacaaatcttgatctcgataaatttctattgaaatacattcgcgtgtagtacttgtgttggagttgtattacaatgcctgttttcttttatcattccatttaataatttattttccctcttcttaattactactatatacatatatacatgttgacacatggctacattagaggactcccaaactggttgcatatttaggcccactgtagctcagctagctacgtttagtacagcagcgagcttggcaattaggtcctttaaaatagaagggtaacttttgctcagattctctagtccctctgccttcacgatttccctcaattttactgtatcatcgaggaaatgcaagcaatcggagaatattaaggacggcgggatgggcgctcgctcgttgcgtccacgtcggattttgctacagtagctacggtgcgcacggggtggaaattatgcgaaaaagccctccgatttttcgtaataatgtataggtccctagcgtcctgtgtttgaagaggaataatcgcggacaggggcttttttgtgatatgtggaagaagaggggcttttccgcaaaacagcatccactaacgcataccccccaaagccctagctgccgcctctccctctcccgccccccctccggcgccgccgccgcttgcgcctaccctcgtgccgccgccgcctccgcctccccctccccctcgccccatccacgtcgccgagcgccgccgccgcctccactcccgccgcctgcgcctaccctcgcgcagccgcctccgcccccctccccctcgccccgtccacgtcgccgagcgccgcctccgccccctcgcgcgccgcactccgcctccccctccccctcgccctgtccaccccctcgccctgtccacgtcgccgagcgccgcctccgccccctcgcgccgccgcctccactcctgccgccgccgctgccgccgcagagcgccgccgccgctctccttgtcccgcgccgccaccgagtgcctgccatctcaccctctccctcttcttctcccgccgccgccgccgctgccgccgtcaccgagtgcagccgtctccacctccgccaccgccatcgccgtcgccgagcgccaccgctgccgctccctgctatccctttctcaccccgcctgcctccggtccccctgcttaccccgcctacctcccccatgatgcggcggcggcggtggcgacgacgacgacggtcgatggggtcatttcctccccacagaggtaggggtccacgctggctgcggcaaatttagtttgttcgcgctgttcagaaacggtggtcgcgtttcatgtgtacgggctgcgtttattggtgcatgtgaaggcacgtgtctttgagtgtgtctgtggcagcttgggcggttcatccgtggtaaagagggaaggggacggcgtggcattttctggatgcactcgcatttcctcttcgtcgttggccgcgccattccgtgcgatttttgctccgatatcagcggctccattgttttgcccccctgatttggtattgaatcgatgctctttctatctcagtgccgaatctgcatgtctggtgtgatttcttcctccttatacattttctccctggtaatggatggccagttaattggtgttggatgtttgcttgttgttcttcctcacttgtcgctgcatatcagagcatggtacaaatcgttcagggtgcccgctcacaccactcaagatgctctgattgggccattgtggcgtatgccagtcgagtctcgtcgctgcgggaggatcccgccagtgcggccagtgtcaggtgcactcaccaccactcgtcgttcgagggcgggacggagagctcgagcatgcctggtcaatggcagccggtcgtcggggctgcgaggtggttggtggtgtctgtgcgtgttccggcgagtggtcggtcccacggctatagccaatcatgctccgctgctgttcgggccccacgtagtcgtggtccatgccaattgcagttggccgctgtagcaggctccgccgatgtgccctttgtccggcgcagtgttactgctcggcgttcgaggcgaacacggagagctcgaggatggcctccgttagagcactgatgtgttacgtcgtatgctgtggctgaccgatggccctgtcatctgtggggtcctattgacagcctctgagtatgttgttttttatgttacatatttttttgttttgtttaccagtataagtagctcattgcctgccaatcttctctttcccttctgctttttcaccatttcctttgcattgccttttggtgcccgttcgctgtttttcttgtcgtctgttctagcccattctccgctgttgtgctttcttcgttcgatcatggaccctggggggtgaacgcgtgtgctggtgggttttctgtatctggcctagctgccttcctttctgtctgtgccgtgtgtttcctttttatcctgtaattaggcttggtgcatttcaggtagccatgtattggcctgtttgttgcacgggacttactgtcacagagtttttaggttttaggcgattttccccgtgttcatgtttcccttttgacagtggatcattgcttatctctgttgttcttctttcagtatatacttctttcagtaaatagatggtggctattacatagatgaagcacacggtcgttagttaatgacaaatatcattgttttttttattcctggttctgattcattattggatcatgtttcaccattcagagtgtgtcccgtggtgttttcttttcgtgcagaaccatgtggttcatttgtatttttgagtctttccttaagtgcatctctgtacgtttacatgtttttttttttgtcccttcatatcgattttttttggcgcaggtgcttattgtcgcggtcaggtccgtgcgatacgtttgttgctgttgtgctgctgttccctttaccatcagctcctgttcaggtgagctttgtttctttgctatttctttgggctgacatcctttttgttttttagtttatttgtgccttgtggtttggtgtatgttctttcttttatctgatatctagcttaaattacattcttattccctgcaggttgcggaccgcatcttctgtgcctgtacatgtcagctaaggtataacaattggcctctgatttcaccgccgtttgggatcgcgtccctgacgcgggagtagccctccgtcttgagcaggtgctgcccgctctcggtgccggcaacgacggcggaggctgaccgcagaggtggcctacggctgccgccggtggtggacatggcctggccggagtcgatcgttctctgttcgttcactgaatgtacctgggaaaattggcagattgttttcacgcctgaagtgaacgttgctttaatttatttcttaaagtaaaatgcaaatagcgatgaattacgataggtatcaatgcaatcatgcatatactccctccttttgtttcatattataagtcgcttttatttttatcctaatcaaaccattttaggtttaaccaaatttatagaaaaataaaacaatattttcaatacaaaataaatatattattaaaatatattcaatgtaatgaaactaatttgatattataaattgttggtaatttttctgtaaatttgattaaacttaaatatgtttgaataggataaagtcaaaacgacttataatatgaaatgcagagagtaaatttgaggtgtaagttcgaccaaccatcaaagacaaaaaaaaaatccactatgaacaatatttgcactttttatcaccatgttttatatatatttgtcttttactttgtaggtcaagtttaaatttaaaatttaggggagtgaatgtctgcgatcgtttctccaacaactcttgaatgaaattttggatacttgtggcacgtttttttcaaaatgctaaacgatatgtttcgtgtgaaaaatttctatatgaaagtttctctaaaatatcatattaatccatttttcaagtatataataattaaaactcaattaatcgcacgttattaccacctcgttttacgtgaaacacttaatgtttatcttcatcttcatgagattcaaacatgcatgtgctctacgtttccctttttttctgtatttttcattgccttttggattgcatttgtgaagtaaaggtacgcaaaagattatccttctagggatgaaaacaaaatggaataaaattacctggccgaatgtttcggctaggccctgttaaaaaatggagcaattagtttgtattttccccaacattttggcaaattgaccgttcaaaaaactaattgcaaaacatatcgtaccaaaatctacctgaaaaatagattgtttgcgcagtacaaactttgatgaatctgagctataatattttagcaatattaacattggcactaaggtattatttgaggtggcacgactttacagtatactgatttagcaccaactgccatcacattggtgctgctcgcagccttctatggacagctaccgtcacattcggttcaaaacccctggtccatagttttttttttttcacttacccggtttttagcttgttctttaaggtttttttaaaataaaaaaaatcacatattctcaaaaaatcattttattttcaaattggaagttgaacttaacttatataatatttgtattttttttgttttttctctaatttttttaaatcacgtgttttattttggtgtctattgaaggacacgcatttatctggtggcatcatttttccaaaatgatccaagctcattgccaccacaactctacccactcgaataaatgtgtgtccttttaatataaaaaaacatgtgattttttatctcatagctagataaaatgaatcttttgcatcaaaactaaaaggataaaatgaattctgaaaacatgtgatttttttagtacatactccctctatcctacaataaatcaaaccctagcttcccaatgtagaattagtgagaaagataatggaccaaaatatccctaattaatagagaagttagtcaaacctagcttcccaatgtagaattagtgagaaagataatggaccaaatatccctaattaatagagaagttaggtgaggggtattaaaggaacaaaatttctcgatctacggtctgacggtagataagaaggtaggagttgatttattttagtacaaattcaaactttagaagttgatttattttgtaatggagggagtctatgtttgtgatgattctaccgaaatgggatgtgcaagctgccatagcatgcagcggctgcagcagttcaaactagctgcaattgacaaccatttacaaatgcagtagctgcagcggttgtgacagttcgcatagcggaacatgcccagtaattgcaatactttcatggaatacaatacaatataaatgaattaggaaccctaacaataaacctactcatcaccctatgccattactgcacccagcataacaaaatgtatatattctatcaggctgaatcattggcatatataaatgattttcagtcagtatacacatttagcagacccaattggtgtaaagtacaaacaaacaaagaaaagatttgcacacctgaaggaccctaatcggatcagctcagagatagtatggttagcttagccggagataaatcagactgttgtggcagggttattagcagagaaccagacacatttatacaggacacgagttagaaaaagaaagaagagacgaacaccaagacaggatcacaggatgtgtgtccagtcattgcctggcttatttgccacaaaaaattctccagatttcttgcacgctaccgtctatatcgtgcaaaatgaacgcatctgaacgtactccctcccacaagtatgtatgtaacccaaggaagagagagctagtaccaaaggcaaattcttggaaaccatgcaacaactgcaagcctgcaaaatcctttgctcccgataacggggtcctcatcaatcgaatattcatgccaaacttggcagctcagctaggccacatggaaaaacccaattttcacaagaatcggaaaaaagaaactagacccccagcctttttttcttttagagcaagtttaatagtaatatggataaaatcccttatatatatatattttaggatggaggtagtaatgtttttgtaaaaaggtaaattcctgatttagactagaaccctgaagtccgaacctatccgcttccactaagatttgatattcacttacatgcatcaatccgtttttaaaaaaagtcgacggtagtgtaaaaaaagaagtcgatgattcagaacagtttagttttatctcgatgatcagttgccttatttaattaggacaaaatatatgtgcaacaaccttttacaactcaacagatttatttatactggacatgttatctctactacttaaaaagttcgtagtggtggtcttgattcctgacacagcagacgcatgtgacagacacgcctaatctcaaccatccgtttgccatatccaatgatcgatctcctccccacgctcgctcctctctcgatccaagagatcactccccacgcccactcctccttctcccacgccgccttctcgccgcctttttcgccctcctccctgtatcgcgccagcgctgcgtcgcctcctcatctcgcggctgcgtcgcctcctcacctcgccgcaaacgccgccgccgtcgactccgctccagatccccgcgtcgcctcctcacctcgccaccaacgccgccgccgtcgactccgcaccaaatccccgcgacctcgccccatccgccccagccggcggcggccgactgccagatccccgcatcgcctcctcacctcgccgccaacgccgccgccggcgacgttgccgctgcccacccgccccagccggcgacgctgccgctgcccacccacaagtaagtctgttctgtaccagtacactgcaagtaagcattgctgaatcaaaagaggtcaaaaacatggttgtcaataccagacagttgtttttctttctcttcttccgttggggtgggaaataaatttattcaaaaagaaataaatttaatgttatgcattatgtgggggaatagggcaattgacagtttactctaccgaggtgctgctgctgaatttgtaaactaccgtggtgctgctgctgaattttattttgaaagcactttgcaatctgtgagatggggaaggaggttagcctagatcttactcataaagacgacttctctaacccaacaattaggagttactacaaagtttttgttgaggtaattatcccctgcatgaaatgactgacaagtagtacttgcattatacacataacataatttgaacataatgtatccttgtatttgataaacttaggttcggctgtaaatactgaataattgatgcaattttcgattggatgaaattgaatgtaccatgcactcctgctcactatcgcgactgagtatttcttcgcagttataatgacattgcaatcaagtagaaatatccattagttaaatattgacttagctgcctccctaatttgtttccaacatgcattatccaccaaatttaaattacaaatctgactaggtagattacaagtttttatgctttctagctttgcactcccaaaggaaaatctccgattggctatcaaggacccatgttagtatgcaaatgtaaaactgcaatcgattccgattaaatccaatgattttctactatgcgtgtagggggttatttttgcccttttttttaatcttccttcctcttttcctctttgtgtaaaaatataagatacgtctcaaaatatattgttttttttttgtcatcagtcattccttgtttgctaaacgaatagtatgtcatcgacctcgccgtgtcatctcgatgacttgcatatatagaggatgcaggaagggcctgtaactaactataggggtgccatgcataattggattggatttcttttacctttacagaacaatatttttgaacaaaaggaatattactttattttgatatcatcttttcttgtattgcaggttttggattcttaaactcgtagcgtttgctgtctatgtttagatggtatattactgatttgcagtatgagctaagcatcggtcatcttttcatttcattcttgcctctgaagataggtactgtgccattgaagatacatgtttgtgtgcaagctaaatcacacttatgcatttatgcatggttaattacattgtttgctctgttaatctacacaacatgatggcgttctctgcaatcttaagggatttatagttttatgcatgattatgcttttcaggtctttagtaaaaaaatggtggtcagggatttagtaagaaatgctggagcactaattgatcctctgctcaaattgatcaaatagtactgtccatttatgcctactcttttctgatcacatggtattgtgtcaaataaatttgatatttagctttggtgtccttaaatggcatggttgttttataagaccctgtgattttctacatgtcaccttaacaatcagtaggctctgttggatttgtgtggactcataaagaagaggtgcttgtgtttgctggttcatcaaacagctccatcaaagcggtagggcgtgggagaagccaaaggtttggctgtgctgctactactactagcatccattcacattcattactctgtagatcaatagtaccatttttatttgcggatcagcagtagggttctggacttacattgccgatcaaatgatttgcggatgcaaataatgaatttccatatgtacacctgtagtgggccgtatgataataatatatctggtacattgcagaaatggctttgtagtccaaaattgctcatataattaagttgtcaaattatgtgcacggacaatgcacctgatttgtctgcgataacaggtaatgacgtgccaaattgctcttcagcttctgcatccgatgtaatcacgtttctgtcaagtgacatttgatacttagatgctaataaactaaatctgtatgacaacagttacgggttgaatcaactaattttctgacagtacatgtgcttaagtgcacaacctaaaatttctttaattcagaagaacatgtaaccacattaggtataaaatttgcaagatatcgatcttaatggcctggtgctgctaggtgtatgcattaattctggtgcgctagatatagtttgcttgcctccaggattatatgataagttagatgtattttgttggcctgctggatgtatgcattcagctcctgacttattcttgatttatttgtgcatgccggatccatggaagaatcaacccactaaagtctgaactctgaaataaggcttttggtatactgtggcctatatattctgcacgtcatatagctttcatgtcacagtatatgtacaggttagcactggatggaaattaatacctcatttgttttctatcttttcaagaactttgctcagggttggtataaatcaccacttaagtaactttgtgatggcatccatctagccctatggccatttacatagagcaataactatgcatttatccgcttttcttcttatgtaagtgaaatgatctggtggtatatgattctgttattctctaagtcaatatcttggatgatcttatactgctttttgtctgcaggcttcggggaaggttgagtattcaagccttggtcaagagttttttttttcttatatggtttgacaaaatagatatttggttgtatcgctgacaaaaatgtttgatatagcatattcttgattcatgtagattgacaaatgatttcacaagcaaatgaaagagtatgtgttttagacatttagtacacacgctattatctactgatgtcacgggcaaggatgttggtggaaggattgcggcgaagcgagtatttgaaggacgttgcaggacgtggccctggacctcgtcggcgcggcagagccgtgatcggcgacgcaccagcgaggcagggagataaactagattggactcaaaattgattgctctatttcctggcctcaatcggcttaaataatacatgaactgtaatgctaacaaactcaagagattaagatgctaacaaactcaggataaagcctaataacaaactctagaaaagaactcaatcctaacaactgttggtcgcccagttgttgccgccgcgcggcacctcgcctccttgcatacgtgagtccccacatgacaactgaggagctgttttcacagcttatctacaatgagtcaaaatttaaagtcaacatcatagctacaatgctagattaaatagggttatgaatatctgctcagaaatatttttgtatactcgtttttattttatgccaaaaattttgtattgatgtctcattgaaattgtttatatataggaatcatatgtttattttcactatgaattccctgatttatcctgcactttcttcagaaatttgggtgtaatactctaatttcttttgaatcctattgttacttgggcactgttgaggaaggagggtgttggaactgccacggaggccgagctccaagtggtctacgcgtattcattggcaagatcggtctcaagctgcaattctggaggtttacatattaactaccatcctacgggcttgttgacttggtgttgtatcatattctgttatcaatatttttttaattaacctataagtcaagactgattgattatgtaaaactaaattatttctagctttgttttgtcggtgctaaatatggtgattaatgcgatccgtaactttggtcattgcaatgtaagatagcaacagatatatggagacaatatataatgcatatataaaattagatttcagctatttggtccttgacatctgatgcttttgtttggaaaaaaaaaagaaagattaactataactggcaactaatcaatatggcattcttgcttaaaaaatcacaaaagcaaacctgaattaaataaactgaatatattttaatgaaatgaatacttttttaataacatgggttctacatatcgccgtagcgttagcacgggcaaattactggtataagagaagtcgttaaccagcaaatataaaattaccaccgggcacaactacggttttgtagcaaacatggcaattagatccttcaaaacaaaggggtagcttttcgtcagatgctcaagaccttcagtctccacgatgttcctcaaatttgctggatcttcgagtagctgcaagcacttcttctcaagctcggggcattggtgttccccagcaaacgccaacatggctgccacggttctcacagttacatactcacatagcttatcttcacagaccaaccttagtctctccatcttatacctgttagccgccgcgaccaggtctgggagcatcgccactgcgtctccacctttcatctccggcaacgagtcggtgtatatgaagtggagcagagcctcgaagtcctgcgcctccatgtcgtcgacgcgtatgatgacaccggcaccgccagtcgcggcattccccttctccgttagggagaaaagctcttggtggaacactggggatcgggccgcgagcacattccgatgcgccaagaacgtcttgccgtcgacctcgaacgtcacgtcggcgcccactccggtggcgaggaggccgccgaggtgccgggccaggtccgacggtggcagggttacccgcctgccgccagtgtcctttgcctcgggattcttcatgaccgtgatgtcacacctgatcgtgaagcggttgtcccggaggtactccgatctctccagtacggccttctggatgaaacgcagagatccccgatagcggccgtagccatcgaaaatttgcaacccatggctgtagatgtaggatgtcactggctcccgttcttggtcgagtaagctcaacgtgagctctgctctcacgattgagcgaccgtaatagtagtcgtgggcctcgtggccgtccaagacgaggtagatggatatgcaatcggaaacgttcgagttgaagccgttggggtagtagcggatgtaccaatcgtggccgccaacgcggaaatgccgagactggacgcagttgccgatggagacggcgtccttgatgctggagtagccgttgatctcgagcaggtgctggccgctctccgtgccgcctacaatcgcagaggcggaacgcagcagtttgccgccggcgacggtgggcgcggtggccattggcatatatatggctttaatttgggacggacaaatagtatcgagctgcagaatttcagataacaggagttttgacatcagtggtcgttattcggttaaagctgaatggaatcatcaagtgaggctgtgtttagttcagcgcaaagtttgcattttggttgaaattggagatgatgtgactgaaaagttgtgtgtgtatgacagattgatgtgatggaaaaggactgaagtttggatctaaactttggatctaaacacagcctgaatacatgagagagaatatacggccgagcttaagtcggtcaaaacctctctcatttttatacgcacgtttttcaaactgctaaacgatatatattgttttttaaaaaaacaatcatagaaaaattgttttagaaaatcatattaatccattttcaaattttttaaactaatacttaattaatcatgcgctaatatattgtttcattttgcgtgtcaaggggaaaggttcctaacatagaaaaattatgtagcacaagcacatatatagtaaaaatctagaaaataccgttggattcaaaaatagacctttgagatttgttcatgtcactaagattaaaaaatttactcgtatattctaccatgagagaaaattttattgcgagtaaaattttactcttgatgtcgtggataaatcttacacgttcatttttcaatccaatgatagttttcagatttcactacatatgtgatttgcactatttatttcccactatcatagcctatcaatcacaacatctgttccaccgtgaaatgagcagaggcagagtctcacactgtttgaaagttgaggggtaccagtttcattcaattttgatttgaggattaaagagctgaggaacgagaaataaaaattttcataattcttagcacaatatgttattagtggacatcgctagtccctcaggtattgagagatacggagtactgaacatacatcaaagatataggagtgaaaaatgaacatccgattagatgcattgtaaaatttgtcgagtaccaacctaacaaatacttttctcaagaatagaacaaacttcgtcctaagtcctaactttacgttgaggttcctcacttgaaatctattcagggaactccatttttccaatttagagatatgttcgagtagtgatcgattctacgtactgaaaaagtatttctttagggaagaattaagattataccaaaagagtgtttgcaacacctcatgtaacagattcactaataaaaaaacttcacgaaataaattgttttaaataaagggaaccttcaacaatgtgagtccgttgctctatcagactcagtttgctatgggaaactatgatggataaccccgataatgtcttgggatcaactatatatcttgaacatgaatatcttagcatattgaaatagtataaacaacacgatcaactcacctagatcaatcgaatcagcttatagagctgagctggagatcatatggtagatgatttgacaaaagatcacaatgatatgcatgagcgaggttgcgagtagctacacatatatttatacttggttccagaaaggccttgataatgtaaggagaaagacctgaaggtgggaaccacttatctggtagaggtgtggtgcatgatttcattcattagggtttgaagtcttatgtcatctttgttgtgtaaaacttctacctatgtggctggcaaattttaccaaccgagaggctaggttattagttcatgccataattgtgacataccgacttcctagcttggcaatgagtccactcgctataaacacatttctttgtcacaaattgtcacatttaataagttgttagtcgaatgtaagtggagcaggtaagcaggtttttttttatcataattttatttaatatttttcttcacaattttatactagcaaatggaaatgaaccatgaagtgggtttttatgagagttattaagcatgaaacacttggcaaagatttttatggtgaattccacacactgccaaatattttaaggcaaagtatgaaaggcaaaaaaaatattttacaaagtgtggatgatatccaacagttcattaatgcttttatttgcactctctgagttccttctagtaaatcttttgtaagattaaggatttattaaaaggataccttgtagcagtacacacagtcatgtacatgtgtggtggtatttgcgtcttttcgcagtggaaagataaaagtcataggctgtgtttagttccctttaaacttccaaaaattccgtcacatcaaacgtttggacacatgcatggagcattaaatgtagacgaaaaaaagaaccaattgtacagtttgcatgtaaattgcgagacgaatcttttgagcctacttacgccatgatttgacaatgttgtgctacagtaaatatttgctaatgacggattaattaggcttaattgattcgtctcgcagtttacaggtagaatctgtaatttgttttgttattagtctatgtttaatactttaaatatatgtctaatatatctaatataacaatcaaatctaaaaattttcctcaactaaaccaggcttaagtataaccacgtatctctagttgcctacggtgcgccgtctcttcattgggccaacataattttttcatttcagcccttgttatatataatttgttttactggttagatcttttacggaaagaaccactgcgtttttaagtgactacgtatgaatagacttccctctattctatgctagggaattctatgctatagcagtagatagttggttttaatattatatttcttactattaaatttgagttttaacattcgggttgactaaatgtatttaagaaaaatatagatcacacatattataggcagcgaggtctagaatatatctactctatttttattgattgataggtaagtacgtataacaaattgcgttagatgtgaaccaattaaaacaaggaataaaacacatctattagcagtaacctttatttagatttgttaaaaataagagcccaaaacattcaattaaaaagaaaaacaataccttactttttaatttagacttaaaatttaaacctaaagatttacgtcttcttaaatgattttttttacgtgaaacagcaggagcaggagaggctcctactgcgctatattaataataaataaaaggtttacaatatttacaaaaatacaaaacaattaagagagagagaatcaatccatgattgcaggatgggtttgtctgcttttttactctgtgcatatgcagagcaaaatccttcttgaactctgatttcccttgactaaactgatagtcacattgttgaaaataaaatcattccttctacaccagatgtgccaacaaccaatcgcctgagcttcaaagaagaagttgagatgaaaagatacttagctgttgtaatcatgttcatgagctccagcgctagatttcactgaatg

SEQ ID NO: 67509 - DNA, 23119 bp, Oryza sativa
attacgcaatgagtacttcagccatgcatctggtttactatatgctctttcttcggaggtgggtggatctctaactgctacaaataatgatagggtggccagtcatcttttcctatccatgccatagagtgaaaacacaggaacaatttagttgaccattcttgtctcttaaaacataataaagcaaaattgcaacagttctgcgaatccaaaacatcgtgtagtttctccttatcctgtatatttccatttacaagaatacaagaatcaagccacgcttgaaattctatatttgattcatattatagactagtctaccaacaaaaaaaaaaaatccatccttgtttttctgtttgttttgtgtatttttcatgtaatcattatttgtttcttcatgcaactctcagtttaaggatgtttgattacgaagatgttactattggatcatggatgcttgccatgaatgtaaagcatgaagacaaccgtgcaatgtgcgattcggcatgcactcccacctccattgctgtatgggacagcaagaaatgttcaagtatgtcttggtaaattgtgtttcgtgatcgtagtgataaaatagtcagaatgggaaaattcatcatcgctgatttaattatttatgaaatagtactatttcttccttttcctatttctaatattgcgattcctgatgaaagcaaaactaactttacatctgatatatctctgtgtagatgcactagctattattactgcatactccatccagtcatacatatttgacgtctaggacaagattcggtcaaacttttggtactttgatattaataatctgataatttctttaattcttaatctacaaataaaaagaaacaatatgtatagatttgccttgaaatgtactatgtactattaaattattagattttgtaaacttatgttaatacaaaattgatggcgaaagtttttattattagattttgtaaacttatgttaatataaaattgatggcgaaagttttaaaagtttgaccgaaacttcgtaaacatcaaatagtcatgactggagggagtaatatttttggtgtctgaagacttaatttgaatatattttttagtaattagctgatattgcaaaataagtttgattaaccataacctcatgcctttgacttcttttgatgcataaatgttttacattagccttgttgacttccagattcatgtaacacaactgagatagtaaaggcgcttcacaacactaccttgtgctcaaagagccctacattgccacctgaggtggaggatgagtagaaccttagtgttattttttttcccgtcaacagatgccaggtattgcctgtcgtaacatctgatttctagttaaatgtatttccataccgttgtattcattggtgaactcatctgagagccatactgttgcagcttcttgttgctgagagttctccgagaagtgtaccatcgcgagaatgatgtaggatttgtgtgcacactcccgatattgggataagcgaacaagacaatatgtaggttcaggcaaaatgtatactcccgactgatagaagtgggaacatttgttgtcttatgtgccatagccgattctggccatcgattctttcactggctatgttgttcattgatgtgtatataaccatatatataccccagtctgcattgttgatcatgaacttcatttcatgatcatggataactccagcttatttggattgatgtgttctcatagaaccagaacccagcttatgtccggtcggagtaataatgaccaattcatgttgctgattacactcctgagatatgattatctgaagtaaggaccaatttatgttgctgattacactcctgagatctgattacctgaacgcgttgcgtttccttgcgtgtatgtgttgttgttccctttgcaatgctgcgttgcaggtgttgcttcttgtaagaaactgagaaaagctgtgggcttttcacaccgttaatgctacactgtgaataccatgatgccgatgccccacttttgccattgcttgtgcctgagcctactccctctgtcaaaaaaaagaatcaacctaggaggggatgtgaccccttctagattgatgtatgtggacacccttatcttaggaggggtcacattccttcctaggttgatttttttttttggacggagggagtattctccaaccacaagctcgctgctattcatctgaggtgacctgagatcagcaaaatataggatccatctgaggtgacctgagatttgacctgagatcagcaaaacataggacgtgttcagattattatgtatttactaaatttgacaacaaactaaacaaacatagatactttttttttaactttacttaagaaatggtgaacaggcccatagagttaccaccgatgcgtttgcaccagcaaacaatactagcactatcaaattataatggcaccaacaatggagcgagcacactaagatatttatttgttactattaagatacagattttaactctgtttttcgttagcacatttaccaaactgttagatggtatatgttggcggatggcatgaggcccttcgaccaaacctgccgaaacccatggcgaaggctatggagcaagaacggcgcaaggcgaagagtcgtacaagcgccaggccagaagcgtctcaggcgaagggtgcaaggcgaagactatctgccgaaggaggacgacttcgccttgacaagttcgcccccgcgagggccgaggaagcctttccggcccatcaagcctaggggcaatagggccggcgatcgccagacggcccatcaggggcctgtgagcccctatatcatcatgtacccctgtaaatgtccctttcgtaagggtaatcatgtaaattcccctctatagcctaaaccctagtagtaagagcctgtaatagggctataaatagccccctagggccatgtaacgggggaatcccgagtgaaattcaaaatttaatacacttcgtttttccaaccactgttgagtaaccacgtctttcgacgtatgcggttgtcgtttcgataacagctggcgccaaccgtggggacctccgagcgaaaccactgagagcgaatgccaccgaagagggtcgtgaaggagaaggttgccaggcggaaggaaagcgacgccgggccggacatggccgccgaggagggagaagagccttcggcgccaatggctgaagatggaggaggaccatctgcttccacgactgcgccatcacaactgccttcggcccctgccgcctctgtgcaagtgcacggccgacatggcgaaggcggctgcggcggcgagggcactccagaccagggcggagatcctttcaacaagccaactggtagtgccccaagccgctccattgcagccaacagcgaccccaaccgcgctcgccgccgtgcaggcccaagtcagccctgaccccgaagcacaagccgaagccgacatggaagccatgcgacagaacatgacacggctccaagacatgcttcgccaaatgcaagaacaacaacaagcatacgaggcggcgaggtggaccaaggttacgtcggctccaatccttcagtattcggcagggtatgtcccacctcaagtccatccgcaagtgacgactcagccctttccgccacaagtcgcacaagcgccgatgtacttcgccaagcagcaattggccgtagcagcgcatccagcccctcacgtacaacagccagtcgctgctcaagtacaccatcaaccacttggccaagcgccacaaacagtggcggaaggggtttcggctctgcaggcgcaactccaagctttccttcagcaactcaaccaaccccactgcatttcaagtacaaacccatcggcccatccggaggggaatacaagtcaaggggcgcctaattggttgccaccgattcagccgagcctgggagtttcgccatggaatcaaggaccgcagttcaacttcgtcaatgctgctcaagcgctaaccgttcggcggcaagctccaactccaggctttggaacaaaccaagtatcaatccaagcggccatgacgtggtcgcagccaattttcgacccatccatggcggctcagcaagtatctccagttggagccgggcagtcgaatgccacggcccaaccccacgcacaagctgcgatttcgcccttcgccacaccgtacccgcagcaaggggcggtaaacaggacgggaggcgaaaaggggctactgctaagtgggggaatcaagactcgtccaatcccaccacagttcaagttcccacccgtcccgcgctattcaggcgaaactgacccgaaggagttcctctccatctacgagtcagcgatcgaagcggctcatggtgacgagaataccaaagcgaaggtaatacatctcgctctagacggcatcgcccgttcttggtatttcaatttaccagccaatagcatttactcatgggagcaattgcgcgatgtttttgtccttaactttcgaggcacctacgaagagccgaagacgcaacaacacctactcggcattcgccaaaggcagggggagtcgataagggaatacatgcgtcgcttctcgcaagcctggtgccaagttcaagacataaccgaggcgtcggttataaacgccgcttcggccggtctgctcgagggtgaactcacaagaaaaatcaccaacaaggagcctcagacgctcgagcacctacttcgcatcatcgacgggttcgcaaggggcgaggagaattccaagcgacggcaagctatacaagctgagtacgacaaagcctccatcgccgctgctcaagctcaagcacaagttcaagttgccgaaccacctccccccttcattcgccagtctcagccggcgatccaaggacaaccgccaaggcaaggccaagcccccttaacttggagaaagttcagaacagaccgtgcaggcaaagctgtgatggcgatcgaagaagtgcaagccctccgcaaggaattcgatgcccagcaagcgagcaaccatcaacagccagcccgcaagaaggtccgaaaagacctctactgcgcctttcacggacgctcttcgcacaccacggagcaatgctgaaacattaggcaacatggcaacgcacaagacccaaggccgcagcaaggaacgactgtcgaagcaccatgcgaagcagtttaggagcaaacacccccagccgaacaacgccaagatgtacagcgaagggtaatccaagtgattacaagggctgacccgccaagccagttgtccaaacggcagaagaagatgcagatccgtatgatccacagcatcactttggcgggtgagggggcgccgcagtatctgaaccagctaatttctttcgggccggaagacgcagaaggagttatgttcccgcatcaagatcccctggtaatctcagctgagatagctggtttcgaagtccgacgaatcctggtcgacggagggagttcggccgatgttatcttcgccgaagcatatgccaagatggggtttcctacccaagcacttaccccagcaccagcatcgctccgcggtttcggcggagaagcagttcaagttctcggccaagcacttttgctgatagcctttggctcaggggagaacagacgcgaagagcaaatactgttcgacgtcgtcgacatcctgtacaactacaacgccatctttagccgtgcaaccctgaacaagttcgaagccatttcccaccacaattatctcaagctcaagatgcccggcccggcaggggtgatagtagtcaaggggcttcagccttcggccgcttcaaaaggcgatctagccataatcaacagagcagtgcacagtgttgagaccgaaccgcatgaacggccgaagcacacgccaaagcccacccctcacggcaagataacaaaagtgcagattgatgatgccgaccccacaaagttcgtatcactagggggtgatataggcgaagaagaagttgagagtatcctagaggtgctcaaaaaaaacatcgatatcttcgcctggagccctgacgaggtggggggtgtcccggtggatctcatcatgcatcacctagcagtcaagccggacattaagccaagaaaacgaaagttgcgcacgatgtctgccgatcgccaagaagcggcgaaagccgaagtgcaaaaattgctcagggcaggggttatccaagagatcgaccatccggagtggttggcgaatctagtgctggtgcggaagtcaaacggcaaatggcgcatgtgtgtcaatttcacggacctaaacaaggcatgtccgaaagacgacttccccttgccgcgaatcgaccagctcgtggattcaacagctagatgcgagctcatgagtttcctggatgcatattccggttaccactagatccacatgaacccgcttgacatccccaaaacatccttcatgactcattcggcacattttgtcacctcagaatgcctttcggcttaaggaacacaggagaaactttcgccaggctggtgtacaaggtccttggcaggcagttggggcggaatgtggaagcttacgtcgacgacatcgtcgtaaaaagccgcaaggctttcgaccatgcgatcgacctacaggagacattcgacaacttgcgcgcagcaggcataaggctgaatccggagaagtgcgttttcggcgtccgcgcaggctagttgttgggtttccttgtttccgaaagaggcatcgaggcaaatcccgagaaaatcgatgccatctagcaaatgaagcctccgtcaagcgtacatgaagtacaaaagcttgcaggccgaattgcggcactcagtcgattcctctcaaaggtagccgaaagaggtttgcccttcttcaagaccctccggggggcaggaaagtttagttggacaccaaagtgtcaagcaactttcgacgagctaaagcaatacctgcaaagaccgccagctctgataagcccatccccaggaaccgaactgctattatacttagcagcttcgccggtggcagtcagtgctgccctcgtccaagaaatagagttcagacaaaaaccggtctacttcgtctccgaagcactgcaaggagcgaagacaaggtacattgaaatggaaaagctcgcttacgccctagtgatggcttcgcgcaagcttaagcattacttctaggcccacaaagtcatagtgccatcacagtaccccttgggcgaaatactccgaggcaaggaagtcactggccggctcagcaagtgggcggcagagctatccccgttcgacttacattttgttgcacgctctgctatcaagtctcaagtgttggccgacttcgtagctgaatggacagcggtacttgcccccaaccccgagcccgccgaacaattctaggtgatgtgctctgacggctcgtggtcgcacaagggagcaggcgttgcggcagtcctattttcgccgaatggtgtgccgattcggtacgcagcaagactgcagttcgacacaaccaacaatgcagcagaatacgaagccgttctcctgggcctaagaaaggcgaaagcactaggaatccggcgcctactaatccgaactgactccaagttggtaacaagccatgttgacaaatccttcgaggcaaaagaagagggaatgaagaggtatctggaggctgttcagtccatggaaaaatgcttcaccggcataacggtcgaacacttgcctagagaccagaatgaggaagcagacgccctggcgaaatccgctgcttgtggtggcccacattcgcctggcatctttttcgaagtcctgcatgctccaagtgtgtccatggatagctcggaagtcatggcaatcgaccagaagaaactgggcgaagacccgtatgactggcgaaccccatttgtaaagcaccttgaaactggctagcttccggtagacaaagcagaagcgaagcgtttgcaactcagagccacgaagtataagatggttttgggtcagctttaccgcaccggggtacttcaacccttacttcgttgcatctcttttgccgaaggcgaagaaatggcaaaggagatacaccaggggctatgtggcgcgcactaggctgcaagaacagtggcctccaaagtatttagacaaggagtttattggcccactgtgttgaaagtctgtgttgagcaaatcaagaagtgcgaaagttgccagtgtcatggccgaagccaagccgcaccccagtatgatctgcagcccattacgccgatatggcccttcgccagatggggactggacatcattgggccgttcccggtggcgcgaaatgggtataaattcgcgattgtaactgtggaatatttctctcgatggattgaagccgaaccccttggggcaatcacttcggcagcagtacagaagtttgtatggaaaaacattgtttgctgttttggagtgccaaaagagttcattactgccaacggcaagcagtttgactctgataagttcagagaaatgtgcgtagggcttaacctggaaatcaggttcgcgtcggtcgcacacccatagtcaaatggggcggccgaacgtacaaatggcaagatcctagaagcactaaagaaaagactcgagggggcagcgaaaggcaaatggctagaggaattgctatcggttctctgggcccttcggacgacccccacaagaccaaccaagtttagcccatttatgcttctttatggcgatgaggcaatgaccccagcagagctaggggctaactcaccaagggtgatgttctctgggggcgaagaaggacgcgaagtatcgctcgaactcttggaaggggtaagagtcgaagcgctcgagcacatgcacaagtacgccacaagcacttcggcaacttacaacaaaaaagtttgacccacggagctcatgcctggtcatctcgtcctaaggaagaaggcgaacccagtagcggttggcaagcttgaatcaaagtgggaaggaccatacctcatcaaacacaagtccaggaagggatcttttcgcctagcgacgctcgaaggcgaggagttcgaccattcctggaacgccacctctctcaagcgcttctatgtctagaatgggtggcacccaaatcgccaacttgtaaaaatgtgcatacagtcatcggcaaaaaaaaagaagaagaaagagagaaaaaagagaaaaaactggatgtagggctattatccgccatggaggcccgaaccagtataaaatctctgtgccctccaccttctttttgtttttttcgtgtgattgataatttgtggaaaaaccccaaggcaaacgcttgatcagcgaaaaaggccagggggcgaaacgaatcggccgaagcatcgctcgccgaacgttgaaaccgcaacagcttgcctcggaaaacaaatagccgaacgacgttacgaccgatcagcagaaaagcaaaagcgtttctttcgacatagagcgctacagatcgaaaacgaacgacgaaaagctgaaaagtcagtatacctatttcgctaaaatacgcaaaggggccgacatattccgacctaacaaaagcacgaaatgtgacgatgcgaaagaatagcgaaaaggaaataaaacacatctttattaacttcgaaaaaataatcgaagaatagaaggttcacaacacgatacatttcaccttacaagtaaattacatcttcacccccataatcactatctctccctaaggaatggtcagacgaactaggttcgtcatcactactaatatcatacacaaccctaagaggagtaggggcgaaacacagactaaactgtaacgacactgaaagatcgtttcctggcgtttagtcttctgatggtttcgccaaaagcgagccatatcctccaaacgtcttgaatgaacaagatcgtaatattctaaggttcgcccggggtgcgcccgcagccagttggcaaccttgaaaaccttatagttgcgaccgtttatctccatttcgtgataaacaggccgaaatggacattgcaccttcggcagacccttcaatgccacaaatttctcgttctgacttcgccagctcccagaaaggggccgaatgcatgattttcggcgaacccccaggtagacagtgcagaaaaggcaaaacacaacttacatggtaagaataggccaaagaaggggaagatatggcataatgggaaatgagcgaaataataatatgccaaaggctttgatcattaaaaagtggttaaaattgtgtcatacagtccaactacgcaaaagggcctcttctaaggtttagcggcagcttgccaaatatacaacggttcgccacatctagcgaacaccaaaagaaaactatgaaaatctaagagaagggcggagggcctcacacctctgggtggtcccgggcatcgcctccaccccctccggccgccgcgccttcatcttcacaaaggtccgccgcctctgctttcgccagctgctccaaaaggcgcgccttagcggcggagcggtcgtccttctgccaaaattgttttcgccacgcacgaagcgcaggcgaaatgtcttgcgcactgatttcccaatcccccctcgcgtacttggggaactcggcgatgtgctcgcagccgaactgctgcaggaggcccatggtaaaggccgctgacacgcgcgcacagcagtcgccgtatgcggtggcgcagtcagaaaccgaaccaccagcctgttgggtccattcggagaagtcgaaggctgaggcatcttcggaggggacaccccgcactttcgcgcccatatcagtaagggcgaggcgaagcgtttggcacgctgtccgcgcggactcggcggttttcaccatctcccgcaaaaaccgccgcgacttctctgcagcgcttgcttcggccttgcgcacctcctgccgaagagtctccatcttcggctcggtgaggttgtaataatctatgagcacggcagtgtgggccttttctttctccagttcggcctttaagcgatcgactttggccctggcttctttccctttctccagttccgattgaagccgcttgttttcaaccttcgcctccttaagggtgttggcaagggcctccatctccaaatttttacggcctagttcatcatccttggcccgaagacggcttttgaacccgtcaagtcgggctcacacggttcgctccgttgagcagtgagccgcgaggatctgggcgcagaatacgagcggcaaagagaacaagtgtcaattgtaaaaagaagagagaggaagagtaaaaataaagaaagggggaaaaaacgtacccgaacagccaggctttttatagcagaacacccctcatcgaactcattcagttcggtgaacaagctcggggcactagcgggcagtacaagattgcttaccccctccacaaaaggaaggaggtccgcccgcgtctcgaaatcgccaagggcgaagcggggtaccgagagcgaatattccgaagcggacgtctcagcgaccgctctctttcccttcgcctcaatcagcagcgacgcaaccggctgatgcggaggactgccgaatactttcgctgcggccgtcacaatcctttccgcagaagccgaagccccagcggcggtactaccgcccactccagcgacgccgagtggaggaatgggggcggccgaaagatccaggctgcgaccagtgggtgaagtcggagtcccgtcggatgactcatcgtcgctaaaaacgcgagcgacatcgacgagcctttcttcttagccacctttttgacaggaccttccttcaacgctgcacccgaagagaacgcaattagggccttcgccccttccaaatccttccgacgaaggggggagctgttcgactccaccctggtctcgttgtgaccgggacttggggtaggaatgtagccgggggtgtcgacgcggtattcgaccgcctcgttcgcggccttatcggccacatcctcttcttcctcctctccttcatcctcgccgtcgcgttcttcggcgtcatcctcgtcgtcggcatcggagtccgacgaagcaggagcccttcgtttcctaggggcaagcttcacttgtccgcgcatccgcttccgtgaaggccctgcatcgtcgtcggctttgtggagatttgcccgaggaggcaattcgccgttataaacccagttcgcccgcccggccgattgtcgtgttagcagctggctatactcgacgaccgacacgtcgccgatcatcctgcgggcttcggtttcagcttggtcaagggtcaacactgtaaaagtagagtgtgaagctatgtcaaaagtcagataaggcgaaataacaaagcacagcagtatatagcaaaagaacagtcttactgttcgccccctcaggaagtatcaggttcggcaaaccgtcgacctcttcgccttgatcaaccgcgacttgccatgactgggagaggggaaaaatgcgaagcatacaaaattcctccaccaagtcacggcagctaaggcgggagcaaaccttccgcagtagaacgaaccgcgcctccatggcgccgtccacagcgatcttgggtctccggttcggcgcaatcgccctgcgccggcaccggagggctttcactgattcagaaccagcctcaaaggggatggtgtgatagaaccacctcgccatccaatggcggtcccacttcgacatggcagcgttcaccgaccagagatcggaccgctcggggcgaacgttgaagttcacactcccgaacactgtcttcttcgttccagccggggtaatcaccgtcttcgagttcacggtggcgaaaaatatggcgccgaagagctcggcgttaggctcaaacccggaagtccggcacgcccagtcgaagatagcgatccgaacaagcgccaacgggctcagctgcggaagttccacctggaagaggcgaaggatctccggcaacaacacgttgcagggaaaccgtagccctgcctcaaaaaatacggcgaacaccaccgtccgattgtcgataggtttcggcaccacggctttccctggggcgaaagcctgcccctcgaccaacgctccggagctgaccagcttcgccagctcgacgtcgtccacaagagagacccctaaaaaggcggtgctgtcgtcatcgactcggccgggatctggccctttcgccgaaccagggtttggcttgcgtggggccatggtgaacggtgcgtttgcggcggcgaagaaagagaatgggcgaaacgctggagaggtcgagggatgctgtggaagaaagaaacggaggaagagagcgcacgcggtaaaaaggcaagtgtggcggtgaaaaggaaaggccgggggggatatatagctcgcttaggcgaccgttcgcctacccaccaataataaagcgccacgtgtcgcaagggtaggcgaaacggtaacttcccaccgtccgagcggcacagtaaaaagcccatgaagggaaagcccaatactgttcctttcggcccgggaaaagaaaatttataaaaaaaatgtgtataatatatatatatatacatatatatatatatatatatatacatatatatatatatacacatatatatatatgaatatgccaccaaatgcaggaggcgaaagcgcggcaaaacaataccagccacacaaataacaaacttcactcgcaggaataatgtaggtttcggcaagagcatctgtcgaaagggggcaccgcataccataccacatggtttgcacggtctcggccgaagctccaatctcacccttacccgtgaggggcttgttggcggatggcatgaggcccttcgaccaaacctgccgaaacccatggcgaaggctatggagcaagaacggcgcaaggcgaagagtcgtacaagcgccaggccagaggcgtctcaggcgaagggtgcaaggcgaagactatctgctgaaggaggacgacttcgccttgacaagttcgcccccgcgagggccgaggaagcctttccggcccatcaaacctaggggcaatagggccggcaatcgccagacggcccatcaggggcccgtgagcccctatatcatcatgtacccctgtaaatgtccctttcgtaagggtaatcatgtaaatttccctctatagcctaaaccctagtagtaagagcctataatagggctataaatagccccctagggccatgtaacgggggaatcccaagtgaaattcaaaatttaatacacttcgtttttccaaccactgttgagtaaccacgtctttcgacgtatgcggttgtcgtttcgacaacagtatatttcgtatgaagacattataaataaaaattgatttaaaatatcagataattaattttttaagtttataatcattaaaactcaattaaccaagtgctaatggctttatcgttttacgtgtctctacttaatcttcatcttcatcaaatttagcataggcatgttcaatttactgctaaaatcaacctttataaaaattatcaatgtcaatttttttttgtaagttagcaatattccaggttttgataggatagactaaatgtgatgtaatcaaaagtccctatacactaccaatgtttagtaataaactaaagcattcacacgtttgttaattttacaaaataatagtatggtttaaactgataccaatttgaacaagcccatatgtagaactaatctttctaagggcctagagttcaacaattttacgagacttctttagtgattattttaatttgtgtgaaattgcttgaaaatccatccatttcaaagaaatcaacgagcctatttataggagcttttatcagctacagcatcttctaaaattaaaaactttctaaatagttcagatttttacctaaaatttgagaagctggtttgtcaatttctttagatctcatcagctacttcttaaaatctaaaactcctacgaacaaacccctatgcttagttcgaatttacctataggatttttgcaaaaactatatatgtgaaagtttctttaaaaattaaataaatcatttttttatgattgtaatagttaatatttaattaattatgtgtaaatgactagtcttattttaggtgcaaattaagcctatcccttatttgaaaaaagcctaaattttactcgaatttgaaggatctcacccagtgtacaactatcgtgcgaatcgatttctacgagaaaagaaagatttctacaagaaaacaagaaagagccttgtacgcggaggagttagcagctgggctcccctatccattattacctttgggacgcgttgacgcgaccgcggaagaggtaggtttgcgcgtgagctgcgttgttgcaattgcatagcgtcggtgcacgcaaagacgccactcccgccgacggtttgccggcttgcaagttggaacaccaaatgctaggtccgccacaaattctaaacgagttgtggctgtttggtgtatactgtattgctcttgctcgatagtcaattcaaccatactcttttccttcactacgcaaaatggagtgacaaaattagtacataattaattaaattatagtattagttaaaaaaataaaaaatagattaatataatttaaagtaactttcttatatatttatttaaaaaacacatcgtttatcagttcggaaaacatacactaaggactaagggtgtgtttagttcacgtcaaaattaaaagtttggttgaaattggaactatgcgatggaaaagttagaagtttatatgtgtataaaagttttgatgtgatgaaaaagttagaagtttgaagaaaaaatttgtaactaaacacggccttaaaaaataaagaagtagagatgaggaagagtgagtaaagatcaacacattaaaagactgggcaatgcagatgaaactggttgtgttcagcaaactgagttaggaacttatcctttacgcacataaaatagtgtaactcattagttcataattaattaagtagtagctaatataaaaataaattaatatgatttctaaagtaaattttctggagaaattattttacaaaaagatacaatatttagcagtttgggaaacatgtacagaaaataagtggaatgaagctagaaacattgagtaaagaacacaccattgtccatcttatttgtggtaaaaagattagcatcaccaaaatgctggcaataaaagcaaactaaccaggcttgcttgtaaaactgcacttggctgtgttcggtctgcgttctataccaaaggcttctaacttccctccctcgttttccgcgcggacgctttttaaactgctaaacggtatgtgttttgaaaaaaaaaatttctatatgaaagttgtttaaaaaaatctattactagggttgggaacccatctccccgcacggaaaacggagcagtctattagcacgtgattaattaactattagctaatttttcttaaaaatggattaatttgaatttttaagtaacttttgtatataaactttttttaaaaaacgcaccgtttagcagtttgaaaaacgtacgcacggaaaaggagggagatgggttgggagtgagctgaaacgagcactataccctactaatatttgaatcatatcattaccaatctttcttttcttttcataaggtttacattgttgatgccgagatgatccagacaacccctaagggtctcatctttttcttaaacttatgcttatcagccaaaatttaaattttcatccttaaatttagagctgattttaaggtttttttttaatcgaagtttacttttcagcatttgcttttatatcgctaaaaacacgtatataaaaactttattcataaattattttttgtttgcaaatatgtcgttttgctgagtccgtgaataagcgaaacgatggctccataaatcgtatcgtgcaagtgagagattaattgataatcgctcatcgtaccgtaataccagtaacgatgtgtggagaaagaagcataggtaagggcccattaaaatcgcaggattgacaaaacgtaggaatagaaaaaacgtaggattctgataggaatgtaagtataaaacagaggattgcaaaatgcaggaaaaacacaggaatgaacgtttaattgaaccacaggaaaaacgtaggaattggattagagagatagactcaaaggaaagttatcaagaggttgaagctcttgctaaatttcctccaaaatctctataggattgtccattccataggaattttaaaggattggattagattcaatcatttgtttcaaaggacttcataggaaatttttctatagaattaaaattctccaaaattcatatgattttcctccaaatcaaaggggccgtaaatatgtaatagtagtcaacgtattacaaacgatacagttgttgaaattcaaattcaaattttggttatagctgataagctaataagcaaacgatgagatgccatggttaggcataaaatttgcctggtgtctatatggatttaaagagaaatacaaattgcaaagttcaacctaagatgttcaccgatgacaagtcgaaacttcatagtgcctcccaaaatgcacttgtaataagcaaccatacagattaacgaccctaatcgtacaaaaatagggttctctgctccctttttttttccctgttgccgaaattctttgcttcagacatacgtacatacctgacggctaatcccgatctgcatattaaacaatgaatactgaagtgtcacacgcagactttttttttttactacacgtcctttgcagttcagctagcacatcattttcacaccgatttcttggcaaccatttcgatcagattcagagagaggaatattaatgattgacgtaagacgcatcaagttggttattgccacacaatattagcactaattttaatttagacaagacagaagctgccttgcatgacacgtgagcgacgcttaccgaacaaatgtgacaatgtgattagcctggctacagttaactacgccattattgcttgtatattgaaatggaatatcttctaggactcgatactcctatgcttaagttaattggggtcataagtaagagtattaatccatgtgtttggttgctaatcattacgaccaatcacccattcgttgtgcttgtatcttgagttgcatatgtcggtgcttggtgttgattctggagacaaataaaaaaagtgtgcattatattgttggtttcaaatttgaatatgatatgcgcctcacaaactaaaacaaataattaagcgtctatggtttatcatcagtaagggggggatacattgtatagaaaaaagaacaaatattttgtacatgaacgatgcgtccttgtactagcttaattagcttggtcggaacatttgacgatttgcttaactgctgcatttgcagatctgaatgtttttagttgttaatatactcgacagctagatgctctattacttgccaaccgttggatggttcaccattggatttggaggagcctcaattaggtgaggtgtgcctagctatgtgtttttcacattattcaagttttaggaaatgacattacgaataatttaggttcctaattttaaaactaatttaggtgttttgatcattatatatttttagttgtcttttgaaccagtaggagtagaggtataaaacaagtctctacctaaatttattttcattgcgtataagtcatagctggccgacaaacgtcaaccaatcatgcggttttgaacatgaaacattatttcgaaaattttctctgtagactgagtgaaattggaaaacaaaatgttcttccaatttgaatgctactataacaaatattttatcatgtcaataacaaacttaatttgataccatagaaagaaaaaattgcttgtttccttattccaaacatgatcaatcatgtaagctcacaggtgatgtgctcaagccacaaaaatggcttgcattaatgaacgtgttcggctagccgtactactgcaagccgctacggttgcgacaattgtaagtggctgacggctgcagctactatgaactgttgcagctgcagccgctgctgatcaacccattgtatttgagtaaacaataccaacaaaaaagaacaatcaagctagcaaaacattgctggaaatatatggagtttacacatccctatttgattaaaaaaaatggttatccatttgtacagttcaggtgtacagctcgagctggatcaacatcctaaaaggggccatggagttgtatgattcgacatctctaccgtgaatgccacatgccgtgctacaacaacacgacggtgcatcggtcacaagccaacaaattttgagtttcctgctgaatgacattttcaggtagggataaaaaaaaagttttgtgttcccatgcagaatgatatattccctccttccctaaatgtttgacgccgttgacttttttaaatatgtttaaccgttcgtcttatttaaaaacttttgtaaaatatgtaaaactatatgtatacataaaagtatatttaacaataaatcaaatgataggaaaagaattaacaattacttaaattttttgaataagacaaacggtcaaacatttttaaaaaagtcaacggcgtcaaatattttgggatggaggtagtatatttcactagtgtcttggatatgttttgtgttcctttacaatattgacgataactgatcaattattctgataaatattggtcatattcaaccacactgaattttaaaacaaaactgctcgataattcgattaagtttcaaaaaggacatatattaaactttaatttttttgataaaatttattcaacattaaccggttttcgtctataacatttcagttatcacgatttttcgtctataacatttcagttatcacgatttttcgtctataacatttcagttatcacgattatcgatgaaaatccaaagtagcggctatacgtgcctaaacaatattgggaaccctgatctaaggagtgcgttctccacgcccattttttcttgtgggaattagcatagtacctatttgttgcgatggatgattaaaaaatatatattgtaagattaaaaatagggaaaagaattagaagaagttaggaacttaggttccctttaaatcgcaggattgagaaaacgtaggaataggaaaaacttacgattttgatagcaatataggtgtaaaaaagagaattgcaaaactcaagaaaacacaagaatgaccgtttgattgaaatgcatgaaaaacgcaggaattggatgagagggatagactcaaagaaaagttaccaaaaggtagaagctattgttaaatttcctctaaaatttctataggattgtccattccatagaaattcaaaggattggataggattcagtcccttgttttcgtgggtaatttggagccatgccattataattttgtaaagtttgagatatgtcatcggtatctcaatgacatgtaggacccacatgagtcaatgatatgtgcgtcaggatggcatatcttaaattttacaaaattataatggcatggttccaattttcccttgtttgaaagggcttcataggaaattttcctatggaattaaaatcctccaaaatttctacgtttttcctccaaatcaaataagccctttacagtggtgaataaatcccagagtaaaagcacaatgtcagtatatctctttatggagacctcgcataatgttcggtaaaatgtggcccaaaaattcccaaaaaagtgttgcaaattcaagcatctgttttatgatttaatccatgatcccgtgggtgggccaaagtgttgcatcaccccggaaccacatcagatttaattattatgtgtacttccatatataagagtttgttcatatatgagaaacatggggtttcccataaattaaaacctcgacgaccccttcatgtagtacatgtaccatgcacttgccctaccggattagtgaaataagctggttggttggaacttaattggaagacctcagcttatctgaacatgcacagtcaagttcagttgggtggtcgctaccatattacgcacacatatgtacctgcatttttctagttgtaacagccgaccattaagctaggtcgccaacgttgttcctgtatatatggtgcccacatgaacgattgacttttccttgctataaacataaagctacagtctaagatggagtttgaatagaggattaatttatcagaattgctaaatatcattcgattgaaaataagggttaaaatcttaaaagtttctaactttaggatccgctttacaattcatgctccggcaaccctagctccccctccaactccggcaaccccttctactttagctccaatgaccgtcggtgatccgacgagttatgatttagggtcctgtcttaggataggggttgggaggagggagggaaggagaagaagggggaatcgtcaggcttagaggaatgaccgtgggagatggtggcctcgcggtggacggtgaacatgggtggtcggtgaggcgctggcggcggcgctagagccgcggggatggaggagtgcaatggaccggtgtgggcggcgggagcaaaacaatgaaatggttacaatgcgcacttcaatggcactgttgagtaggaggagaggtggaggggaatgggttgagggaggacggatgaggttgattggcggaggagggtgatgttgattcctttggctagtcggtgaggccggacggcggtagcgtagaaggtagggaaagcggggccatgggcaaagtagcagtggtggcgcggagggatgagaaagggaagagaatagggatattaaagttagatgtgttgcactaatctcaaagcaattcaatggtcgagaatttacaatattaggaggtgtatttcggtcgaatgtcatacgggcagtctcttaatttatttataattttgatttcatttaatattcctttttattttagacataggtagttttggagttaggcacaatttaaaattgttaaatgatgtttttgccctactatcattacacatttggatagttgacggataaaatatggagttattcattacacataagggggtaatgttcgtcacttagtaaaacacgcaaggtaaagatgagagacaagtgttagattctacgttgacttacgtttagatagaaaaaagtaaaaagaaaaaatgtgccacgttagaatcaaaggtagtacaaatgtatttatacaaaagttctcctgctaatttagtttgtaaagaatataattaaaatcacaacagattttcaaaaccaaacgaggggtgaaccacgtgcaccatgttattcctgcaatgttttcccagcagcaacaggtcttcccgatcctccgggctgtgtcgatgataagcgaaaggggcaattaaaaccaaacacatgtttaattaacaggttagttagatctttaaaaatctcgctttaattttatacttggggcagatacatgaacaaaggcatacgaccagtcacttcctagctgttgtgcaacggtaagatcattatagttattgacaaaacatggtaaaaatatattgagtaaaatacaccagcggttcttaaacttatcaggaggtttcacttagatccatgaacttgtaaagtacacatcgaggtccctaaacttgggtataagggtgagagaagatgtgacgaccaaagcagaagtcgcagtaatatgggatcacaagctggggaatgtgacacctctggaagctgaaaagacaagcagacagattttacccaagatcttgcagaagaaacacagtcctgctgtgacagcaggatttcaccccagggagacttccacgactgtaagataataaattgatattatttaacctaccaagtatatggccatttgttatagcagcacctggaaattcatacacctggatttactttcattcatagaagttaccacttttttttttttttgggaca

SEQ ID NO: 67510 - DNA, 16390 bp, Oryza sativa
ccaggcaattatgcgcagtacatcatgggtattgttgggttactaacttactgtcactgtgttgagaaaacaaaattcaagattccctaactactccaagagccaaaacatatgtactagctaatagcacagaggcagtagtttactccaatttcacactagttagcaacaaatccggaggtagaactatagccaagcaaagcagcgcagcgctagcgctccagtgcgtcttacttctaagaaaaaactcagtgaccgcgtcagttacagtgaaggaaaagccaaaaccactgtagtgaggatgaactcgagatggcggaccttggaagaagcggacgccggcgccgagcagctggtcggaccagggggaggaggcgcggaggtcgagggagcggacctcccgggcgccgcggcggagcagctcgaggcacagtgcggagccgacgaagccctggccgcccgtcaccgcgaaccgcacgccctcgatcccctcgttctcgctcagatgcatctctgactctccccccaagccgccgacgccgagatgcgctcggtggcggagaaaacgagggcgagtggaacagtatggctgtatgggtcgccggcgacggcgaccgcgctttactacctgtccgggtggagatcgtcggatgggaactcgaaaggcctatctctcatgggctcatgggccatggcccacgcggaatgttttttctaaaaaaaaatataaacaaccaacctgtttgtagaactaggcaagaattattttaagagctattttttagataagaaaataaccctctaaaaaaatagccctaagttgtttggattcaagggttgcttttatgtatcttcctatggagagagatagagagaaaagacgttttttcagtgagccccacccgaaataggctcaattagcaccccttgggtagaataattttttttgagtgggttatttccaaatagctcacccttttggatctttttggctatttggactattttttagggagggctaaaaaatatcccttggatccaaacagggccattgccactgtcttttaacatacgacgttattaacttttatgacattcgtcttatttaaaatttttatgtaaatattaagatatttttgtcatgcttaaaaaatatttaataataaatcaagttttaaataagatgaatgtttaaactatcttaaaatattaacagtattatatgtttaaaaaaaggaggaagtaaattggaacgtatcatggctttcatatcagaaaatttcattgcaaatgattgcatgattgcgtcactgtagcagacgctggagaaaagtagtggtgtggataagattttttaaataaaaattataaacaagaactggatgtgatttttaaaaagcatgtctgggaaaatgaatagacgagaaatgtgaaaagtggctgacaattttttttgattgacctgaggaggagaaaagagggaaaataaaatgtgtaaaatataggctgacaatttttttattgacctgaggaggagaaaagagggaaaataaaatgtgaaaaatatacggaagagaatagacgagaaatgtctgctgagaagcaaaaaaaataaaagaatatatcaaggtcccaccgagatttgaactcgggttactggattcagagtccaatgtcctgaccactagaccatgggaccattttgcttaaaaacccaagctgtcattatataataaaccattgctgtgctgcttaagagctccactccgaagcatccaggaattgcacagcgttgcttaggccggttctttcttgtcagagacaaatggattacaagatcgcctacaaaactagctatgaaccccagccagtgacgtttttggttgggtaagaagcaatcttgtatatgtcacagactccctccggcttgccggtgcccctcctgatcctgaaatacccttgctctccccagttcttgccccacgagttcttcatgatgatgtagtcctggccgtagtacgagccgtagcccacggccgtcagtgcatgatccggttgaatgccacattccccatcaaagatcccctgcatccagtattcagatacacccattttgtcagtttaatgtttttgtgctgatctgtactgtatcatggtgaatgaagattgaagaacagctgataattttgtttacccctttgtagaactgaaagtctctgctcccagctgctatccccacactgacaggctgatgagccagtgccttcagtaggcttgtctcgctgttcgccgggacatcctcgtagccggttatggtgatgactttggaatgaggctaaccaccagtcatcagttcatcacagcagataaattcaactgttagagatcctgctagatcactacatgtgtttacagctgaattgcctctgaagaagaagtggttttcatgtttctacctgcttttctctgcagtagccttcttccatgaggtatgggtagtcttcctctgtgtagatcccctggttccccattatgtatgcgaaggcgaagtccatcagcccacctcgacagccatgattgaaggtgttgtcgcagtccatcagttcctgctctgatagtgataccaacttgccggtcacaatctggtttatcccctcaacagctgccaccgttgaaaaagcccagcaacttcctgcaagagaccgttttctcttacagcattttcatggaacaaattgcatcatatcatacactatttcagatagtgatttagtattaatatgctgaaacagactgtgtgcactctcagtttcaggcattgagtatcgatgcgatgaaatagattgtgcacattttcaggcattcagcattaatatgctgaaattgattgtgtgcagggattcagtatcaccgtgctgaaataaattgtgtgcattttcaggcattcggcctcaatatgctgaatagatcgtgtgcattttcagggattcagtatcactatgctaaatagatagtgtgcatttttcagacattgagcttaccacattctccttggttcttgaccggtgtcactgctcccttcttcctccagtccactgcccagggcaagttaacggcgttcgcgtacctgaatgttgttgaaccatgtggctgagcatcccttcttgctaaccctggcttcagtcccaggtaactggccttgaattcttcatgtgcaatgtcagcaaaatgatttaagccgagccaatagctgccatttctcctgttcgtctccacaatgtgcctcaggtttcgcttgaagatctcatacctcttgaccttctcctttgggcttgcatagatcttgctatgttttactgaccatgatgtgaagagaccaacaagcttatttggcaatgcaagatcctcctgcgagtatccgacaacggaaggatcatggtgactagcagtggcagaacatgccacaaagcctagcaacaagaagagcatggagagcttggagtccatggcaagaaggctattgtttcctgccatggcatgcctagaattcatgaacactctttataatgaccagccatgtttcttgcaagtaattcactacacctgaaatctgaatacctgacaagggcccttctggctcaagctgtgaaggagtggtactagtaccttgctttatgaagaagctgcagttgcaggtatacttttgctctatagtttattcagaaaattgcttgatgtattactttattgttctattgatgacctcttatcatgtttaaattttgatttatgttaaaatagaagtttcttatgcttgcagccttgcaaacctctgaattggagataacttgctcaaccatgcgaagcaggtgcacaggcagcagtggatttttggaaggatggacaagtatcctttgcttatctgctcaagtcatcaccaaacagaagtacaccaaactattctattaccagatcaaccaaccattagtattttcccagttcgagcttggtgtacgtgctcataggaatgcagaattggctgggatgagatatctaaaagaatatagagaaagagaaatgtcttgaaaaaaagaagcaccatgggaaagaaagaactaaaaaatagacgcggctttgcctatgaaatactccatccgtttcatattgatcatcatttaacacaaattgaattttttaaattgatcatcatgttatcatagccccttcgtttgacgtgtaatattattgcatttaagcatgaaaattgagtatgcatgcatgtatgtaggaattcgaggtagtaaagctatcgtttcttagagcaagtttaatagtatagtcaaccactgacttcaaatcatctatagtcaatttagtaggaaattcatatactcctataaacatcactacacaatttatacttggtcgcacctgtcatacatacatgtatcttggagtctgtgctacagctggctacaaatctatagcccactgctcttctctcttctgttttatctcatcgaaatgtgtttataattggacctgctcttatgtatggggcctaagaggagttaaagtgtgcatgtttcttgatttttccctaccacatactcacattaaatgaaaataggaaagttaatacttttttttgtcttggtgaaaaagttatatggtaatcaatatggaacggagggagtaaatgatatggtatgataagtacacttaatttctttatctatttaatgcctgaaattatggaaactatgcccttttattcatatattaatttaaagcagcgagacattgaattcatagacataagttggaagtcgaatatatgcgcacaaattccaaattccaacgaaaccaaagtaatgaaactacttactcccttcttctaaaagtctaaaacttattctattctttggtttttccaaaagtttaagtcctatttatagtcattatgttttaaattaaattattgatcggaacccaataaaccattttattacttattggttacatgcttattggttttgtcacattgtaaataaattaattactccttggtcttggtgccaaaagaaataattcctccatcccaaaataaacttaattcctgggtttttgtgtctaacgtttgatcatccgtcttatttgaaaaaaaatatgaaaaattttaaaaagataagtcatgcataaagtattattcatattttatcatctaacaataataaaaaatagtaatcataaaaaatatttcatataagacggacggtcaaatgttgggcacgaaaacccaagaattgagtccttttggaatggagggagtaggtcttagacttttggatggagggagtattttcattttatctcctggcggagctaaaaagattttttgagcccaagcaaactatacttctagtatttattatataaatttcatcatcaattcattcaataacatataaatttaatggagtttttgtcggtgagtttgcgcggccgcctgcgatagccaggtgtggcttcacccctgcctccacatgtctgtaaaaatcaagaaaatccttttttaaaaaataattttatcttcttattctttaaacataacgttctaaaagtgcataacattaaaaaattctatttgcacaataaagaagagtaaggaataaattatttgtttgaaaatttggaattgcgttgagctcaagctaaagcaaaagatactggtacctccttattctcttctactacttaattatatcctggatactccctaaaaaaattatatcctggataaatgattgcaaagaggctttatctgcccattgcaacttgtatgtgcagccgaactgtggtccgcatcgtttgcttatttcctaataagccaaaacggcttattagaaaataaaaataaatttgtaggtaaaacttttataaatgtattcttggtgacttaaaagccaatgttgaaaaagaaactacgttgaaaatatctcaaaattaagcttgaaaattcaaaatttagttttttctttagctgattaggccatccgatgggagcctgtaagtgtcaactgagagcacaatcaaatgatataataagatctttagtttttctcccccacactatctgaatgtaatactcactgttttttcatttagatggcaacgtcatgcaaaaaatcagagccgtccgtctgtacattgatctagccgttcgtacgatgtcttcagttgcaggcttgcagctaaataaagtcatatatatatatatatatttgtccttcccagtccccagcccccgttcctagtcgtcgacgactccgctgctctccagtctccattcctcaatctgctccttgctcctcagcgtctccatcttcgccacggtgccgctgcgacaacggacagtatatggcatcctttgcaggaagttcgatggcgcctgtgtctaaaagatcgaagtagcgccgtcaacatgagcgaggagaagtctgcgatgcgctccctgtcctccacctcctgcaatccctcctgctcctcgggccgtcgacgggtggttcgccgcagcgtcatagccgcgacgtgcaggtgacagaggatccggcgcgacgccaccacttacccgtgcacgccgcctcctctcatccgctagctagcgccccctcccttctcctgatccggcctccgggtcgacggccaccaccgctactcttctcttcattgggctcaatggatcttgccgaagtttgtatcgtcgacggctatcgcgtgcttgaggtgactcctgcaacatggcgacaaccccgcgtgtcaaggaagggcagcagcatggcggcggggagcgcaggggagggcaaggtggccgggtggtggtgaagaagacgagcccgcgccttgagggaggacatgagtgggtggtccgctgcggcacgcgggtggcggaggatccggtgggcggcgaggcgtgcatcgggaggagggatgggtggattaagggtcgagcgcttttgccagaaaaaatcaagcttcgttggtccatcgcagtgaactttcggagagcaaggagacacatggcagattttcggagatgagaagcttaatttataggacgccacatggcccaatctctaaccagggatagagccctgatatcggtattagagatgagcattatagaaacactcggaatgtcacctcatgtgactaccccatacttaggcattttttacgtttttaatccctgtgaatacgtcttaacctcaaccgaataaatagtattttaaagatatcactatgcgttgtttaaaaaacaacactatgctgatcaattaaggttttggttcaaatggatttttttgcgtattattgagggagattatatactatattaacaagataaattaatactccctccttctatttatatatatgatgttttttagttaaaaatgaactaaccaacttcatatataagtggaaggatggagtaatttgagaaataaaatttagaaataacctagagcaagaggtacgaacaaaacaataaaagatttgttttttgagaatttgtatttgtataagcatggagaatatattgatatttgtaaaagcatggagaaaataatcattggcaatttttttaaagaaaaagtgaaaagaacagggcctagactcaggtttttccatcgtcacggacaatagaaaatcttggcttattcctagcactaggttagttttaacccaatatattaattaattccaaactaaaagtgatacaatgttttatccttaaggcccacttaaattatcctctgaattattactacatattatctgcctgattatgtgaaaaataaacttaacaggtggtatgaaacaagtcgactaggcattacagtagaggaaagtattttgaaaaaaaaacatataccaagtaatatgtgtaataatttgatgaagtggcaaaaagaaagaagacattgtcagggttatggataccacatacctaatagtagttgactaaatctcagcagtatccaccacataccatgtcctatacggaaacaacctgcggatataggaggagtttcggataaggaaagacaaccagagttctatatggaaacgacaagaactactcggattgtatccatattggtttccctagttctacttggacaagaggacacctatgggtataaatacaagaccccctaggaggagaggggacgccacaaagccataagccaatacaagccaacatacaccaagataagacgccggatatcgacttcagggataagcacggctaggatactgtcaggagagacgaaagcgctatctctgatctcgccgggtacggattcgaggaggaagactaacctgttgtcgaccacgagttagaccttcagatcaccatgccaacaacagttagataggctaccccaaatattgtactggtgtgattatggtgaataagagcaataccggcttcggccaacaagatgtagggttattgcctgataattcaggggcccgaacctgtataaaaatccttgtctccgtctcttttacctcagtctcgcgtatatcctaataccaacgatcctcatactatgcaaataccggaatcgcgacatcaaacgtcgacagacatataaaagtggtactcaacaatatttacacattcaaaaaggagtgtaacttaggctgtgtttagttcgtgtgacaaaatttttaaagtatatggacatacatttgaagtattaaacataaactaataataaaacaaattacagattccgcctataaactacgagacgaatctattaaacctaattaattcgttattagtaaatgtttactgtaacaccacattgtcaaatcataacgcaattaagctcaaaagatacgtctcgcgatttacatacaaactgtgtaattgattttttccgtccacatttaatgtttcatgcatgtgtctaaacatttgatatgatgaaaaagttaaaaaatttaaagaaaaaagttcgaatctaaacgataatattataggctaaaagttagcctgcgcgccaacgggagcgctcattttctagtatactaatctcaagctggccgttgtgccagaatttgattggtccacgtggcttaatcaattgcgaatgaattggtgaattcgaggggtcgttccttgagaaagaaaacgaaaacctctagacaagcgtaaccaaattctccaacattacacaagcgtaaagagaaaaaaaaaaaaaaagctccgagcacttagttgggcctagctagcccagtcgctcacctggacctgcccactcggtgcccctcactatgttgatgtatgcaagtgacgcgttgccaattcatctcctcctctcctcccttcctccttcccttcttctcttcctaatatagtctacagtataccataaaaaattttaaaaaacaaaaaattagaaaaatttatgtatagaaatactatatataaaaaaattaaattcaaattcaaatttaaatcaggtatataaacttttaacttataaactttgggtctataaactttaggtgtataaactttagatgtacagaaatactatatatatagaaaacatttgaattcaaattcaaattttaattagatataattcaaatttaaattttaatcgggtatataaactttaggtctataaactttaggtctataaactttaggtgtataaactttagatgtatagaaatactatatatgaaaaatatttgaattcaaattcaaatttgaatcagatatataaacttttgacttataaacttttagtctctaaactttagatgtgtaaacttgaggtgtataaatttactaaaataggaaagtaatgcggtgtaaaaaaaagaaaccaagtagagagaggggggggagaatctcgcccagtagcatttctgcctcaacagttgcgtgcgtgaacaaggaaaaggaattatgaggaaaacgaaaaaggaggaaaaaaattaaatacaagaaagaaagaagtaaaaatattttatataaattatatactatggcttgaatcggaaattgaggcagctaccctaacttcttcttcttctttttttcagggaagctaccctaaccaaatcgatatatttctggaaattaaagacaacaaaaagaatgagaggaacaatgcgaacttatatcataatttgttgtcacgataaccatgttttaaaatatgcatttttcacaaatacactacacatttgataatctctactaatatagaaagtacgaattcattaaacacctctctttcctaaccctcagatttagggcattcaacccatagtgtccataagcagcaatgtctatggtgccatatcaataagacatcacaatagaaactatactctacaacccatggtttcttaaagtgggctattaataaatacatcatttctctcctctacccacggattgccatgcatttggcactgactttccccgccctttttcgtaacaactccaaataaagatggcaccaaaatgatagttaccgccatagacaaggattcatttgtgaatgataaataaaagttacccatatcaagaccaaataatggatcaatgaaaaattgatccaaggggcttgaaattattggtccgccgcttccagggataactcatatttattcttcatctattataaagtcactattcttttccaatacaaaacttgatagtgtctagtgcataggttctcatgttgaagctgtgtcttgcatgagatccagtttcttcctctcttcactctctcttaattaatatagtgccacataagataaaagtcctacatggcaatatagttaatgccatagacaccatcctaaatggagggttaggaccgcccttattcatccaacgaatttatggctgtgtttagaacttcagctcccaacccctctctcgcgcacgcttttaaactgttaaacggtgtattttttaaaaatatttctatatgaaaattgtttaaaaaatcaaattaatttattttttaaaataattactaatatttaattaatcaagtattaatgtatcgctccgttttcgttctgaggatttgggttcccaacccgggctgaacaaacacagaaattagcgatcccactccgtgtgaacggttatagaaattaattagcgatccatctccccctcccctgccccgccaccttctccaccggcgccgacgcctcctcgcgcctaccccgtcgcccgccgccggcagccgcgaaccccgccgccgacgcctcctcacgcctatcacgccttcatcgcctgccgccttctccaccgccgccgtctcctccaccgccgctccttgccgccactgcatcctctacgtctccccgcacgggtggacgctcgccatcgaccccaccgacctcgccgcgtcgctcctccacctcttcaccggagccgtccgcgccctcccgccgctcccggccttcttcgccgagacggacgacctggcctgggactggtcgccgcatggcgtcatggcgtcctgcggcgagggactcctctttacgcctccgacccgcccgccgccgcctgggcccctatcgccgccatggccgactgcaacgcgagcagcatcaactactccggtggcgagttctttgtcttcgaggacgacgtctgctactgctgcaccaccatcgtcgacgccctcaccctccccatcgccgccgtcatcccggtgcccgccgtcgagctccccgccgaggcgcgcatcgcggtggcaggcgacgagctcttccttctcatcaagtccaaaggatgtacctcttcggcgacgacatcgacttctccaaggcttccggacagctttgacttggcctgacaggagctcaccggcatcggcggccgcgccctgtttgtcgattcctgcacggatttgccatggagaccgcgggattcgagaacctcgagggcaacaccatctactcggtgaccaccaaggaggtgaacgatcggcattccaccacgatgaagtacagtcggtgttcagcctggagaaccggagcttcaagaagctcgcctgctgcctcaacaagctggagatggccctctgcggcgagacgccgtcctggatcataccaagctggaacgaaggatgaacggaatcagagattgccggattggtggttcttgaagcaatggtggtcgacaaatctctgtctcactctcagaggatggattctaatctctcttttcttgcattccacttaaataattatgaaaaaattttaaaaaaatttacaagatagattaatacgtaatatattacttcacaaacatgtaagttcaagttcgacttctataagttgtaacaaaaataacaaattaaactctaactagtatatgtatatttacagtcaaatttgttatttttgttacaatttgtagaagttgaatttgaacttgcatgcttgtgaagtgatacatactaacctatcatgtcaatttttttaaaattttttcataactatttagataacattgataaccgcagcatcactattgcataggacgccggccaccttatcctccaggaggaccggtgcgcctgacatgcctttcgccgtcggcaaattggtaggggagaattcatttagatcatcagaatctgttggaaagaccactgcttcgcccctgcacatgcatgttgtgaaacagacagcgtcaaacagcattagttacctactaggagcagtaggtttgcatcagcgtgtacagtaattaacaaagctattgcattgaacatacatatacatatgtagtttcataaagaaaaatgtgaaagaaaggctctcgttaattacagtatgtggccgcgcgatgttcccggatcaatacacatggaggtgccgtcaagtccgaagaatccaatcgcgacaacctccttcccagacaaatcagcctcatcggagaatcccagaggaatgcagttaggcgccccttggacacggatcagagcaagatcaacgtgttctgagacgtgcaccaatcgagcagaggcgatatgatccgcaccaaaccgaacggacagttccttaggctgtgttcctcctgacacggagaacaaagcacacgatttagtgagattaattaagtattagctaaaaaaaacttgaaaaatggattaatataattttttaaaacaactttcatatagaaaacttttaaaaaaatacatcgtttgacagtttgaaaaatgtgtacgtgaaaaacgagtgaagggagttgggaaagagggaaaaagaacatagcttactccgcttaggatcgattacgtgggcacaggttaataccaagcacgacgctccatcgttgtgaacaacaaagccagttcccacgccaagtttcctgccttctttggtaaccagcacgcacgtcacctggactaccgaaacgcggtgttcgtcgtacacgcgctgttccggcgtccgcgacggcggcgaatcaccttggtaagcaacacaagagcaaaaagaagcggtacgttaaccacaagcaaattttttatttttttttaaaaaaaccattttcttttcttgcaagaggatcaatgaaattaagaacaaagcgctagttgcaaaggataggagtgcaagatttgtaactaacttctcttgcaagagatcgaatgaatgaaagaacagttaagttgtagatgagtgcagattcaaaactagcagcgccacagtaggatcttttggccttaattcaacagtaaatgggagggaaaaaaaaaagaacagctggcctacctgttggcgctgatgaggacatcttgacttgttggacttgcggaagaatgggacggagtatcggcatgtagagcgctgtttgtccttatatcatcgcccgccggacagagctgtccaaaaggctcgagacgcaagctagttcggctcgtttcaagcttgtttggagctcggctcggcaagaaatcaaacgccgagcccgttatgctgtgcgctttaataacttacgcttttacccccttcatcagccaagccatccaccccacaggccacagggaggttaagatgttgggttattaccccctttagtgtgctcaacatggacactgtcgatggccgctattgtcaccatatatacgagcccccacgtcgcgcaggaaccacgcccgtctgttcggcgccggtgttccaggaggtgcacccgccgtctgaggctaccatgcagtggcggacgcaggatttcaacaatgggggtacgaagttacagactacggactgtgtacatagtaccaaggaaacagttcgacgatgaaaatatactcaaaccactaatgaacactcaatcgaagcgcaggcatgcatatataaacaaagtatatctcaatctttatacataacttgttgtgaatgatttgtagtgaacaatgaacgaaaaaaatagtacagaagacacaactaaccgttgcgattgtagcgattatatggctgcaccacccataaagattggatccaatctagaggaagaaaataccattgaatgatacccaattatctctattatctagaagaagaaaataccattggacggatggttgtattgcttttttcaaagcctacaaatattttggcctaatgatctgtatacatagtatatattatcttttttgttaccaaaaattttgggggtacagctgtacccccatgtcccagtgtaggtccgcccctgctaccatgcatcctgcagctgcttttttgcatgtccagtccttccattgtggcattgtccattctagagtttggaaattaacatgaccaattgtacataagttttttttctttacacgaattgtacataagtatgttccatgaaaccatggccaagttattttgcaactcaactacatcaattgtgtaaaattgtaagttgattgtagtatttgttttaataggagagaaatgcgcatcactacttcttagagttgtctatttaggccgtgtttagatttaattttttttcttcaaacttataacttttctgtcacattaaatgtttggagacatgcatagagcattaaatgtggacggaaaaaaaaccaattatatagtttgcatgtaaatcgcgagacgaatcttttgagcataattacgtcatgatttgacaatgtggtgctacagtaaacatttgctaatgacggattaattagacttaatagatttgtctcgtagtttaccgacggaatctgtaatttattttgttattagtttacgtttaatactttaaatatgtgtccgtatacttaaaaaaaatttggcacaagaactaagcacagcctaaaccagcagtgatgcctagctagcaccaccgatttaaaaccgatagtaaatgtcccggggcatcattgtcgtatgcctcccacaggttctaaattaaaaccaagagcaaatcctattacgaaccgatcgacaggtctgtactagtgttcagcatcgtccatgatgagtactgggctactggcgcagctaggagctcttggaacggcaacgaatgcagcagcaggctatggcgcttcaccatgctctatgggaaggaattgaagaagagattaagttttttacacaaaacgatatggtatcaacatatgattgattgagttttaattattacaaacttgaaaaatatattaatatgatattttagagcaactttcatatacaaagttttcgcacgaaacacaccgtttagcagtttgaaaagcgtgccacgaaaatcttaatcttcatccaactcgtcacaataattaatatttctatgagttttccgctaaacccacaaaataaacacagggtagctagctagtctaatagtataggcaccaccataacaagactccatgtcgagactgtttggttggttcccataacatatacttcctccatttcaaattgatctacatatagtttttttaggttatttctaaatgatctacatatttgtatgcatttattaaagtctatttgttatttgtgcattggagcaaatggagattgatgcatgcatccatactgtcggtgacatggggccgggggtatcgtgactagaggcttcggtagccgcggtcacccacgtggcctgaccccctcgggggggggggggtcgggcccgacggtgacgtggccacccctccctctgtctccccgaggggtcgggccgctcccgtttcggccccgagggctggggcgccccgacccctgtggttttggcgccacgtgtgtgggttaggtgagcacagcgggctcacctaaccgcatttatagcagg

SEQ ID NO: 67511 - DNA, 25545 bp, Oryza sativa
taaatccccatcctctctctctctctctctctctctctctctctctctctctgctgcagcgagcggcggcggccagccggcaaggcgcgcacggcggcgcgccctctctctcctcccttcctttgctgcggcgagcggcggtggctgacggcccagcaccgcacgatagtggtgcttccgcggcgccctggtccggtcgctgcccgggcggctgctcgccgccatcgccgtcgtcttctctgaccggttcaccttggccctcttcgacggcggcggtgtcgttgcagcggcggcacctcgctttgacgatagccgccccacgcttctcttcggcgtggctagtgagctggtgagggaagggagcaaagagagagagtgggattagggatagagagatagagaggtggcgaactgacaggtgggcccaccgattttttattaaaagaattgctgactgtactaccatgtagaacaaaaccaccgcggattgggtcgaggggggtaatttttccggtttgcatagttgggggtgaagaatgtccggttttgtggtttaggggggtaattcggtcgaccgcgatagttcggggggataattcgtacttttttcttcttttttttgcggggtacttttttccaaattttaaaagtgatggatgtgtttagtttaaaactttactaaaatttggtacaatttttgagaatggaaacttctggaattgtcaaagtttggtagggtgatattggcaagtatatatgtttagtttgttgtaatttggtgctttcaaaatttgataagattgaaactagcgataaagtgaaaaagttattaataagcccataaatgccattacgccattgccacgaaacacaaaatccccgtgcaacgaggcccgaacgggggcgaatgggcgatcgatctcatcgcccgctctgcgccaagcaaacaacaggcaaagccgcggggacgacgttacgttacgttgttgtttagtcccataccggggagctaagcccaagcgctacgggtgataagaggggtggaccgaatgggaggcgtgcccaatgcaggcacacccggatacacacgagacgactactcgtgctgtggtgggaccacgtgtggaatgcacgtgtagccgaaatcattcaggaattcaaaaatccaccggcgagtgacggtgcgagcgcatgacacatgcgcttaagcgatctccatactttttttaaatttttttttgggtccatcaatagatggtttccatgcttgtttcatcaatgtcgtttcaaggccatgcttgtttcatttcatcaatgtcgtgcacagttatcttggccatttctgttcgttcaattaattggattcggtttatttaaggacatgtccagcgcagcgaaatcgatctgattttgccacggctccagatccaggctagtggcccaaccgttgtggcctggtgggctcgtcgcacacacgggtgcagatggaccgacctgatatgatcgggcccaaagaagagaacacatgtgatatataaaaggaaaatgaacaggacgaaatggcaacatctgagtgaatcaaatcaaatcaaatccactgtataagcagaagagttgttcatgtttggctctttgccatggatgaccaaccatgatttattgcaccttttccccttcgtacaaaacgcgacaaccatacggcggctgcacgcgctccgggatgaccaaattatctgagaaaaaggggctctcctgatcgacttcttctacctatacttggctggtgtacagagcgcaatgcataccagccagtgagacagatcgcatcacaagattaggacaacagtaagaagcttgatgccttgattagcttccattttcaaacctacaaaaatgcccagatcaaacaatctgcaagtatacgaacctctcgggagagaaatgccagaccactctattcgtaatgccacgggacacgcacagtactccaccctgcagcaaagcaaagccagcaacgacggggaggagaatgtttagtcccgtaccggggagcttggcgcgtgcgctccgggtgataagagggcctgaccgagtgggaggagtgccaggatgaaggcggcacacccggatacacacgaggtgagtcctcgtgctgtggtgggatcacgtgcggtatgcacgtgtagcaacaaaaaaatcttggtcatgacgaatcaatccacccagaggtgcgattgactgcgcgggcgcatgacacatgcgctttggcaatctccccccaaccctttttatttttcccctttttgggtatacattcccggttcgaacaaaggtactggaggaaatggcaacacgtatcagtgaatcaaatcttttttttttcagcttctcagttcgaacaaaaagatggaatcaaaccatatactgatatgctaaacccataacgttggacgtcaaacaaaaatgaaaaagaaatggagggagtatttttgactctttttctatgaatcaccagccttttattgcatcttccccttcgtacaacatgtgacaaccgaatggctgcaacaatgaaattatagaaccctctctgtaacgaccaaataatcggagagaaaaaaaaaaggctcctcatttctactacctacttgactgatgtacatgtacagagcgcaacgcatgcccacgtcgccaccacaagttttaggacaacagcaagaagcctagcttccatttacaacctacaaacaatgcccacatcaaacaatcggacaggtcacaggcgtcgtctggtgttttgctcttgtcggctgctgtgcagtgcggtgcagtgcagtgcagtgcagtgctattcttgttgtgccttgtcaagatcagatttggttagaggtgaggtggactgctctttgtctttgtcttttgcatttgccggccggttactctggttgacaaggtggtgaagccagacaaccaggtccagaatgtagtcctcggtcttcgccttgtccgcatggtagagcgtctcgaccacgtccggttggcctggcctccttccaaccctctcagtcctgaatgaaaacagcatacgaaaccaaaaatgtaaatgccatgtgtgaaggaaatcttagtttgcacaacgaactcgtagggcattcgataatgtagttcttaccctgatctcgcccattcgctaaaccgcaagaagcctcgggcactggagttcaattaaagaattcatgcaaacagagcataaaagtagttataatcctgaacgctcgaaaagctaaaattcaatgaagcttaagacattcattactacgtaacaaagcacagtaccacgtggtattgatggccattggaacaagccatttcaatgttttatccattgtagccctaatttgatcaatattgagctgcaacagaaaatcaggatttcagaatacaaatttttatataaccatagttctgtcattgtgtagtggtatcacctcctgaggcactgacgaagttcttaatctattaggtagtgccgatctcactcttggtggcaatccttggtagagagcatctcttgtatttggtggtatatatcctgatcgagaaaccttaaacagacaaaatttagtaaaatagctacatgcaaatactagctagtgggctttgctgaaaataccaattacgctctttggtgctctgccactcttatgttaagtgggtacaatatacatatgctaaacctacagacaaatgtgtagtagtttccaattgatctatgataagatagccaaatcatgccaaatcttgggcagacgtcgcaggcaaaatctgagggaacttacaacgctatagatctgtatgataatatttgcatagtgtaatgcaagtccggcaggtcctagtctctgacagtcttcagtagattcagaactcaattcaccttcatctacaaatatattacaaggatcagtggatagtcctgtatgatcgattctaacatgagaagtaggaccatgaaagtaccagaagatccaaaagaagcgttgatctcaaaatgcaagtactgcacgatgtctacaagcttctcaacaatctataaaaagaaatgaatcttatatgttataaacaaaaggaaaggtcaacagagaatataaagggaattccacagtaaattgttctcacatcttccaatgtcttggaccacaaagatcttttcttcaagcttttcacatagttcctttgactcttcaattctattctcacgacctcaatattttctcctggaagattatctggacacagtgccgaaattccaaaagattaaaagtggcattgctctgacaacttaactgaaatagatatggatattgaaaatacaaagaaataacatttttcccttagcttgagcaatccacataagtcatttgtttgggtcatgaatatcatttggttaggtaatgggcacagaactattgacacaaatatttgtcactctgtccaagaaatagctagaggattttgtaaaataggtatcatacctttctgatatgaatttccctttaccgtcagcttgcagcgataatcttgctcaaatctatccaacgcatgcagctcgtgatacaaatcctggaaaaaaacagccaaaatgagcaaaacctagattaatcaaatgatatattgaactacagcacaatgcttacagttgtacgatgaacaagatccatcaacttttgcatctctgcaactgctgtttcttttagctgcttctgtggtggattttccgattctagcctagattccgaagtaacaagtatgattaaggtctaatctttataacgattgccacatgcaaaaacatgaaaactcttacttgacaaaatagcggtccaggttatgccattggggatctttacaacggttgccaaatctgacaatctcttgtgaaaatattttcagctcttccctgcaaatattagccagagtgcacaaaacagttattgggttgtcagatggtaacaatgaaacattgagaacaaccatcaatcatctcttcaaccttttgtcattggctacaatccgcatcaacacactcatgtcactggaaattaaattctgcacgccttcagaaggaagcaccacttgtttgaagtatgtaacagtgtcttccgaaagagattgcataatagtagcacctttcaatatcgtgtttgcaacctcaaaagcaagaattgatatcggacatcctttggttttagccctggaaataaagccgccatctgtgctaaggcttgttgttaccaagcagcctatagtgtctaaaatatcaactgccttcccaaatccagccatgccggctgttccaagcactcttagtctgggaacctgcaaggaaatgtcggggatttaaggatatcgtaatttctactaagaaagttaaacatttcaggaattgtacatttcattttgtaatgctcttaaggtaaaacaagcaagatataaaagttagcatagtatttatgaacagagacaaacaagatataaaaagttacccactagttcaagaaaacacaactgcttgtgaaaggaaaattgccttcacttttgtccacaacttaccctgcttgatccattgcttccaggcctgtctgttgtcgactcgggcaatccctgtttcccaggcaaatctatatcttctgatgcggaaattcccagcttactgctcccggaaagaagaaaatcatcactattggagaagagattggattgactatccaattccagcttccccagcatggcttcctcggcaccagtgaccatctgtttgtgtgcagcggcgctcatcgcgtcggggaatccgctgatgccatccgcaccatcatccacggaccacgcatcggcgacaccaacgagccttcttgatttcagcactgccaaacagaaaccaaaccaaccgtgagcacagagcggaatcctccacctccaatcctatagcagcagcaagatccaaaaagaagagcacgtagacgcgtactgtagcaatccatccgcaagctgaggcccgtgcccgcaaggacggcatgaaagggtggctcccaacaaacccaattaacgccgccacccaacaaccgcccccccgctcggccgctcccctccccagcccacaacagctcgagccgcacggaaggtgctcgacgaaatgctcccctcccccaacaagaagtcaagaacacgaaatggggacgcagtcacacaatccggccaaagaacaactagaaacctcagcaagcgcagcagctaaccaacccaaccagcagaaacccaaaaaaatctctcacgcagcagacgcgcccaccaagaacggggagaaaaacacaccacagcggaaaagaaaaaacgaaaccgatttctccgacgcgggatgagcaggcgacgcgaggaggagagtagccgcgcttgtagcttgcttgaggatggagatcgggaggggaatggagtggatcaatcggtcgcccgccccagctgcggatggagatgggagcgatcgatttctttttcagctctactttttctttctttcttttttttttcctgggagccagcgagacagcgccgagtccacgcgctgaccctgtcttttgcgggggtttttttccagggggttgtcgtttggttgccggcgccaggattcgttctctgcgattggccggccgtcattgcttcgaatttttaaaatttttaattttaaaaagaaactattccaaaaacttagaccctgtttagatcccccacaccctaaaatttttcaatacatcacatcgaacgtttgaacacctgcataaagtattaaatataggctaaaaaataactaattgcacatattgcgactaatttgcgagacgaatcttttaagcctaattgctacatgattttgaaatgtggtgctacagtaaacatatgctaataacagattaattatgcttaataaattcgtctcgcggtttattaacggattctataattaattttttttattagtgcccgaacacccaccctatataataactgatatgacaagccaaaactttacaccccctgatctaaacacccccttatttatagaatctgatcatttgggctatgtacagtccatctaacgtggcaaaataacaccgacacgtcgcacacagggggagtgacagttttgtcttatcatgctagctagggtgtcatggtcaaatacgctgccacgtcagtcagaatgtgcgtggcactgttattttgccactctgttcaaatattgaaaataggttttaaaaagatttgtttttgaatttaaaaattcagaaagataaaaaaaatacgattgcgtcggaggctggatcaaccgcgtttttggtgatcatagggtatttgtttaccagctggtgatgagtacactccagatgcagagtgatggtcgtcacgttctttcaccgatcctctttcccgatgcgtacacatggatgcagttttatttttgttgatttgtctatatcgatatgtaagggcgtaaagattgtgtttggtccccagttcatttttttggtctggctcgactgttttttttctcttttctggttcgaaacgtagaaaggcttcagtctgcatcgatgcatcagttttcggcactgctgatcctggccctgctgccctgaggcccctgactcctcaaactgatctgcggccgtttgccgactgtgactcgggccgggattcccagtggggccacgcaggagaaaacggacaagtggaatcgtcacgcagggcttacaagttagtacaagttactcctacatccctgtagatgtagtataacctgtgaatattctggcagctcgcaagtcgcaaacgagcagcatccttttgtctcagttctcacaacaacaacagcaagaaaacaaagctccacgttccgaccagcgcgtcccgtcaagcccgtcgctgcgaccgcgagagcgagagcgagacgtggtggtggtggtggtggaaccgtacgtgagcgcgacgacctacctgcaccgcgcgatcccgacgcatcagctcggctcgggctcgcaggttggcgacgcggcagccaccccggccacccgcacgcacgccttcggcgtacgacccgcaagcctcggcgtacgaggcggatgtgggtggatcgcgggggtcgccgcgccgtgacggcgtcgttgggtggctcgcgcgaggaagcggtacaggttggttttccttgcgcgggcggaggaaataatcgagccggacgaccgtgcgaagtgctcatgtggtggtggttggtcgggtactcggggttggttttggtccttcctttcgattatgatatatgtggacagagacatctgtcctcacaccacatatgccacctgggggatgttgaatctgagccgcgcatatcagttgactttaacaaaatcgttgatcgaacagggagtgtagccataattttcttaggactcaacttgcataaattacgtaattttgcctatatctttcgtattttttgcatttatcttttatatcttggggttttgacacgtaatttttactccctccgtaatataaaaacatagaatgagataggactgaaacgagtgctacgaatctagacataagagtctcatttggtttagacggagaaaataatatatatttaggcttaggagtatggttataactctagctgccttacttctattttcaccacggttccttaatccatattgataatttgattaacacaataaattaatatttttaatataaactttgtaaatactagcttgtaattagttgaatgcttgtgctttgctacgggtaatagaaagtatattagaatatcatctaaaataaattaaaatatgttttatattgattatgttaactatcctttgccatagggaatactgagcgtaatttgatcttattcgtgggcatcatttagattcattgccaccaccattagcttcttttaaagaagtatagagatctttcgagaaaccatgggctgatttggtttgaagccttaccaaaatgttggtagtaaattttggcactaccaaatttgatagagtagatttattattagttaggcaaaaaatagtcacaatccaaatgttatcaaagtactatttaaagctaccaaaatattggcatggtacaaattggcactaatctaaatatgcctcatatttttgaaagcgtggagcaaatacaaggtggaagaggtacggaaaccagccaggtttgctttgtcaactcgtgcctggcgccgacacttctacgggactactgcgcgagaacatttctcctgtgctacaactccctacccatatagaaaaagaaaaactatagaagattggttgtccacgtaacaaggtcaaatctaaacttgatttagaaaacaaaatcagttgaaaaagaaataataaaccctatataggaaggaattttcatgactttctaaaggcactttcgcagcaacgttttaccgacgattgtactgccagctctcatcgtaacttcatcgaatttcattataaatggccaatttgtttgcgggtggatgaggcgtgatctgagcaaatcctgacagaactgcaattttaatgaccaccttcagaaaactccatctgaaacagcaaatggagaaaatgtacacttacgagatgtcgagatccctatataagctaaattagagcaattggtcagacagtagaaggattctgcacgattgagtaaaacgacagagatttgaacttcttcaatgggtcatccgtgacgtcagcgctcaaactgaaaggtggagctagaaatgtatgtacccacgtctggtctcatgatgatgcagcatgcttcaagattcagagacaaatagtgctactgagtgaacaaacaaataaggcaacgcttctacttgaccacaaacaaatcgtaattcgtttttcggctcaatggtcgaagatggcaatagaatcaagcccacaggccacagtacattgtacaaggctctcatcaacatcagaataaaaaaacaagcgtaaggctcatctataaataatcaacttacagcagtactaggacctttcgatgtccacttcctgaagctgttgacatcaaaatttgccatagtaatatcatgttagttacatgcgctacgggaactatactgaaaaggactactaccatatatgttcagaagcaacctaacatgtggtctggttggtgccatcttacaagtagttggcccaaggcctacataaagctcaatggggttagcctaggatcctacttaatgcatataaattcttcacataaattagaaactactagggggtgttaaccctaggctattctggcggactgccacgcaggtaaaaccctaccagaagccacaggcttttgtacactgtatggcacttcattgacttgttcacaaccatctagctcaagatctatgtagcggacgtcctggacgatgctggcagcatcagatatttcctgccttgtacgtgtctttgcagcgcgtttcttggactggaccgtgcgttcctcaaagtcgtcacagttggtagaggtgttggtgacggagaagcctcttcgcttcttgaccgcctcgctgtgctcgttgctgccgccgctgctggttttcctggtcgcatttggatatctggcgaggaaatcctctatggttgcaagcacacggtccccgtacttgttcagcttgttcctggatgaaaagcatgtgaaaaacaaatataattcttgctctacttctgaaaactgcttgtcaaaattacattgtgccatggggtagagtcattacttgccgatgccatttatctccacaagttcctctttcgttcttggcattcggttgctgatttccttcaatgtctcgtttctgtaggttaaaaaataagaaccacgttataagtcagtgagttctgtgccacaacaaaatgcataacatataacttacttaaatatgtggtatgccaataattgtggattttcatccattatctgagtcctaaggcattgcaaagcttcataaagctcggctgcaaggctctgcaattaatgaaaatagccattatagcataacaaaaacaattactgacaaaaatactgaagtagtagcttttataactaaagagccacagccactaccccgtccacttgactctgttgattagtcttattaattcgtggaactgacgattcatcgagtacacccatcttaggagccttctcaggagtggggaacctgcaagataagaggataaagaaattactctaaaaaaagtagattgtagtttacaaactattttttggtcacccagaatgcaaaattgtattcgttaaataacacaagggaacaacaccctgcatcatggaaacataagcaactctagagacttttatacacacactttcccttgtgaatttgcaacagtaatcagttaggcaacaagataactatatcattcaatgagggcaagtggaataaatatatggctgcttgtattgaagaccccaaagcagtcaaaattgcaaaaccataatgaactcggatgttcaaacctaggatgaactaggaaagctcctaatactatctccagtcataaataagtgatgttttggaatgtgttaacatgtttaaactttgacaatcaattgcgcttttaaatactttgattcaacttttgaaaatgtttttgttatattcatcttcaaaatttgtttcaaaacattatacctttgatatattttttcataagttttaaactagtaattagtaatagaagtgtattagtgaccgtgccattgtccaaaacaacacttatttgtggccctggcgggagtaacagtcaaaacaactctttaccagtatcaagctgtacatctaattttttttaaaaaaaaataacatgggattaaattccaacagattttagatgtgaagttcatatgcaaaagaaagatgtgattaaaaaaggataattttcagcaatatgtgtcgagcaaaatgagaaaaggacaaacaattttcagtaatatgttttaggaagaaaacaaacttgaggacaacgttgtgcttgccagagagaagatcaccacttttcttatgattagtctgcttaacaaacattcacaaaagaaaactatgtattagaccaaggtagagactagaagattaaagaaaaggaaaaacctagtaaatttgtctcaaagtaaaccattataggtgcagggtatatttcacctttaagacagatgatacagatccatagttttcgctctttttgacatcctcaatgagtatttcctcaattactagatggcgcaatattctcgctgcttcacctttagctagatgctttccagctccatgaagactcaaagtatcatggcggtgcttcttgacctgattagtagtaacagataaatttcaaataatggactagtatgtggttttccctgccaacatgacatatccggcagtaaaccaagatgtgttgtggaccatggagatatttccatggcactaaaagtagcctctggtgatgttatcataacaatgaacctcagaaccaaatgacattaattacttgcataatacatacattttggtttactgaacctctgtatacttcgagaatatgagtagttgaatatgtttgctttgtcatcattaccagatcaacctaaagaaacaatgtgagaatgtcagtttcagacaaaggtctgtgcatgtgttaggttgtttagaaggggcacagagctcagctgaccacataccaattgtctagcaatgttggtcacatctttttcgacccatctcaactctttcaagcaattatcacatgtttttgcacaacatgaaggattaaacatctctccaaagtggatcagctgtagtagacgtctgcagtccacatcattttcgcagtaactaacctacagacagaatatggcattgttatgatggcttccaaacttcaagcatgcagaagcatctgtaagatatgatagataccattcgcaggagattttccttatgcgtttcaagcgcttgttcctgcgaagaacctcctcgtggtgctgatgttccttgctccgcaaatccttgggtaaccatgtgtttgagacgaatctagaaaattttacgaggaaaatacttattaatggttagatatgaaaatagtgaaatactgataataaaaagaatctcttaactcacataatcagaataattgtagaacaggacacaagttgaaagctgactgtcacgaccagcacgtccacactcctaaaaggataacagtcatcaaacacagctaagtttatgccattttgatgtgcacacattggcgaaacttatgtcattgaaaatacctgatgatatccttcaattgatttgggcagggaatgatggataacaaaacggacatcaggtttattaatacctgcaatcctgcacaattagcacgaggcaccaataaacaacaaatatatgtgcacactatgaaaatcaagttacccatcccaaatgcaactgtagcacatattatgttgatcctatccttgctccactgtttctggatatttgctctatcctcaggatccatgctaccatgataatgtgatgccgtgtgcccatattcctgggtagaaaagcagtaaacagtcagaagttacagtggcacaggtctatagttccatggtgcatgaaattcaaactaagcacttgcaattacttagccatcaaagtcccataatctgatcaaatccaaatccaaacacatcacccaacaatctattcaacatgtccattattttggaacatcaagaattaaaacaactgccagtgtaggcggctaacaagactaggatacaaaaccgtaaactttatgcctgcacccactggcttaggtttcaagcaaccattgatttagtattgctttctcctaatttgattcaacgctctatttctcttaactccaaacaacagactaggaaatactacccaatcaagaaatggaaccctagaacatgtgagtatgggtacagccgtacaggaccactattacccataagtaaaactggtaaccaactggttactacccttgttatcaagcccgtacatctagtcacgactagtcatcagctagtcggccagggagcatgactcgatttgttggcggcagcagacacaataaaacaaagaaaacaacaatgaaccacctcggaggtctggtccatcaggcattattactgggtgaaagggagatggaggagagctccaccaggtccatcaagcacagcatgacgcagcagactagcagtaaaagcaactgctatgtaataatagtctgatagactagtcaactcaatgagtagtcttcaactagttgcgactagtcgccaagtcactagatggtaactcaagtagactttacaacttaaaaactatggtcactgctgcaatcttaaaccctaaatgggaccatgacacacaaatgggataacatacaatttcctaaatactcaaaacttctattaccaactagtatcatgtagtaaccaaaccttctatttacccacttgcttccttgtctcttttcgccttctattttttgtacttgtattcttcacagtattgattaaggatgattgaagagattacacattacaggcaaactaaattcaacaggtacatagtagttaatgttttgcaatattctaaacataagtagctaaaggttggcacataagtagtaattttagtcaagaaacttgagtaatacagaaacaagtaatatgttcttatattaccaaactgcaactttattacatatggggggctctgcttaattaaccagcatgtggaagtagtgcagaataacttcatttgagaaattccagataaaaaagaggaatggccctaattagatttaaaattatatcctagaacaatacttcctccgccccagaatgtaaccatttttggggtaggcacgggtattaagaaaatactgtagaaatgattgaagtagtattgtcattggtgaagaagagaaagtaggtgaagagaatagttgtgattgattgagatgaaagggtaggtggagaaatagcttcattttgggacaagttactgtgttagaaatagctacattttggaacggaggtagtacatctagattctgacagtattgaggactaagttaattcacagaataagataagaattttaatgcttaaacattgaaaagtacagcaggcttgaacaatttatagtttcaagaactaacccttaatttagcagccactttctcacaatccatcctcgaaaggcaatatatgatgccgcattctttattatgatttgcatgtataaagttatggatatcctcgaggcacttctttgtcttgggccatacaaaatacctgcaaaagttgggctgagatggtctggtgcaattggagttgaatgtcaatgtcttctgaattctgatagacttacctcagatttggacgattaaaactttgtctgaaaataatgcagtttgcaaggcctagaacttgcacgacatcttccttgacacttgcagttgctgttgcagtcaaggccaggactggcgtctgcgggaacttctgttttaaaatgcctagatgctgatggataaagaactggattaaaaggttgtcaattatttaacatgaaaatctgcttcctgacagaaagtacctggtaatcaggtcggaaatcatgaccccactggctaacacagtgggcttcatcaatgacaattctagagagatggcctcgcgaatataaattttccaattgtctcaacagagcatcactcctgtactcaggaaattaatgtgagttaggcacatgaattggcaaagcacacgtcacaaaagaaaggactaattgtgtgagaagctaatacaagctaaaggtgttgaatcttcataaagaaaaacaaagaaatgtaaccaatagtccaatactagtgatctggaaatgcgaactgctgcatagtgacagcaggtcattatgagcttacttatactatatcagaaaagactacctttcaaatagtcaagaaatcatataacatgactacgaatcaacagcagaattccacttacttggctatcttttcaggcgtaacatacagtaacttgtacgtgcatgtaggagacattaattctcttaatatctcctgctgttctgaccactccatgctggcgctaaggtaagctgcagaaatatttgcctgtgataaacaacacgtgagcaattagaaaatcatcaagaaataagtagaaggaaacaaaacaaccctttacctgcaataaatgcatgatctggtcttggatgagcgatacgagaggagaaactaccaatgtaacgccattacaaatgagtgctggaagctgcaaagtaattgatgagttttttttttctttttggacgaaaaagctgtatgaaaggatcctacggtatatactcatatattaagtaatgtacatatttacatgaaaaaccaaaacaatgactctttctaattcctgtccatccacttcttaataagaggacaatacctctctctctctctctcttgctctatggataaccatggcaattgaaatctaaagaaagcacgggaaaacttgtagtatgggattgacatctctgaagattttattatttcttataatccagatgctccaaggtaacacaagcaatagaatcttaaatattaacatagtactacatccgtcccaaagtatagctatttctagcacagtgacttgtcccaaaatgaagctatttctgcacctaccacctcctttcaaccaatcacaaccattcttcatttaatttcttcacctactttttcttctcaaccaatcataaccttcctccaatcatttctacctactctcttaataccggtgcccacctcaaaaatactaacattttgggactgaggaatcccaacaagtacagattgaaagcagtatggcttgttacctgatatgtcaaactttttccaccaccagttggcatcaaaacaaaaacatcattcccactcattgtggcgttgattatttctcgttgatttgggcgaaaagaacggtttccaaatactcttttgttgttggcctgatgaggcagcaagacaagtcattctcacaaacaaatgatgtttgaaataattacagttgattttgaagaaaataacctcgagttccttagtccatgcaaagtgtgtactactccactgtttatcaccagaaccttcagtgtaactgatatcaatagcccttggagtgtaatctctctgaacagacggtaatggcatgcttaaaccatccatataggaatatggagcagaagaaaagcataaaccactttccccaggttcattcctggtgtaaatcggtgattggaatatattggtatcctttacaaaagagctacttaggatgctagtggggtgatggccctgatgagctgttgtggaggccatagaatgagattgctgtcgctcttcatcttgggttaacctcgccgtatactccccaagcagctcaatctgcttctttaggagtgctctgcagagtgtaacagtaacattgcatcagaactgctggtagtcaaaaggagctaccaaatgcacgttgcaagagtcaaacttcatattttgaaccagaaatgccatcgttgggttcataatacggtcaagattatgtagttttcctccttttttattggaattgtgagcaatacattgtgagagaaattagctgtcaaagctcaagtttggagatcacaccgaatcaaattagatgtcaatggtgtaaggaaatattagttagtcagaccagaaaacaaacctcttttgatgaagatcatcagattgttgagggctgagttgaccgtcaataagctcatgggatattgcaagcaagttatccttcatttcaagcaaatgagacttcgcctctgggcaaaaagctagctatacaagtatagtagcaagtagcaactagtgagcttacatgctgaaatagctactagtctaaagaacaatgatgatgatttaattgctgcttggcttaccttgctaccgtggtcacacattatagagagttcttgtggtaaattattctcatcaaatccattgaagttgcacttctctaatggagatttggatgaccctctgggtgtatttgttgcttgataatgttccatgactattcggtccacatcaatactctgaaacgtaaaccaagagttaaaaattcaaagaagagaagtggatccattacaattatgacatagtagttataataattgcagacctgcagttgataagataaaaaatcatgaggcgaaagcacataccgctagaagctcatcctcatccatggcatctaatttagcatcatcacacatgttgtcaataaaaggagcagtcttgaataattcaggaccagttcttgcaagactttgatttgttgttgtaatggtatctgcctgcaccacatgattgttcaggtaagtccttgtacaggacttggtgcctgcaggcagatggctactgttcttctccatagtaccactttcagtcgtctgatgcatactttcctgggtgggattcctatttctggacacactgtccattttgttaacattatatgaagaacttgtcccataagtatgagcatggtcgctatcacaatctttcacttttccagataaaccaggtcttaaataattcttccgtgcaacctgagtgttgcgtagagaacgccaggcctgccataagaatgttcttagaataccaaaaagctcacagaagtaaacaagaatgtattaaaaacagtgagttttaggttaatgctttcttaacaaaggggtaaagataaaagaatgagaccaactaggatttgagttttctgataacgcgtcaagggttaactggacctattatatggaatgttagatgatacacctttggtggacagtttacaaggttataatgcaattatcctacctgatagctccagattggagttaggggaacccatcttttcaacaggatttattatgatggagcacatatatggttgcaaaggaaactgaataattagctaaacttacaagttcaaatgataagtgactatgcaactatctcatttttatgcaagtgatgacaaataccatgtacagtattactgtcgtaactcataccttctcaatggatggagcttgaagacgctctaggccttgaattctgcaagcagcagacctgaaatatataggtaatgatttgccattattctggtaaacaagtatcttttgctagaagaataccaaaggttacgaacaacaaagggtgaatagctaatttagtccttcaagtttcaccaaaggctcaatttggtccttcacgtttcattttgtccacatagctcctctaaatatttgttttggcttgacatcatccttgggcccacttaatatgccatatggctatttttagtcaatatttctattagaaaatgtcccttttacccttaatttatatacaactatatataaaaaggagaaatcaagattaataaataacattgcagatatactttccattatttcaacatgtgcacatgaaacttaagcaattgctatcgtatatacttgccagtacataatttattttcgttttacataatttactatacattatctataaaaaaattcaagcatacaatttttctcttatatatgtgaatgatgggggtataagtgtcatttatcaagagagttgttggttcaaggataagtttgaactaaaatgaaaacttgaaggaccaatatggatagattgaaacatcaaggactaaactgagcctcagatgaaacttagaggaccactttagctattcacccaacaacaaaatactctattgtataagaaagtagactgtaccttaaaggaagcattcccgtacaatctgcttcctgattaggcctttgtgttggtaaagagaacaaaaaacttgaactcaggaattcatctttgatacaggagctttgaacagcatttgcatgatccgaccagttgacccttggctttatcatggcaggtggacccaacggtgaggctatttctcccttgcatccaccatggcaacaattaacacatgcgaacctgttgaatgttggttcttgatgacctcgcgagctggatcaagaatgaggcatgtaccgggactgtaatctctgcgatgagagtgataagtctcagcatggttcaaatgaggaactattgaaagcttaactatgaataacacaagtgacagacatatacatatacacataataagttgacaaccgcacgcagtttagaagtagaaataatcgtgtgtttaatgtacaagttatgtactctctggcatctatttgaacaaaaattgtacagttcaccaaaacagaaaaggaatagtgagatttgcggataaccacctttcagttagacagcataatgggctttcactaggaaaaagaaaactcaaggccatgttcggttaatcccaagtgggactgggagggattggagggaatttgttccatgcctattgcggtgtggaacgattccccctcaatccccttcaattctcttcaatccccaccaaaccgaacaagacctaagggggtgaagcaaccaaatgtcagtagttgattgtgcaaatgctgacggctgccccttcgcggctgtgaactgtaagactgaactcgctgctcctcggttggagcaacgccctcatcaccgcggccacctgcctcacgccctcgccaccgcgcgctcccagaccctagaccgccccccccccccgatcccccgcccatctcactgaaaccccgcttcacgcattccgccgaacaccctacccctaacccccaacatcccacgcaaccatccgaagacaactcaccctcgaccctcgccggcaccccctccgcgctagggcacaaggccaaaacgtcccacagaattagcctcgaaaaatcacccaaaaaacaaaaaaccccagccatcaagggcgcgccgcgactggaccagagactagggaatcacctgagagaccgaccaagctggcgccgccgggaggaggacgcccgcgcggcagccgccgcagcagcagagacgcggcggtggccggcgaggaagacggggagttggggtttggggattttgggggtttctgcggaaatggacgaggccaatattattttggttcgtgagcgggagaggaggggattaaaacttgaaaaaacccccgcttggagggaaaccaatcgcggtttcgggctgatcagggagccggccgtcggatctgcctcgagattcgcgccgggtcttcccaaatcgcaacaagagccccgccctccccctccaacgggtagaaagaacagtggaagtggcaggtcgccctttttggttccacgtggcccgtgggccatggcacacttttcattcagaaccaaaagttttgcttcttttgggttttacgtatagttgtcgtagtagtctctttcttttttttcttggtttttcttgtttttctcttttctctcttcatttggtataaatcggtttggttaattatgttgtgtaaataaactctcttctcctttcatctaatattgacgtgcaattctttttcgctttcgcgaaaaaaaaaagttttggagttttgaatcccttcgaaatagcactcgcatcctttgtaacggaaagaatttgactgcttttttttacaggatctgagctgaaatcctgcaaaattcatgcaagagtcatgcaagagaagcattgctcggaccctgtttagatgggactatccctatcacatcggatgtttggaaattaattataaatattaaacgtagactattaataaaacacatccataattttggactaattcgcgagacgaatctattgagcctaattattccatgattagcctatgtgatactacagtaaacattctctaattatagattaattatgcttaaaaattttgtctcgcaaattagctttaatttatgtaattagttttgtaagtagtttatttttaatactctaaattaatgtctaaatataaagaataaagttaagtccatggatccaaacaccaccttggtctccggtcattcatgtcagttaccagtaggaaatctgagacagattcaggacattcaagaatgttcagcgacaccgagtcaacattgagaagttcaggttctcgtcggcgacagtagatcagagttcacagacggcgcactagtcgctaacggccactagcatccaacaggcctttcatacaaggtactagctgaatttacagtagttttgccaagacgacgacgattttcacaggacgaattgatcttcaaactccgcagctcgtcggcgaggctgtccactgcacaagaaaccggcgagcgatcctcaaacggcctctgctgtccagcatccgcagccgtcaccgccaccgaccgatcgacgaacgcgagattctccttgctaccaccaccaccaccaccaccacccgctgtgattcatctcatttggcaaatgtcatgttcagaattaccgtcgcggtttttcctggcagagcgtgagtaaactttgaagggttcagggtttcgcagctcacccgcattggtgcccggacactcgtacaggttcctcttcagtagaacggtccccgggaccgacaccagcctcagcctgctgagattcttcctgtcgaggtcgtctatcggtacgaacccgaacgccatcgtccatgtgtcgactaggctaggtatcgcggatagaagaagcatctctaccttcagagatttcagcatctgttgagaaaacatcaggtaggtttaagttctagagtggcaaatatcttaactagtagtaagtggtacacatgaagcatagaaatagtctgcacacgataagcaatgatgcaaaataacattctcttcgcttagaatttgtcccaaactataacaatttctccactaacattctcttctcaaccaatcacaacccttcaccgttcactttttccacacacctccacttctcaaccaatcacaacatctccccgtttaattctacctatttttttaataaacgtgtctaactctaaaacttcttatattctgggatggatggagtattattgtgtgataaattattgattggttcttaatttccaagctcagttttatatacaagcatgttaatctacctttgatctaaagaaaattccaagctcagacatgtacttcaagaggagaagactgaatcgattgttaagtttgaacaggatataggctagagagtaagtcggatgcagatagcaaatatttggtagaaatacaggtggaaattttcaggtccttaagaaggatacggtggggaataagtcagatactcggtgactcggatatgatgcttagggagtaagcatgacatgattctttgggtgatctttttaataaagaatccaaagtagactacaaaagcatcagtatccagctatctactacctgttcaatgtaatccatgagacgcctgcacatcccttgttgacgattctcaaggcaagtagctattagaggcatctccgccacaactgtaccatgtaacctgcataaaaatctgtgttaatcccagagtctgaaatattagataatctgaccaattttagggtgttgatttcgaacatacgaaaattgaactccgtaagtgtcagaacttttgaacgtgcagtacctgatggatgccacagaaatgatcctgtcatcattttccaatactacagtatagaaccccttgtaatccaaatgaacaaagtcagacctggaaaagaaatacaaaggaataaatgagtgcctgaaaatacatggaactaaaaaaaagagagataaaagcaaatattcgttaataacattaagaggacaactgattaatttggaaaggaaatagtcggtctcacctccaattatatagtataggtgggataatatctattcctgttcgtgcgtctattataggtaagaagcattcttccattatactcaaggcaatcactaatttcatgttgcactcagcgaggattgcaatatctgcagctgtagagacccgttgatcaccgttgttccggagaacagtgcaagagaagccatcaattgtgtgaatggggatcccaacacgagatcgcaaattcatataaatctgccaatatcagagcacagtgagttaggcataagccagtctggctgatggctgattgctttgtgtaacaaaaactcttttcctgctaatatattgacgtgcaatccttttgcgcgttcgcaaaaaatcagagcacagtgaggctgcttcaagtaaacattttcgctgtctctgttaaatatatggctagcattagtgaaggtcgaattttaggattatacctgctggcatcttcttccacaaaaccaggcacaaggtccaccttcctcgttgcacaaaagtttaccatatatgcattttgcatgatctggagagaaacaatgtaatgaacgagcatgtggcataagatttcaagcaatgctaaatcttgcggtggatttgggcaatataaggagctcagaaactgtgataagaagcatcacaaaatcaaagagtgaattatagttgaattaacagatctccttataagggtaaacattgcatgtaactgcattaacatatgcacaactactagagtaaattaaattgctaaaatgttctatgctatacaaacaaacaatcataagtgtgcgtggtaagttatgaaactagagcacaggaatagtgtgctgttaaaacaagaagcagcaatttatatggaaggtctaaagacaaatcttgctagcaaataaccagacatggtacggtggcaatgaagatgtgaagtgagacattacattggcgttcacactgtgcgcattctaaagcaggcagggaacttctgagctccttcaaatttatcacttccccacatatatcgcaaaggcatctatagcaataccagctgccatctggaatatcctgaaaaggtagaaagtgaatcagtaacatgaatgcaaacattgctgttgaagatgtcaagattgacggtctgaaacgttagctttacagcagtagaaataaaatgaagtagaggttgataaacaaatggcaagatcagttgttctgtaacgctggtgcaaaagatgaccaccctaactgataaaatgctatgtcatctccacagtaaaactacatagcaactcttaactaagcagtgtaatgcacacatgattaaacagatgcggtaatgactgcattttgctgtgagttattctggaagcagcatggcacagcacaa

SEQ ID NO: 67512 - DNA, 777 bp, Oryza sativa
ttcatgcatatttctattgtccgctcaatagtcaatttcactgcattcttcatttcccgaaagtcaagatcagccatcttgattggcatttggttaggacgaaagcagtgtatatctgatatacttccataaacgaaatcaagctatataatattaattacttattacaattttaccgttaatcactaagaatcaccttagcttctggattcacaaactttttatgaagaggtgtactgactactgaagcacattaccagagagaaatgaatgtgctgatttgaaaattactgtttgtcaagaagaattgattgtcgtaaagtttactttgtattctgtttggaacttataaaatacatctctttgtgtaacttagctgtcttaaaaaatcattacattcagttaagtccattcactaattcaatgtttgaatcaggaacacatgtgggctagtatgaacagttcatcagtaaagaatatacaatcttttataggctaactctggcacttctctctatattgcagtttggaacatggaactggtttatcttttaggtttgttgttggacgaaccaaagataaagaaaaaatggcagatcttcagaaagaggtagacatgtatcatgatttcttgtttgttgatgctgaagaagatacaaagcccccacagaaaatgtaaactctctctcctcttatgtttgtacctttttacatatacacgtgattaatcttaagcctcccctcttgttgcccatgtgacaggttagcgtttttcaa

SEQ ID NO: 67513 - DNA, 16520 bp, Oryza sativa
  unsure (1)..(16520): unsure at all n locations
tacatgtcactgttaagatgtcgactagcgagtaccatgtaatgccagtccaaactaacctaatagttcacgacaaacatttttctcatagtttgactcccttgctgatcagctccatgattcaagccgaagcaactcccttatccatggaaatgtctatatctttgacatattatcattaatttccattcattgcatagctaagctaaagtcctaaattcctagctggaactctgaacagctataccaaagttttgtcgacgaacatcatcaatttccgacagaaatgatcggtgaagattaattacagtctcactgtctccgattgcatcacatccttgacagctgctggactgtcatctttaactacagattccttgagaatttcctcgtcgcagctgctggactgaagaatgaactgaatattagctntgcttctagaagtgatagtagtggttagcaatcgtattttctcagaatcagtcagcagctagaatcattaattgttagtcaatgaagagtatctttactttaaaaatgatgaaaagcgtcttgctcttacgtagctagctagccattctccatttattttagtactcagaaaaaataaaattaaccaaatgtttgaattgaggatagattcagttttttgactattggcccggtccatgcttacccatttgacatgttagtggtgccagttatgtactgcagcctctgatgctgatcgagtgataggctcatagcaaacatagttgacgaaaacacatgaatgaccatatgagttgtctaggacaaaatattctgacaattgactaatatattaccccaatttgtccaaaacagttttgacatagtacactcggagagttttattttccttgtgcatgaggtgcaagaacgaaaagttcctcgtatttcgtactcctacatgataatatatactccctccgttttaaaatgtttgacaccattgactttttagtatgtgtttgaccattcgtcttattcaaaaaatttaagtaattatttattctttttatatcatttgattcatcattaaatatattttcatatacacatatagttttacatatttcacaaatttttttgaataaggcgaatggttaaatatgtgctaaaaagttaatggtgtcaaatattttgaaacggatggagtatatcacagcaaaacatcctgtcatagatcgattctcaaggtctaaactctagcaagatgctaaaattctaatcaacacttagtcacaaatgcatgtcattaagggtgtgttcgtctttaccacctcttcccaacttttactcaatcattttccatgcgcacgcttctcaaactactaaatacatttcttttgcaaaaagtttctataggaaaattgctttaaaaattaatattaatcaacttttaactttatttcagctaatatttaattaattatacactaaattaatattaaacaattcgaatgatatttatagttcaaactccgaaattttgatcgagtggttgttgaaaacaactaatcttactgtgtttttccccattagctgagtagctttttcggcccctgcagttttaattagtattcctcccagccattgattttgaagacaatattgaaaacctcaaaaagtcttttagctagttctacaatttatgtgctttgtcttgcacatgtattgagaaaggctagacttccaatcaattattctctaaggctccatttggtgttgcattggatactattctctagacatctcgttgggtacaattgttttgaacttgttattgttatgatgcaaaggataataatattttgtctagccttaatttgtctgtggaacaatactacaaacaattattgtctttattttcccaacaacttaaaaatatgagcacgaggcaacataacaaccacaaactgagtgtaccccttttacttctcacctagaatatataaagttcaactttctaaaaattgaagttagcaagttaaaataatgtgactatctataaaaacaatatcgattggtacatttattttcaaaatattactagccacatcgtcgtgctttgtgcgactattgattatgtttaagaacttatgtatatagtttattagttcagcttagcttttaaaaaggttttgacataagttaatttatttatagaatatcgattggcctagtcaactattgtcttttttaagttatatatgtttataagaggaattggagcctcctgttttaattcttcattatctttggcccctctctatttgtatcagtgtctaagatgagacactagaaacatacagaaattctcatatgtttagccatttgtgtttttttattaatgcatgtatcttttgacctaatgatcattggttatctaaactcttgatccgacggtcaatatgtttttgtgatgtagcacatccttatgcaagaaagcttgctgcttttactatacagtaatataagttcattaatatataacaatgtataattatgaaatatagtcaccagaattgaatgcgtgaacgaggagataacttatccaaagaaaatgctctctgcaaattaaaatgtttgtcatgtccttttttttcgttcacaccatgtttaaactatactttcattttacactgctgctctaagccaaaatctggtgttagagtgcaccccaacccaacgtcactctactctaacctaaagatcacaaaatttgacgatcactttatagtttttttagagaagggtattttttacccggcctctacatccaactggatatatgcagcctttttaatttgttaacttagaccctcaaacaactcaatctaaaattcgctcctatggagattcggactcaggactttacaatgctactcaggtcactggaagccctttcgcgacaatcactttatagatgcatagtgccatagtataaagtgcaacactcaaataacccatgttatataattagtgtttttttacttggtttgagaatatatctttacttgatttgagaatatatcagaaggcactatattttctactagtatataaaaaaggatcatatatacggcgcataagaatatgcagagaaatttatggcatgagcattcaaaatgtcccctaaaaattaacaaacaaacggagtaattaattaaaatcatttatctactcaatttacatagagtttgtaatcttacggcaggttgttgagaagactttgcacggggaagaagacgacgacgaccactgctgctgctgctgctggaattatgccctgtggccaacaagctgacatccctcttctcgttgagaccctgcaggatgccagccacggcatccatggcactgcaccccgacgacgaccccagcactatcttcagatgaagctcttgacacttgttcggtgaactgccctgatctgccgctgatctgctcgtgttgacctcaatcttgtcatcgtcaggtccgtcgtctcgctcgccgtcgccgtcgccggcgtgcagctgctgtgattcagatagcttcctgttcttctcctccagctcagctatcctcgccttgaggacgttcacgtagtcctttgctctcatcagcactgatgctttgtccttctgtgctcatcgtcgcacaagttacaaatcaattagcattaattaattggttaaaatttataaatgttactattaataaagcatatataggataactgatattagccatgctagtcatttttagctaagcttaagatattgataagcaccttatgagtagccaagctagcgagaatctagaaaaagctagaagctagattttcagcttctggtctccattttattttcttaattctataactatagtttgtattctgaatgctaattctgaattctatagctacatattctccaggtaacaatctagatttgagagagtttgggattatgtgagaatctttcgtcaagcaagacaacagattttgctcgagattctatatttacgtaagcttttagattaaattggtcggtaagtagacggaccttggtggcgggtgggagcacgtccctgagagccttgaagctatcgttgagcttctcccggcgcttgcgctccgacaagacgtgctgcagctgcagctgctggttctcgccgccgccgccgccggcggtggccgctggcgaagcccgcgcggccatctccatgatctggtagtactgcgcgagcctcgccgcgtggatctttgacagcaccgatatggccttcttgaacgccctctgtccaccgccgccgccggtggcggtggtcgccgcccctggccgccggaggagatgcttcttcgggcccaggtaccgggagtacggccggaacgcggtggcggcggcggcggcgccatggccgccgctgctccgccgtgctgcttgtcccggccgtggtagtagtatctgcgacgacacctccgttgtctggtggtggcaagaggcggcggcggcggcgagcatgagcgacgagttgtcgtcgcggctcgtcgtcgtcgtcgtcgtcccggcggagaaggagcggaaggaggacgacgacggcgacggcggcgtggcgtactgatgatcgtgctcctccatgtccatcagcatgtagatctgaatcaaataattcgcaacgaacacgatgatgaaaacatgattactccacaacaaaacaaagttcgtcaattactagcaataaacaagatgaattaatcatgaaaattgcctggctaagctgctgctgcatggcctgcgactgcgagttcatcatcatcgtcatcgccggctcctgctcgtggtggcgcagcagctgatcagtagtcgccatgtcgctccagctgcatctgatgcaagcacaaattaactaattaattaattaattacagcctgcagaagcttaagatatcaaggatagctgcatgcgtggcaacgacgaccaggccgccgccggccggtgatcaccgtgtaattaatacatatatacctgatcatggtgtcgccggcgccgccgtgcatgtcgccggcggcggccgccttgagcatccagctgccgccgtccatgcctgtacgtacgtacgcacgatcggatcgagctagctctagtcgcgttcaatcgattaattgctctttaatttggctgcttcttgagctatctcgtctttgattgggaatggtgtgtatatatactagctagtaggagctaattaagctgtgaacacacttaatcgtcacaaattaattagtgtgcatgcacaaccaaactagtacacataagcgctgattcgcgcgtattctaccgctccctccgtactcgtaaagtaagtcgtttaggacaatgtttaaatcaaatcttagaaatactccctccgttttgaaatatttgacaccgttgattttttagcacatgtttgaccgttcgtcttattcaaaaaattttatgaaatatgtaaaattatatatctacataaaaatatatttaacaatgaatcaaataataggaaaagaattaataattacttaaattttttgaataagacgaacggtcaaacatgtgttaaaaagtcaacggcgtcaaacatttcgaaacgaagggagtataaatcatgaataactctcaagttattgggtttgaaaatgtaaaaattatatgaatagatttgtcttgaaaaatactttcataaaagtatacatatatcacttttcgataaatatttttatagaaacaagaagtcaaagttgtgttttggagacagtgtcactgtccaaaacgacttcctttacaagtacggagggagtactaaatattcctatcgatttttaatatacaacgtcgttaacttctaaatatacgtttaaatactcatattatttaattgtttttacaaacataacaaaataagtcatgctataaacattttctataaattaattaaaaaaataaataatagttatataatatcttaaataaaataaatgattaatgtatataaaaagtcaagagattttttattaaaacctgatagtatatataagtaaggaaagtattctaaactctctaggagacatcccttattgtttatatgtcatttaaatagttatgacaaaatttgaaaaaaataaaaaatatagattaatatcttataaatcactccacaaacatataaggttaaatttaatttttacaaattataacgagataaaaaaatttaactataagtatacattgtatacttattagttatagtttttttttaacttgtacaagttaaaatctaacttacatatttgtagagtgatctattacatattaatctacattgttgaattttaaaaattttcttcagatgacatgaaaataaatactcggagtaacaaacgtatgtatcccgagaatttagaatccacgagtagatcgaaatgtatagtaagggtgtgtttgaggagaaggggattggagagattggaaagatacgtaaaacgaggtgggccattagtatatgattaattgagtattaactattttaaattgcaaaaatggattaatatgattttttagagcaactttcctatagaaattttttgcaaaaaacgcaccgtttagtagtttgggaagcgtgcgcgcggaaaacgaggagctttctcacccaatgtcactggaacgaacacagcctaagtcgtacgtggtgcaggctataactggaattaactagtactaggactagtagtttagtattttttaactgaactagtagtacgtattaattactcaactaattaatgaacgtacgaacgatgggggattaatcaatttatcgtaagccgccggcggcgtagcgtacgtacatgcattcgatcgggaacgtttcgcaatttcgcggacatcgtctatatatcatactatctaggattttattttaatttcgggatgaaactttggatcccttcaaattcagttcaaacccgttcagacttaaggacttgttcgaaactcaagtcaaatcatcgccgtccaatggtatatacgaattataaaaaaatctcatataagacggacaatcaaagttggacacggaaactcagggtttgtctcttttttttacggagggagtactagtacttttttttttttacggagggagtactagtactaagatttgtaaatcctaatactggacgaagctggctttgtcgttattgtgcgcatatatctgaattaaaaggtaagactactcggaatcagccaccattttgttggatagaagaggctgtaggtagatagaggccacagccacagaggctggaacaagatgatgacaagtcactcgaaaaatctctgctccatgcatactagtaacataccagcacagttaatcgtcagtcgtgccatcgtttatgagcaaactagttattccctccgtcctaaaagagtgtcattttagctataaactaagacatatagcaccgtagaaaatataatagaggcttggtctgatgaaagaataagaagagtgcacaagagaaggaagactgacttaattaagtaatattagcttccaatcctatggatcaagactcaaaataggtgctttgcatcaaaccagcccgctggactcaaccttagctgtaaatccattttctttataagcataaattgcaagtcctcgctagcaagccaaggtagcaatatgaggttgacacttatcgatagaggatgcgtctatacccacatgaattagaataagcacattactctcccttggaaatgtaaccaacattggcatgtttctatgacccaaaacattaggacgaccttgtttgaatcattaccaatctaaccttattaaaatattggtaatgacaagatttggtaaagcaaaatttaattttggtaaaggatggttgtttggattgttgctaatttttggtatctgtatgagcttgccaaaatttttggcaccaaatcagatagatgcttaccacattatggtcaccaataattttttggcatggcaagattggggataaaatcaaacaggttgtatatatcttccccacccgccctatgaaaaatccaccaactgcatacaaccctcaatttgttatctcccattgacttctgcaactcgttgcatgctatagttgtttgtccagcacatatgccaccacccttccacttcactagtggtgtcttgacgcttacgatgcataccaaaactaccgatgccttcctctaccccataaatacattcatctctaaggctccgttctgttcttcaactctaaacattaacttcctcgttttccatcgtcagcatgcttttcaaactgttaaattatacgtttttttttaaaaaacatctatatatatgttgtttaaaaaaaataaatttatttttcaaatttataataattaatattttattaatcatgtgctaatgaggtttctcatttcgcgtgcagtacgaatctcatccaggaggaatctaacgaagcctaaatcatctagcatgtttttgcttcaatccaatgagttcccgccaccccacccttcaagcctatttctttccactgctaggccattaccctgcctttctctatacctgaagaaactcccctcttctaccttcctaacccttcccaaccagcctccccatccctagcctcgcaaattacactaccagagattgtgaagccaccgcgtgcctctctacgttaccgagaggttttgcatactctcggtaagatttagaacataccgtgtgtttccacatagaaactcgggaacatcgaaaaattaccgtgttccaagccgatactctcggtatccgtgggacccactgtttcaccgtgacggggcatattatttggcttcgtaggtgatgatttccgtcaacgtgaaggatgggaagcgctattttcgttggcgcggaaggatggcggggctgcgattttcattggcgccaaaggaacagtagattcccgagaatattcagtgcatttgccttcggtaacagccaggcccacctgtgacccaattagcgatcacatcaaaaattaaggtagaaatagaaaagaagtgatatgatgccggaccgtacttttggtattatatatatatttaacatgaataaggcataaaagtgacaggttaagagattgaatggacaaatcagatgaggtttattgtactttatttttggaaaaaatacgaattaccccctaactattgtggtcgatcgaattaccctcataactcgaataccagatatatttcacaccctaaactttttaaaaccggatgaattaccccctgacaatatctagagtggtttccgtcctacgtggtatacacgtggtagtctaatcaatattttttttaaaaaaatggtgggacccacctacttctcttcccctcacccctctatctcttccattattcgtcgttctctctatctctctctctctctcatctctctcgcgttgtgtgcggcgaggatggtggtagacggcggtgaacggcggtgtcacggggagggcaccacggccggtgggccgcgccgaggaggatagtaggggcaacggtggcgacgactagctggaggaggcggggttcgagatgagggcggcggcgggccagcgacgaagctaggaatgggtttgagatgagggtggctgccacccgcgccgctcccctacgctcgcgcctgatgacagagagagaggggaagaggagagagagggggtgagagagtatgacaggttgaacccaccaaatttttttaaaagaaaatgttgactgggttgccacgcgtacgccacataggataaaatcgctctggattgggtcgaggtgggtaattcgtccggtatagaaagtttaggatgagagatatctgatttccgggtttagggggtaattcattcgaccatgatagttcgggtgagggtaattcgtactttttcctttatttttctcaagatttaaaaacataggggcaattgcgcctatgactccattttaaaggctaacaaccaatttaattattttttatcttgtttagtggttggccctcttttatcaattttactcatttgaccattctttttaaaactgaatatatggcctgaccttattctattaaggcaaaatttgctacaggttgaacccaccaccgcttgcttcgtttgtacgcctaatgagagtgaatgggagtatgagacaatcatattgcagtggagaagagattggagaggagggaggttgaccgatgaagagcgtaaggtgtacaatatctggtttgttagtttaggagggtataatccgaacagtatcaataattcactggggtaattcagactttttctttttagaaacaacacagacacaagtggtcatatactcacccctttaaacgtatgcacaacacatcctacccctaagaccggatacctcatacaacaagcgtctttgcatgaaatgcctaccactgaaacaaaaatagttgttaaggcgagtacgcatgccacgtattgaacttcaatcgggatgagtatgtttcactacaagaaatagcatttgtaattttagaacaaaatttatttaatttctttgtattattatcatttgcattttctttaatcagccgaaccctatatccttaaaataccattatcaggtccctaaagctggttgatttgtttttattttttttccaaagtattgttgaaacagacagatttatcgatgaaaatcaccaggctgacgtaaattccaaatggattttttttataacaggatgagttaaattggggttagtagatcacatagggctaatttccatatatctttatcgtttgtttttgtaagaaaaactcatgataacgtatcgtgccccacaaaccagaaatcgtgccgaaaatgtggcgggcaccaaaaatctggcgggctcttatccaaacctcttgggtggctaggtcacaaaacaatccccaatcctggcgtccaccactcatccccatcgacgcgcttcctagtccccccgcccccgcgcgccgccgcgccgcaaaccatcgagccccccgccgccgcgctgcgcgctaaccaggcccccaccgccgtgccgcccaatgccccatccagccccacgtagccgcaccacgcccccatccaagccgaggccgccgcgggcacatccccatcgaggagcacctgccttcgtccccacctttgatggccgtctccatcctctgctccaggtggaacgctatacacgaagtcgtagctccgtttgtgacccccgcctactcctcctaggacgccactgtggctgaggcaagcgactccgctcggccatatctacatcagtgtgcttcgtaaacgagaggtcagtaaagcaactccatgtttccatctgtggctctacaactttccacaaagaaccatggtatgttcatagttgatatgcattagaattagagattttagtatcagggtaaattagttctctttggtcagaagtttcttggttggggggagaacatattttgaatttgttgaacctcttgcagtcccgtttgtgcttgatggtacagattattgtgaagatttatttgccaggagtcatctagatattctaatgccactgtgcagtctttgtacaaagcaaacgaatatagtgttgcaaactctattgaatcgacatgttgtccatccttccaaaagagtgttgtgtgctgccatttccagatttgacttgtatctctgaaattaatatctggagactgtataatatgctaatggaaaggggaccaggttacagaaagatggaggatggagcggctaaattctttacattctggttagaaattatattcttcttgcattaaattatattcttcttgctgaattgaaattcagttactttcttgcactgaacagttatgcacacatttctacttggttaattataggtgctatttgactaggccgctgtgatagaaaccagtaattgccacatggcttgagatcatcttgtaagggggtggcacatgcagatggtgcaacattgctgtatgcaggatctctggatttttgttttttccctttagttcttgtttttatgctcttgcttcaatctgtgctatcaaattgctttgtaaagaatacatttctgcactaagattcacaagcagttggttccatgacagtatcctatctcctgtatctgttttagataaccaattttgcctcttctaaactgtaatcaggggtagaccataaattaaagatcgagttaagactgaagattgctaacaccctaatcagaatggaggagttgttctgttaattaattgctgcttgcatcttcttctattggttgtgttttgcacatattgtgtggattgaaactctaattcagtttgctacggcgaataagatttcaaattttccttatgggagagaggataagattcagttttttttccaaaaatatattaatttcctgccaatgcaacacaagatgacaatcatttcttcaagtgcataatattttaatgttctttttgcagaaaatcattgtttaaactatttggatatcatgcctgaattagagaggctacagaacatcatggaagcaatacatggacctgatagcaccaagcactccgcatggtcaggatcagggtgagatgtagggctagcgacagagcttggatgcaaatgattgctctatcccaacaattggttggatctctgtcttgattgaaggtaattttctgtcatggttattttatatcaatgtgttgtaagtttgtttggtacgaaagaaaaacaaaatgaagattaagagatccattatagtgttgactaagttaataatcagtgttgaacaaatgtatcatactaggagtctatttgcctgtgttgttgttaggccttcacaagaatcagtagcagagatgttctgcttcattcttttatctgtgcagtggtgtgtacacacacacattaagagatgcgcttgcaagttgtttcatgccacctctttgtcatatggaatttcatacttgtctcgcgttactttcattgacatgtttagtcaaaaaaaaactttcattgacttgttgcttcataatgtggtatgggaaactaactataatattatttggcactcagataacttttatgtctgatttcaggcatataatgatcatgccaaaggactgggattgatttatgttgtcaatgcacacatttggttagtcagccactaagatgtgtctattacctttccagcagaggttgtaagaactaaggctcattctgcttctcttgagttatgtgtagctagcgactttgtagatccattcatgttgtgttcttgcctcgtgatgttctcattaataccggggaatcttcaacttatgttcacatgatatttttctatggttctaatttatttctgtgatgcttgcctatgttctgcctgttatgtttgcgtgaaatctgcctgactgttgcttgtctcatatccgtgttgtactatcatgaatataagaaatctgtaaatccaggtgtacaatattatctagtgttcattctcagcaagttactgtgatgagctacacacacgggaaaaattttaacatccccgtgtgtccagtactataatcctctcggtaagctctgtcctgttaccgtgttttgcgtaccacacacggtaatgattgtttttttccagtgtttttgtacctctcggtaacactccgttccgttgcttctgtcccgtcttgtgccgttaaacagattgttgccgagtggctgtgttcactcggtaattttgaacatcatcccgactgtagaagcattgtcgcacgggaagaatctcacagtaaaggtgtgaagccaccgagagcgcgttcccgtgagcttgctctcggcaacttgtgttaccgagtgttttcaagatgttgccgagtgtttttggcacacggtagcttcgcagtctctagtagtaatttaccttgaatcctaactgattgctcatggtcctaccaccaccagagttggagatgaatcgagctctctagtcgccggaagtggagaagaatggcttggagagtagattttgttgccaattgacaggtaaggccgtaagggcaattcacttgttgcaaccaccaaaaatcatatgaatccaatttctactagcgcagctggcagggtgtgtcatctcaattggtagcatgaaaggctgaagagattcacgatggtaagttgggacatcatgtagccatttaatcttggattggtcaaagtgccttattactttttaagaaaaagaagtctaaatgtatttaccaatcagcggccagagtaaatttctacttacatactacctataggtaccgtaaaagggcctgattaaataagtccctactttagctgtaacatgtaaaatttggataattttcttgatccaatgggttgatatataggagtacttgactggttgacttcaactctagaaaacatattctagtataaaattgataaccaaagtttcaaaaagattaaccctacacaccaaacatttataatcggatagagtagttcttgattgtctaaatgtagaggctgagattatcccaaagcatcctagaagggtctgttcaaataactttaatttctccggaattttaaaaactttcaagatttgtgtgggacttttgggttgcaaacattggcccaagcctggcccaaatacgctcaatacactatcaagctagacagggatgggcttttgcgggccaggcaaagtttaggccctctttgtttaggcttagacttattggcctagatttttaagtcagtttattagcgtatatgatttatacgctggtggatttaatgtcctaagtttagtgatttagccatacatctacctcacataagccaaaaaaagcttctccaacctagcttttggcttaatagtgttagagtggcttatggcttaaaaaagacaaacggaaaagctgcctgtttgtttaggcttaaactttttgacttataagttggcttataagcctaaacaaagagggcttaggccctcttttaagcttaggcttaggcttaggcttattggcctagacttttaagtcagtttattggtttatatgatttataagccggtggatttaatgtcctaagtttagtagttgagtcatacatctatctcatataagtcaaaaaagcttctccaacctagcttttggcttaatagtgttagagtggcttatggcataaaaaaagccaaacggaaaagctgcttgtttgtttaggcttagacttttcgacttataagttggcttataagcctaaacaaagagtgccttagacaggtccgctagaaaggatgagggactttaagtgcactaattcctcagcaatttaatgcagtagtaagcagtgttctcccgacgaaaaccgatcaaattcagtgaaattttgacatttcgattggaaatttgaagcttaaacaatagatttggtcgaaattcagttaaaatttatcaaaagccgatcaaaatttatcaaaaactgtgataccgatagggctcgaaatttagtggtcaatcggaaatgtaaactctggtagcaacacgccaacaccacggaaagactgaaatgaactctggtagcaacacgccaacaccacggaaagactgaaatgaatacagtgatcagtacaagcccaacccagcagctgtctgaagcttaaccaaagcttaaacccaaagcaaaccagaggcagatcagatcagagctagtagcagcaagctcgcgatctcccccaacttctagaaccttctagaaccgccgaatgcggctccaccacggccgccaccaccaccactctgccgcggtcgccgtcgcggtagcggacgacgacgacgaggccaagccgcgccgcccatactccactttcgcctccccgcgcgcgcccacgtccgcattttccgccgccttctcaacccaccgcctcctcgtcctcttctccgtcgcctgcctcctcgtcgccgcggcctccctcgccttcgccttctccgcccgcgccgcgaccctgcagccgccgcccctcgccgccgtggccgaagccaccgccaaggtcgccttccgctgcggccgcgccgaggacaccctccgcgccttcctcgcctcctcctcggggaactactcctccgcggcggaggggagggagagggagaaggtgctcgccgtcgtcggggtgcacacggagatcggatccgccgcccgccgcgccgcgctccgggccacctggttcccgcccaagcccgaaggcatcgtaaggtttccccccacattgctttcctccattcccacctaccaacttggatctagctactcgctttgctctggattgctgctgctcatcttacgcttac

SEQ ID NO: 67514 - DNA, 16923 bp, Oryza sativa
cacataaaatactatttatgttttatcatataataacaacaaaaatattaatcataatttttttttaaataagacgaatggtcaagtgttgaacatgaacaatggctgcacttatttttggacggagggagtatcttagtaatagtttatactccctccatccacttttgatagacatattttcaaatctgaaaaatttacttttgataggcatattttcaaatctgaaaaatttacttttgatatgcatatttcaatccaaccatctatcataatgactttctcggatttaatgcgtgactctccattcttccacacagaattggatacatgggtatcgacaaatgtaaatattaatgaatcgtttgtttacgaggaataattagtaagagtagcatgtttaaatggatgataagtagaattacttattcttgattattgtgctaagataaaatataactatcaaaagtagatgaagggagtagcttaggttagtgacgaacaatatttgtgcagcagtgcaggtgccaaccaaataaacctcacaaaaaaaagtactactagctagccgctactaccgcatttgttgtgatatactaatcggtgattagactcacgcccacaagatgatatgatgtgaggaaggtgagacacattcttctttgagagccgccgcttaatcattacacagatcgttcgattgaccgctgatagaccggtactactcctaagcacccaaaatctggttagtaattcaatgacgcgactaaattaacttgattaatcatttaatgtactgatcatgacgtgcaagtccaaaacactgaattgtccctagtacggtcgtaccaaaagctgaaatttgctcagcttcaatatactccctccgtctcataatagctgtatttagatccaaactttaaatctaaactttcaactttttttcatcacatcaacctgtcatatacacataacttttcagtcacatcgtattaatttcaacctaaactttcaactttgaaaggaactaaacacagccaatataataaattttgggtagatataacatactccctccgtccttaaaaaaaagacaatccctatatccccgaggcaagcttagtattaacgtaaaattaccaaagtgccctccttaactgcattcgtcgataacactgccattctctgcacacatcagtactactactaaaactccagtactttggaggaaaggcaaaaaaaaattgagttgcatttgcctcaaaaaaagattacattccgccggaagaaaggaaacaacctgcaagaactataccaagaaaaaagaacagataagaaccaagaatagagggaaaaaattgaaatcaagttcctaaatcagatctgccacatatagccctgcaaactttagccttcacctcctgcatcacaacagcatggccctaccatcgccactgcatccatctcccgccgtcgtcgccgccgcatccatctcccgtcgccgtcgcatccatctccggatgccgtcgccatcgccgccgcatccatctcctgctgctgcatccatctctagacactgtcgccgccgcatccatctccggacgccgaccgccgcatccatctccaggcgttgtctccgccgccatcgccgcatccatctccggacgctgtcgccgctgcatccatctcccaccgccgtctcaacgccgcatccatctctgggcgccgtcgccgccgccatcaccgcatccatctccggacaccggcgccgccgcatccatctcccgccaccgtctccgccgcaccatccaccgccgccgtagccatccgccgccgccgtcgccggggcatcgatccgccaccgccattgtagagaggagcgaaaggaaaggaggggcagatctggagggagagattgcactaaggagaactgaggaggtagagggagagagaaaccaaatgagagggaggggataaggttgccgtgtgaaccggagaaaagaaaagttgaggcgctttgactcggtgactcctcaagaggacccatgcctattgaatgtgtatcgaattttgggcaggaatcggttttttgtgggacaaacaccccactccaggaatcgatttttttggacggagggagtatcctagtacaataaatctaaacatacatccaaccaaaatcctttatattatgggatggagggagcaataagaatcccatcccttctaatacttgatcattaacaacctcatcaagcctcagtcatttgtccaaggcttttattttggaagtgttcagaaattggattcgtgctccaatttgagcgaaaaaaaaatacaaacaactatccgaattttgagtttttacccattaactcttgcggtccttttataatatatagacatataatagcctatgcctccgatcgtggaagctacatgggtagagaacaacatagccattagtccattatacatggtgcaggtcgctttccgtcaggagggctgaagaaagtgttcctatctactgctacatatgcctaacatttaggaaccgattccagcaacaaagctgtgagaagctgagtggaatttaggcagaatctcacccatatgccatatcaaaataattaggaggaaaatacttcatttgattaggtgtgtcagatgcatccttggtatactgagatatttaagtatagggacccacatgttatagattgcgagtaacaaatacttaattattacatctttaaagtagtgaatagttaaatgccccctacaagagagatctgcgttgcggattcatctgcactttcgtttggattcgccgctgcttcaggagagaataccgattcaaaagttgtccactactgcaattaagaaaaatatctcaaccatgtgtgtgtgtgaataccctcgcatttgcatacataccattgtcctgattccaaaaaaaaagaaaaagcaattttacggtccttaagaaggtacactttttctattttaaatttggtgtctcttgatgtaccaaattttacactaaattttttatatctctcaaggaccgtaaaattgctcaagaaaaatagtaaatctgtcatttttgatagcaacattatgtaccatgtcgctgcaaagttttcatttgatattgtaccagccacataccaaaggcatctgaaaattggaatgttttcttttccaaaagataaagaaaaaggcaaacaatatttcagtgctttcatgtcaagaaatgcctgaaaaaggcaggttccatagttttttttttcatgcgatccaaatagttggaaaaaaatggaaaagaaaagcaatatagattattgtagtataagacatcactctgcagatattcatgatccaaattatagctctagagatgaagaaacaaaaatttaaaaattccaactttgaatgtgacatttgtttttagtgtgatttgcctttcgacatgtatagatggaatcctgcattttatgcttgtgtaatgatggatgacatatttagctgtgatgtttgtttgtttaagattcttttataaatatttggactgcaacaaaaaatcaaggtcacatgctcttgaaaacttgaacagaaatcaagtacattgcctacttttgttgataaacttttagaaaaataaattatgttgatcaacttaaagctttgggtgggttgactgaagtgtgtgagaactcaaaactggatgtagatcaagactcttcatcattttctttgatatggaaggctgacacatgtttaaacattttctctattatataccaaccgtcgtttttgtgtaggttttggcttgaccgtcacaaaaattgtatttttttttctgtgagtcctttgtgggaccaacagaaaatgtacacaccctcaggcttgcttcgaagtgtgatagtgacatgtttaaacattttctatactaaaataaagaggcagtcctcctccacctccacgtaagaacttttctctctaaaaaccgttcaccctaaaaagccagatttcaaaaaaatcaacaattataaaaaattcgaacagagcaatgggcccaaataattctactaaactgaattaaaaaatgattctaaaagagcgaatttggtcactcccatcgcaaagaatattgagttgaaaaatgccattgcaaaaagagaggggctgaaaaaaaaaactagtgataaatgtaacaagctcttgaaaatactattgtggtttctttccaatcctgccattagtgcctttttcatagataaatttccaaatatgtcaatgctttttattggggtccacaaatatgccaatgctacgtactctgatcttgccatcacttctattttgcatttctgttctgctatatatatatatatatatcagcatctctagcctaggttaatatgcagtaaatattgggtttagttgcaattttccctaataagaattagcgtggtgttgaaaattaaaaaaaaaggtatagaatcattagagaaacaataaagaaattatcgtcaagtatatagtacagaaaataaaagtacatacaattaatatagatcgaattagctgtaaattatcaggagtccccactagaaaattcatgatggagaagtcatggaaatgattttccaactcaaatattcttcttgctgacgtcgtttagcagcctaaatttcctaaaattaatttggtctgctagcgtattattacagttcacttttgttcgcaacggtcccgggcaaatcatctcgatcattcgatctaaacctatacctttgcttgaaacctgatattccgtagggtggtgctccagaagttgacattgcaagggcaaggtgcttcctttcattaactaaaaactaattaaacatcgaggatatcacaggacagatcttagccatatgtcttatcgggcaaaattatgatgatgttcgccggtaacctgcccatctaatctatccacatagcctttcggaaattcgaatctaaagacacgctcgagcgtgcttagtgctctccaccggagtaggctagctattttcccaagcaaaggttagtttgcatgcgcatacttgaagcataccacattcacgtggggaagacttgtaaggtcttatatatagtcttacaatatttgccatcggaaaccacacgaggaacctgacagatcacataataatatgacaagattaggcttgcaaaagcagaaatgcaatatttgtgagttgtgatccgtttactatcttttgctgttttgcatggtttacacgtctgcagctcctttctgagctatatatattttttaacgactcacaccaaacagcgtgaagtttatattgacagagcaggaaaaaaagttacaagattacaatcttaggaaatcgtaaccaggaaaagaagaaaaaatagccgccacccacacaccgacagctccagcaaacatccttgtgagaaggctagcaccggaccggccgccgctaggccaacaaaggagtacaagtgatcgagggagagaggatgagagagaagatggaacctctctaccccctaggcccttcgatgtggccatcttgtataagctagggcatcgacacaggatgacaaagtctagagcgagcttgcaccatatgtctgggaggtttccgcaagagggttgccaagacgacatctccaggggagaagcaacggaagcaccgccgctgccgtccatcaaggtctcagagagaaccaagactagattttcacccggcagccctgcaagaggagatggaacaacacgacaacgccctcaagaggggaagtgacacccgaaacgccattgttgccgccatacaaaaccaggataggttttcacctgccacccgccgcctgtctatccacaactaatacaccattgctccaccacagtctaaacctctgttggcgcatggataccgctgcaccggttccccagccggtccagcctccgcgtgccgtcacacggccaccctcgtcgcgcgatccacgccggcttccaacacgcgtcctcacgccgcaccgacctcccgccgctgaccatgcatactcgcgccaccaccatggcctccagtcagcgccgccgaagcctcccctgcaagccagtggcgccagccttccactaccgtcggtgctgtccacacaactactgtctccgccgcacctccacagctggctgtcgatgccgacctcccgctgcaccatcaacggcctcccgccgtcaacacctccggccgcaccgccgaactccatcatcaacgactccaaccacaccgtgatgcgccatcctcacgctcccgtcacgccgcacgtggtttgctgggggcgctgggggggcggtgccagatccgccaccccacgccggggaagcagtcggccgccgcgtcccacccatcgcgcgccattacgccagacgtcgccccctctcccaacgcgttccactccacctcccgcatcgaggaggagcaacgccggctcggtttccccgccgccgccttcccagcccgccgcgcggtttccggcagcgggctctagcggcggcaaggcggcgagagaggtgaggagggtggcggcgcggctagggtttcacaggagcgtcgcgggggactttgagctatatatgggcaccgatggatttcattagtcggagcgctggctgctttttttttcagaagtgcacgggtagtccttaaacttattcggatgtgtcatctaggtccctaaattctcaaaatacatctttggtccccgaacttgtcatgagtgttatatagatatatctaaacgggctccaacccactcagtgagatgatgtggcatgtcacagtgatgcttacgtgtcaatgagatctatatgttagtcacatagaaaaattaaaattttgaaaagaggagagaagagaaagtgatgtttttaattttgaaaaaaataaatgaaaaaagagaggagaaaaaaatatgttcttaattttttttctatatgtgactgacataaggttctactaacacgtaggcgccaccatggcatgccacatccgcacacggagcgggttggagtccgtttggatctatatgacacgccggacaatttgagagaccaaaaatgcattttgagagttgagggatttaggtgagacacgcacataagtttacggaccacccgtgaactttactttttttttcaggagaaaaggtatcgcgctatgtaatcaatgattttttatttcctttttatgtaatcaatgaatttattcttgtactgaccaatgctgctgacatatcttcttgatatacactatacagaatttagataatcaaaagatgtgaatatatccaaatcattctgattgatgacgccttattagtttcttttcgcttttgctattcatcatgccataggataaatattcgatttttctaataatataaccaaaatagcaccctctgaatgatgcacatagctggttagcgtaaatatcttgggggtggggggggtgggttaacataggggtgtaaagatttggcatgtcatatcagatattatatagggtgttgtatagggtgttcggacactaataaaaaactaattacagaatttgtcagtaaaccacgagacgaatttattaagcctaattaatccatcattatcaaatgtttattgtagcactacattgtcaaatcatggagcaattagacttaaaagattcgtctcacaaattagtcgcaatctgtgcaattagttattttttagcctatatttaatacttcatgcaggtgttcaatcgttcgatgtgacagggtgtaaaattttgatgtgggatctaaacagaccgttgatgacatgtcaagcgccttctacctcgagttgagtaggaggcgcggcatattgtggcagggaggagtcaccaatggcagtcatattaggccgtgtttagttccaaaataattcttcaaactttcaacttttccatcacatcaaaacttttctacacacacaaacttctaacttttccatcatatctttctaatttcaaccaaacttccaattttggtgtgaactaaacacacccttaaaactcctgtaagttcagaaatttcatgtcacggctatcagatgtgggaatatagacctataggaaaccctggaaggggtgccaacaatacgagtgcagttctcaataaaatatcttgggttacctctagatcataatactaacggtcttatgcaatttcataaaataaaaagaagtaattttactccctataactattttattggatcagttaatcatctaaattgtttttcgttcattcataggatcaagtgctccaataattagtttgagatagtacagccgttcgataaatagaaaaatattgtattcttatagaataattaatactccatccgtatcttagcactatcaatctagagataggtcatgtccaaattcgtagtgtcctatagatttatagtaatagaatacataaagcctaaaccctaaaccgattctagcacagtgctatgaatcgcttgcctcatttcgtgcagttgagaagctcatccaaacatccatatcgaagcggagcctaagcgtgtcaagcgaagcactatagaagtggcagtgctactgcgacgtgcgtgttccccctctaaattcacacgtcaaatcaacgtgaaacacggtgcattctcccctcccaccgtcccaactcccacgtccggctcggctcgggcctctccgtgccagagagtttcactcctcgcggagaaggaaaaaccggaggcgcgcgcgcagtcgtggccggggttgggaagatccgagaggcaaggggcaagggcggcgtgcgggtctgcaggatcaggatcccgaaaagctagcccgcggcgaagtaataataactgctcctctgaatctctccgatcctctcgaaccacgagaagctcagcagtttcggctccgcgcgccgcctgcctctcggtcgacagcacagtaaattccgccggcgcgtggtgcagctttgccggcagcgtgccgctcccacggccatttacttcgcctcctctcctgaggcaggtcggtgtcggtatttatgtatacttgcacagttccacttcccggccagtctcctcactctcgactactcttctttggtttttgctgtgaaggcgcgcggctggagacgggaagaccggggaggacaggaggatggtgccggccggcgaccaggcggaggaggccatcgtggcggacgccgggaaggaggaggcggaggtgcgcgcggccatgggcgtcgagcaggacggcaagttcagcatgacgagcctcctgtggcacggcggctccgtctgggacgcctggttcagctgcgcctccaaccaggtacgaccaaccacgaacgacctcgtcatgcctctcgctcacatttcgtttggaattttgcaggtggcgcaggtgctcctgacgctgccgtactccttctcgcagctcgggatgctctcgggcctgctgctgcaggtgttctacggcctcatgggcagctggaccgcctacctcatcagcgtcctctacgtcgagtaccgcgcccgcaaggagaaggaaggcgtcagcttcaagaaccacgtcatccaggtcggcagggctagctcctctccttgcacatcttcgcgtcagtttcagtttcgtcagtttccgggttttcctgcacacactactgcttaattattttccccgacggaattcgatccctcgtgatcgatctcatgccggtatttcgagcagcgcctgcgtgcgagcgagcgttgcttgtccaacggaaagccgcttttgcatgctctcgcctcctgcaggttccttatctgcaacgcgatcagcatgcatatctgcctccagccagcctagtgcacgcatcagatcaactggcatatggattagactaaacttaatatggattatctaaaaatttactatttttgtgttctcttatgccactgaccagtggttcgaagttcttgatgggctcttgggcccgtactggaaggcggccggcctcgccttcaactgcaccttcctgctcttcggctccgtcatccagctgatcgcctgtgcaaggttgactcgccgagttcttgagacaaacatacatactcttctttttttttttgtaatctttgttcattgagatgtcactgaaattgtaatgcattgcagtaacatatactacatcaacgaccggctggacaagaggacatggacgtacatattcggggcgtgctgctccaccacggtgttcatcccctccttccacaactaccgcatctggtccttccttggcctcggcatgaccacctacaccgcctggtacctcgccatcgccgccgccgtccacggccaggtgagtcctcgatcatcgcccgccgtcgtcggccataaatcaataaatcatcagccggcacatgcttgaccacactgtttataagcatggttgcaatgattatgtatgattcgattcgatggggggctaataacgatgtgtatgattcggcgtggccgctgatcgaattcgactcgatgtcgcaggtcgacggcgtgacgcactcgggcccgagcaagatggtgctctacttcactggcgccaccaacatcctctacactttcggcggacacgccgtcactgtgtaagtgcactaaaagaaccctatgctactgtaaattgtgacgcataaaccatgcaatgcctctgctaattttgtcatgaatggttatcgacaactgggtccagtgtccaagccagaattccggagagccatctatgaaacaatgatgttcgttgttacctaccctagatttagtctggtttctgttttatctttagtctctccctccttggcaaacttgtttaatttacggaaaccagaagggttatcttctagccattggttacaaagaaatggagcatatagccactaaggttggcgatcaccctacagtcctctgctcaagttcctatgatgaccaccaagcatttcaatactcctagtgaacattcctttattcccgttgtccatttcttgtgcttaatctaagatacctgctatgatgatctttgcatcgcgattattaggaataattagaaccagtgagatgttcagacgccctggtattaaatattgagtcctttgtctttaaaattcagctactttttttgtagtggtaaaaatgttctttccaaagggtagatgatatggattggtttcagtccagctagtgcggagttaacatcgaataaaccaatcccgcccaacttcagtgatagcctggtaggacatatatcggatcgtgacaattcattaactgatcggttatggttcacgattccattttatctttccgtgataacctttgattagtgcagtgaaagactactttgagaattccttccctactcccaagtgtcagtttgacattacccttctcgatcgatcacagtttcttgcccaaagcaattcagggctttttgagtgatgagtgatgacagtaattgccattacctgagagtgttaggtgcttgtaatcggcaagtagcttcatttggtcgtatttgtcggtccccctctgcttacttaccatcaccagatgtgtgtccgcgtctgtgcagccgaatgatgtagtgaaagtttggggataatgggagattcctcatgtcccaatctttataaatatcctgactaggataagcactaccttgcccccctgcttgatctcttatcattcaatcaacttaaagtaaagttcttatatatcacttggcatgtgtatgaaaaatgtccgtttagtacgttttgttccaagcggggctaattctgatagcttcatatatgttactagtactgatattattattatttaagataagatgaacaatttcttattttgcataatcaaataatctgtacatgcatgctgaattagagattgtgctgttgatcggttcacgatgaacgaagctgacagtgaacaatcgtgcctgaagttctgaacagttgacgaagtttaattaactttttacgcgtgcagagagatcatgcacgcgatgtggaagccgcagaagttcaagtacatctacctggtggcgacgctgtacgtgttcacgctgacgctgccgtcggcgtcggccatgtactgggcgttcggcgacgcgctgctgacgcactcgaacgccttctcgctgctgccgcggtccgggtggcgcgacgcggcggtgatcctgatgctgatccaccagttcatcacgttcgggttcgcgtgcaccccgctctacttcgtgtgggagaaggcgatcggcatgcacggcacccgcagcgtcctcacccgcgcgctcgcccgcctccccatcgtcgtgcccatctggttcctcgccatcatcttccccttcttcggccccatcaactccgccgtcggcgcgctcctcgtcagcttcaccgtctacatcatcccctccctctcccacatcctcacgtaccgctccgcctccgccagattggtaagtgtgtgcagctacctttgccttttctttacttaccattaaattgcccgagtagattcctcatatatcaatatgaaacatgcactgtttgtctaaaaaaatttaaaaatatccgagtagaaatcgggctgtcagtcggtcaccagtgccaaagtgacacaaccacacattacactacaccaaggcactcttatgctagctaggatgctacacgcatgagcagaacggctgggtattgcatattggcacggattattggtaagcactgtgcagatatggaatggcccccacaagtactgtgatcaaagtaagtgtagccttccactatggcaccaaagcactagtgccacacgcacgaacagcgccgtgacgccgagagcgctctccctgtgctgctccggccaaacaccgacaggctctcggtctctggtgccccccaacaacgacggcgcggccacgcggatcggcgccggtttatttggtcgggtacgcctgctcgatcggtcggcggcgacagggatggccggggctgacgggtcgctgtcgctgttccgcctttctccggctgtgccggcccccggcacgtacgcctggaccgtataccttatcacgcagctcgccggcaggcggcagcacggcgtgaaggtcatatctgcgcaacatcaactgacgtacagcgtgtttgatttttttttttatgcaaacagaatgcggcggagaagccgccgccgttcctgccgagctggagcgggatgttcgtggtgaacgtgttcgtggtggcgtgggtgctggtggtcgggttcggcctcggcggctgggccagcgtcaccaacttcatcaagcagatcgacacgttcgggctcttcgccaagtgctaccagtgcccacccagggcgcacgccggggcgcccctgccggctccgccgcgccactagccaaaaaaaccgagtgccacgccgcgacggcgcgacgccgcgcgcgggccggtgacaaaaggagctagcttccccgcgggcgtcttgcctttgtgtagtaggacagcaggtcagcagcatacatggtaggacagcgcgtgggtcactgactagatttaccgccctgcaggggcttccctatgctgcggagtcttcagttcatgtgtgttgttggcaactttgcgtcgtcctcttttgtttgggagttggatgtgaacttggtcgtaatttgtaggttcttctgttcatgttacatgccaatataaaacgccatatttgttcatgtttcatgcgggtataaaacaccatatgaatatgattggatcatgaaagtaaatgagttattatgctaactaggaaggtggcccgcgcgcatgcacgggcacttatattattgaaaggtaagattactattttttaaaaaattttgtttcatagattaagggtaaattaaagttcggataatgttattttataataatttaagggttatatttttcttaaggtattttaaaaaaccattcacaaacgtttgagtaggagatggattaagtacttacgacttttgaatcatgtgtttttctctctcgagtaaataagaaaggagaaactattgctaattgattattatacagtccatctatatcatatagtgtagtttggctacaaatgaaaaatacgagactaagatactcaaaattcttgtgattaaatcatctcatgaaggcgcatgatatagtaagaaagggagggaagactatgcatggagaaaaaagaagaaagggaaaaatgaaaaaaaaaaagggaggggaagcgtagtacccacgtacgtaggtgtatacatgtgccatgggaggagaggtgggacctcgtagtatttagtttgttctaagatcgatttaatctaacaaattatgatattggacgtacatgttataatatttagataccttgcttttttttcttagaacttctaatatttgctctaatttattagagcaccatgtggcagcttgagagtattttaaggaattttaaaagacttaacacatgtaattagaatattaaccgcgtaatatgtatgtatggggtatatggtaatatttgttccagctttatccatggttatatacatgtaaagagaaattaattatgtggctagcaagccactagatgtctaattaatagcaaataattttgccgcatatttacagttattcatagtagctcttacatattcatcttatgactttgattatccgttgatccccaatttactgatcatcatgactcgcatgaaaaaaatgtactacttagggtttaggacaggtgaaattgatgaattatctgttttatgcgatagctatttgagggtataaacaaatcaattgacttctaaaaagttaaaatgttgtttaaaaaagacaccatttagaaacttggaaaggtgcaaaaaaaatccaaactatggaatcggaaaaaaaagatggcattaaactcccttataacacccttgtcttagtaagaattatattgatattagttagtattgtgctcgtatttataacataatgatttctttcaccggtacaaacaaattgtacaaaatccaaatactacataacaaaatacattataattattctgtaatcaactctcagtttcagcttaaacagagctaaatgttggaaaaaaaccaaacccttggtgcctaattcttctctcgctacatcacacttttaattttctttttatgttattagcaaaattaatcatatccatatatgatttgatatatggcaaagctgtagcgctgcaacggtcatgatcaccttagatgcctcagacatgatgctttgtcatgcgtgcgaaaggcaaaggtgcagacgtgcattatgcagcgggccaaaaaaaactttggacattttatttattagcaaacaatagatctgatgatttaaataatgggtccaccagtcctagtgtaagtgtaaattagttaaaatagattttaaattgttaattaaatgggtacacaatatataatggtatatactttattttaaaacaaaccaaatattatggagtcccacctctcctcgaaacagtgcattatttgagaataataatccgctgtaacaaaaaatagatccgatgatttaaataatgggtccatcagtttaagtgcacatataaattaattaatatagatcttaaattgtttatttgataggtacacaatataattgtgtaaattttattttaaaatagtgcattatttgaaaataatagtacaagtaatgagtacaccggtttaagtggaaattattttacattattagtttaatgggtaacatataatgtgtaaattttattttcaataattgtagagctgtatgacggtagactctttggttgtaaaattatgattatttaaaagaaatatatccattatataatgaaaaaaagaagaaaaaaaggaaaaaaaaaaggaaggaagcatacgtaccatacatggtacacgtttgcatacatatgtgcgggtgaaggaggagaggtgggacaccatattatttggtttgttttaagatcaattttatctaacggtgtataattttggaaccaccaatttaagtgaaaaatcaatggatagatgctttgcttttttcttagaatttctaggattttctctaatttattagagcgccacgtggtggcttgagagcgtttgtaagaagtttaatggacttttagtatataattgatggtgttccatgttcgcgtcgtgttcatttgtactatcgtacacaagacgcgttgtgaatttgtgatagttgaaaggaaatgtatgatgtaggcaaaattttgttagaggacaatcaaatgtgtaatttgctggaagacatcgtaaaacgtgtcatggctaaaagacactctaaaaacctggtaatttgcttgagaacacttttagctcaattgaagagagaaattattaaaaaaagatgaaaatacctctatggtcaaaagattttgagctgagactagagtgaagatgaaatataatgtatactagtgtgctgtaattggggtgatctaaatttagaatttcataattggaaaaagtacgaattaccacccccgaactatcatggtcatccgaattacccccttgaaccacaaaaccggacattcttcacccccaactatgcaatccgcggtggtttcggtctacgtggcagtccattcagcaatttatttattaaaaaaataggtgggccccacctgtcagtttctatctctcctatcgcttctatctcactgtctcactctctctctctgcctcttctccctcggacggcgacgg

SEQ ID NO: 67515 - DNA, 14013 bp, Oryza sativa
ctcgcctccgcccccgccgctcgcctctccgccgcccccgcggcactcgcctctcctctgcccccgctgctcttcaccgccgccgccgcctcgcctagcctcgcctcgcctcggccatcgccgtcctccgcttgctggctcggccgtcgccgtccgaaggagaagagggagagagagtgagacagtgagagataggagagagagatagaaactgacaggtggggtccacctatttttttaataaataaattgctgactagaccgccacgtagaccaaaaccaccacggattaggtcgaggggggtaatttgtccggtttgcatagttgggggtgaagaatgtccggttttgtggttcggggggtaattcggacgaccgcgatagttcccggggggtaattcgtactttttccttcataatttataaagagagaatccattatatgccactgactttgtcacacgtccacgatttgccactgactttgtcacgttctacaatatgccatcgatttttgtttaacttctacgatttaccatcgccgtccggttagtctccgttagtattgtacaaatttgtcgaaatgaccaaaatacccctgagacaaaaactttcaaaattcggatacaaattctaaaatatcagattttaaatttttggccaaattttggatgtttacaatcttatatttataatatgatattttgttaattttatccaatttttggaagtttttgtcctaggggtattttggtcatttggacaaaattgtacagtgctaacggaggctaaccggacggtgatagtaaatcgtagaagttaagcaaaagtcgatggcatattatagaacatgacaaagccagtggtaaatcgtagaggtgtgacaaagtcagtggcatataatggattctctcatttataaattattactctcctatcagtggcattcttgtcttcttcaagaactagcatggtggcccgcgcaaatcgcgcggctagcatcattatattttctctcatttaataatatatatgttttctcaatgtattattcaaatatattaaaatgacaacataattttaaaattttgtattacctttacgaaactactaatgtataatattcatattgtattttatatacatgttagttattaattatttttaatatcaaattttagttatttgtaaattatattcctatatggactctagactcgtcttttaatatttatttgtttttaatttcgaattttcgttatctataaattgtatttctatatagactctaggcacttcttctaatattatttatttttaattctgactttttcttttttctaattgtatttctatgtggaatctaaactcatctttcaatattctttaatttttaatttcgaatttcagttacttctaaattgtattcttatatttactttagattcttcttccaataattttttaatttctaattttagttatttgtaaattgtacttttatacgaactctaaactctacttttaattttattatgtttattccgaattttagttagttttaaattcttatatggactctatactctacatcgaatattccttatttttaattctaaatttctattatttcttaattgtatttctatataaactatatactctacttctaatattccttatttttaattccgaatttctattatttcttaattgtatttctatatggactctatactctacttctaatatttcttatttttaattacaaatttttattgtttctcaattgtatttctatatggactctagtgtcctcttccaatattccttattttttaattccgaattttctattttttttctcaattgtatttctatatggactatagtgtcatcttccaatattccttattttttaattctgaattttaactatttctaaattgtatttctatatggactcagtttttctttttctccaattaatatgagaatttctaggctatgagagcgaacgtggaggctcttttttctatttctttaataagttaatagatttatctctaattaagttaaaagtgtcatctagcaaattcctaattttttagaatatcttttagtcgtgacatgttttttctatgcttatcagcaaattacacaagttttgggtgtgctgtagcaaaatttaccgatgatctatggtgggctgtggccgcccaaatttattttcacgtttgtaagcccatactgtcacgccggaaataacaattcgtttaatcctaaattgggcttttagcccatgtagaacaggagtactagtacaccacaaagagtcctttatggtaacgatttcgtagaattttgtgatttaggcgaccagaaatcagttaatactcggtttgagatggcgatgaggcgatgagatcattgccttttcggtcgaatctagcagagcggcgagcaacccccacccactttgactccgatcctccccgcccccagcgcgatagcccatccgatcccaaattccggcgagatggcggtcagcctgtggcgcgcggtgatgggcgcggccggcggcggcggctcctcgtcgtcgtccgcggccggcggcgacgcggggggcggcgtggagttctggcacggcggggagcgcacggggtggctgaacaagcagggggagtacatcaagacgtggcggcggcggtggttcgtgctcaagcaggggcggctgttctggttcaaggacgccgccgtgacgcgcggctcggtgccccgcggcgtcatccccgtcgccacctgcctcaccgtcaagggcgccgaggacgtcatcaaccgccagttcgccttcgagctctccaccccgaccgacaccatgtacttcatcgccgactccgagaaagagaaggaagagtggatcaattccatcggccgatccattgttcagcactcccgctccgtcaccgacgccgaggtcgtcgactacgacagccgccccaactccaagcccccaccgcagccgaagacgagcgaagagagtgaaccgtcagcgtaagatagcggtgatctctggctctcaatatgcatatctattgtatgattttatctactcaagtagtagtaattgtgaatttttagtttttgttttcttctcttggttaattatatgtatattattgactgctacctgagaataagttcaaggttttgccgtgtggctagttcttttacattatggattagttgcaacagcataattcggttggtgtttacttgtttcatcctgtatgaagttactggcttggatcatcggtgctgcgaaaaattttaagcactcagttctttaattttcattatggggattttcgtttgtcaccaatgggagcctgaaatgtggttcagaacatcagatgcaatcctctgtattgtatagtagtactgaagtttgggctgtattcagctgcatgtttagctttgatcttaatcttgtcatttggagtggatgccccagctttgtgctgacctcttcaatatttgtttgtcatgacctgattgtacctgaaatctgaagtcttaatggttactatactttgcggtatgtcaccttctttttaaaactgtttgagtagaattctagtcagaagtcagaactaattagtatatattcagggcttcatgacttcatgcattggatatgctaacaagcaggctgtttcataatgttttaaacctattgaagcctcaaattttctgataacaatactacttgttgaaggtagaaataaattttactcttgttagtcctaaagatagcagtgatattttgtcatctgatatttgttttcttaatctgaatagctttgattagtttacagcctacaacagagcttgttgacaggtttgtcatgctgaaaactgttcattgatatgtctgcctgttttgatgttaaaagtgagagaagtattatgcatggtagttcgttggaagtccaccgacttggtattatgtcttccgtcttctgcttgttttgatgttcaaagtgagaagtattatgcatgatatactccgtatgtagtttgttggaagtctgctaacttgtgatgttgagcaagattcatccatagggtttgatattttttgggacagaaggagtagttcgaagcaaggttgatttaggccctgtttagcttccaaaatttttttcccaaaaacatcacatcgaatctttggatacatgcatagagcattaaatatagataaaaacaaaaactaattgcacagttatgggagaaatcgcgagacaaagcttttgagcctaattaatccatgattagacataagtgctacagtaacccacatgtgttaatgatggtttaattaggctcaaaagatccgtctcgcggtttcctggcgagttatgaaattagtttttttattcgtgttcgaaaacccattccgatattcggtcaaacgttcgatgtgacacccaaaaattttcatttcgtgaactaaacagggccttaaacagattgaacccacaccaaaagtcctaaacagatgtccccaaaactgaactgcaatgatccttcgttcgtattgatagcagtggaatattgggtggttcaagtctggctatccatgtctccatcactccatcaagtcctttgaaatttgaatttctggatcttgtcttcttcaactttgtcccttaccactcactatggtcctcgatgggcatgtaatgatctttttaatgaaaatgacccgatcagcgagtaaataaattctgagtgaaaatgaagcgaagtaccttactccacattttatcgctggttttctcccatgtacatgtagtctattctaggccaagcggactatttgcacttcttgcatggttacgtcctcctgcggtcctgcctaatatacctccctacctgtcattttgaggtcgattattgcctaaatgaaccgtaccaatatttggtactgcttaattttagtatagtttagcgctatcaaattttggtagaatttgatgcatttggtttaatgccttattaagttttactagtgttttaagagtagaagtttccaaaattaccagactttagtaaacataatatttgcaagagtagagctgagtcggggtatttcaattaggcacaatatattttaaaaacttttatataggactcaaagaggattttggagccaaacctagggctcaagccctaccttccctagggtggcctgctcctccgtccaggaaagcatgtcgttttaaggttgattgaacaaattaacaagtaaaaatgactatattaccatcatttaatcattgcatttgtcacttcaaattatgctgcagataattaattaatcacttatagtagaccatctattgcattgcacacacatgggtaatactagtagtggtactgttgtatagggaaataataggttcaaatgaatcgatggaatatactaggctcagcaagctggtcaagatgctcgaacaacaaattttgtgggatatttttttaacaacagcggctttctgggatggagaaagtaaaaattatactctgagtacaaatgacacgttctttgacagaaagactgttttttcaatggaaaaccttccgcaatggaaaacccggaagcttgggcctctgggcctaaaattccattacgtaaaggctgggaaacacccggaaaaggtcgagctgacctgccttgctaatgctaggtccacctcccggttggcgcccgcgggaaccgtgtgaggtggccgcgtgtaacggcggaactctctcgaacaccgagacgctctcctctcctcctgagtcctgaccgacgcgcgagatccaacgggaagccgaagccgaggagacgaaacgagggcccccgccccgtccccgcgcccgctcgtcctcgtcctctcgctgcgccgcacctgtcctctactgtcatctactccctcgtcggctcgtcgccgtcccccctgccaacctgccagtgccaggggatctcagcaccctcacttcctccccaccgcaaaaaacccccacgaaaccctcgtgctcccttccgtgccccaccacccctgcactgacgcgcctcgtcgccacccgatcgatcgatcgcctcgtgaagcgccccgcgcgcggcccctctctcgactgaaatcggaaatccccaccctttctccaatcttcacctctcccgtacgacatggaagccgccgcgcttggcgtgccgttggtgcaggtccgggctgcggtcgccgcctatggccgcggcgccggcaagggcaagggcaagcggcgcgtcgtaggcgctttccacgcgccgcccggccgccgccggacggcgctcgtcgccgcgctcccggaaccccttcagccgctctcgccagcgcaggacggcgccgtggcactcgcgtcgactgaggtacgtcgcctcgaatttgaaaccattgtacgttgcgattttgagataaacactggttacctccgttgctgcaggctgatggtggggaggaggtccatggggatgtggcttccgcagaaatctcgtctccctctggtggtgagcctcctctgcttggacaatggcgtgacagtagaaatggtgaaaactgaaaacctctggtggcgatggatattgtgatttattgtctatcaacctgttatttcagttcttgggaagacggtgcgtgttagatttgtgctgaagagggaatgcacgttcggccagagcttccaccttgtcggcgacgacccggcgctcggcctctgggatccgtcgaaggcagtgcctttggattggtcagaaggacacgactggactgtggagaaagtgagccttgcatcgtgcgcattgtttgatgtactctccttttgaggtaatcatcaccccttttcttctgtacaggacttgccagccaacaagttgattgagtacaagttcgtgctgcaagatttgtcgggcaagttgcattggcagaatggtcgtaatagaagcgtacagacaggtgaaactgcaaacattctagtcgtatatgaagattggggtaatgcaaatagtcagacagtagaagaggagggtaaagtgtccattgggatggaggagggtaaattgtccgttgggatggaggaggctgtagttccagatgatagtgaaagcagagatgatattattgtagcagatgagctacaggtggatgacaatctagcggtcatgcaaaatgaatctagtgttcgagaggatgacaagaaatcaacagttgggacagttacttctgttcaagctgaattaatgaagctacatgaagctaaccaaccagaggtaatggcttaatgagatatccattgcagataccttcatgtgtttaagtctattttctaccgaaaccccagagacattctatatattctcaactgtcggctgaaaataattagttcagtgtcccctatatgctcgctgattgaaatgtgatcctttttttatctcattagttactctgctttctcatctcaattagcttagaggagtcatgatgcaaagtagtgactggttggatttcatatgagagtttttaaaactatttactgtttactggaacaccatattgtttctatttcctatttcctgataatgtatttagtgtgcaaagaaactgaattatcaagtgtcagatcatccattcattagaagatgtgacataggtgtaaacatggataaaatcaggggctctgaaaaaatataggtggtttttagtgtacaatgtgagctttttagtgcctaaatctcatcaaaatgtcccatgactttggctgttgtctagacatatcatcctatttttatagttagctgttacttgctcactctatgctgctatcatacttatatataatgcaatttctgaatcagttaattgtagatgaaccacaaattcaagaggcgcttcctgaaacagcggacacagaaccagagaacggcggtgtggcaacgtgcgctgacgaccgttatgccgaaagtacagatgatgacggtgttccagtaggaggtacagatgatgacggtgttccagtagaaaatcggtggaccggtgcttttgaacatgagttgctttggggttggaaggccctgcagcagctactcatgagcctgggcttcaagatggatacatcatgaacgagtcataaggtactgcaatacataggtggcaatcttgatgtattctgttccttccatcgatttagtactagtagtaaagactagcagctgctgtctgttggtattgtttgaacgttcagttctgtacatattatttcccagaaccaaacatcaataagctgtcaagtttgttctcagctaatgagcagccacacttcaacactaagaagatgtgtaagggatgtccatcagcagtatatatacttgtcgtgagaattacgaccatgacaagaatcgctcaaaaatcctagtatgatatttgtgctgcacagctctcctctagtgcgttgtaatcgacaataaatccgattctggaacagcctgccattgaaagggcgggcttgagttaaggctgagttcatttcatcgactccagacggtaactttctcattttcttagtctagactgctagtcggtgtgttgtgtaaaataatttatataaagtttttcaaaataaaataaatttatttttaaaaattataatagttgatacataattatgcgctaatgatacgcctatatttttccaagcggagctactgattcgaacagggctgaagaccagcttcacaatggcagacaaagcacagcattttcaattttgaataaatacaacagaccttttcaaggcatagtacagggcattggaacaaaggaaggatctccctatattactatgaatttcctatgaaatggttcgatccatttgaattttggagaaaatataacagaggtggtagccctcgcgtggaaaatctgtgtgtttgactcactctaaattcatgtgctcttttattgtggaccatctttataaaatgatgccttttgcatagagttctatagaggacctaagattttgtaacacccctttagcaacgacaacacaaacatattagtagcttattaggcccaacaaatttcctatatattttaagacatctagctgtggtaactcaaaaaagttgtgaacttttcgtatataccactccaaaagtctccactctccgctgtgaaaaaaggcttgtttgaaatttagaatcttggaattagaaaagatgctgccaaaacctatatgttttaaaaaaaattaaaaaaaaactaaggacaccagctctaccaacttgatactagtaatacggaagagaaataaaaacaccatatcttaagggtataataatgatgtcacgcttggaagaagatggcatatactacctctgtacctaaatataagggttataagggtttttggttggatgtgacacatcctagtacaacgaatctggacagaccgtaggacggagggagtaagaatttgatgagtggaagaaagagaaaaagggggaagatatcgtaatagatggcttaatacacactcatatagtcgaataaataattatacaaatatattgtaacaactaaatagacaacatattatatgagttatcaattcataatatttggcattctaactaccaacaagattttacatttatatttattgtgtaacatactttaataatataacatgttttttaatctttactcatttatttaggaaatataagtggctaaactaaaacaatacaatggggttgtttagattgtagccaaataaaccttatcaaattttggcaatattaccaaaaatttggcaggatttcttacgtatttaccaaagattggcaaaaaaaaaaaactaaatgtagacacatttttggcaactttgctaaaaatggtgtagtttgaaatggcattattttgaatagccgcaatgttaaaattgccaagtattaagaaatcggggagtaacatagcatccaccccatatccccaaatatgaccttattatttctttctcatttagtactcttatcagtgctaatactggtcttcttttgctcctcctttctaaaagcgaggctactaaggaaagtcactccataactttttgccccctctatcgatcatctatatgtaaacaaccgtgtagattaattgcttgatttcactttcacatatctcatctttcttctatctctatcttcttgcctcaaaaagaccaattgtggtcgatgtaagattcaatctaagatgattgagcaccaagtgtgcaagcaagcaatgaatgcacatttttatcatctagaccaacaagcataatactcctctccatctagttttgatcgacacatttggttccagcatggtggcaaaggaggacacaagttcctccatattccattaactttgcaatccgcatgccacttcaattacgtacatgtatgtatgtgataggttgttgcaagcatgcatgcgactacgcattaactatctgagacattgttatgctaaaagcattgtccgcagccaaatcatagatcaatcctacgagttttttttcttaggaaactatcaaaactatatggagggagtattatatattcttggattagagtatgttttatatggtttcttgtggaaagttattacaaaataactaacaacgataatgtaactagggaggcggagtcttgtgcaaaaccatagagttcattatctatcgttatggacatgcatcaggagatagaaattaatcattttgtaaaggaagaagacaaacaagaaaaaaaaaggtttatccattataactggatgatcgatatcaaaagaaagtcatgacgtaacttacattcaccatattagaggatctgcatctcagcgagacatgtgttagctgagtagttgagccatgataaaattatataatgaatagcattgtaagccattgatccattgtagataccgacaacacaggaggccggtgcttattggggcaatggaagaccttacaagtgggacgaaggaagggcgcacaatagagactatgaggaggagactctgagaaggggattgcattaggaaataggataggggataaaagtacaaatgacatttagtattagtgtgttattttttctgaaaaaaattaatttgtcatatatatcgagttttgccaaacattcagtcaatccaaaagcatgtcttcccttccataattagttttttttataagagataccttgaatctaaacacctttcaattaaggggcaattacaaatttaccaatgttttgaatcgttattgcaagactgccactaaaaaattgcaaaaatgccactaaaatagttattcgagtagcatccttacaaaattgaaaaaaccgatggcaaatttgcaaatgccccttcaattaaagaatttcatgtactcccttgatttttaatagttgtcattctaacttctttgatcattaatttttaatttttatagatctgtagtttaataacatgtgaattatgttatgaaagtatttctcacgataaatcccaatacataaatgctagtatgatattaaaacattatgaatttttaaaaaactgatggttaaagatacattagcacaaagctaaaatgaaagtaatttgaaaggggctgtaaattgtacattaactttgcggcagccgtgcttgctagtacaaattataagtaacaaacttttgtgacgtatagtagcctattctctagaaataaaaaagaaagaaagaatagacgggagaggaaaaaactatggatggtttttggacttctccgctactctagaccgcaagggacgcgacttgttcaatggccattcttctctgaaacactagactagagaaccccgcatcccacttcttccaggctccagctcttcttcaccctaacccagatccgcggggacccagccgattcgcccagccacgccaccgagcgctcgtctcgtctcgtctctcgacccaatcccgtcccccggcgcgacgccccgccgcgcgatggccgacggcgccagcagcagcggggccgcctcggcctccggccccggtggcgggggcggcggggagtcggtggtgatcgactacggccggcgccgcacggcctgcggctactgccgatccaccggccagacgagcatctcgcacggtacgatcccggaaaagtccctttgggtgaaagggaggaaaaggaaaaaaaaagaagagataaaatagaggactagcggactggggttctgtctgcgtgcggagttgttctgtcttcggttcgagtcgatgcgtatgattgctagatgaccccgaaacaatcgaatttcaggtgtagatattgccgccgatgaaattggctaagtaccatgtatttagtagcacattacgacaccatgtctcataatttgggttgtggagaatcgattcgttgtttatgccagcttatgctcaggaattttgttagagcctatgcgaatacatgtgtggatggtaatatgcatcgttggacgctagtaacgcaggccacctataatcttgtggcctgggtctgcccatgctctcaaggaagtaacatttggccaccaaactacaggatgtgaagtactgctgatagcctatcaacgctgatcttgaccccctttattttactagcgtatgctactgatcttgtctttattagatatggccttagagcgtttcagatgcctccgttttgcgcttcaccttgtttacatcaatggacatccaattctgtctctgaaatgggatgaaaatcatgctgccgacgtgcttattgtctactctcagtcataggattagtatagaacacataatgttatcaacagctagtagagtcgcctgttgcaatttcatggttattcaaagttgtatctgtgacgtgtcccttatggttatgactacaaatatgttatacgatggtgatagttgtaatatgttgatgcaattattctgttgttaatgtccctacctaaattggtgttatagattctttatgtttcttttggttagtgatggtatttttccttttataattttcaaggtctctaaggaacgggccttcaatatcataggttgtttatataagaataaatttcacaaaaccccaggttttgaaacataattaccacaaaccccaggtttcagggtctactttaagaaaccccataatttgaggtattccatttcacagaaccccacttccgtcaataacacgttgttccctgtcatctcacatgaagggcctgctggttagtcaccattcagctagcctgtcatctcacgttgttccccgcattcatcttcctctactgctctagatctgagcccaatcttaaaaaaaaagatctgagcccatacttgcaccaccgagtagcagaacggggaatgtaggatctccatgttggctcatcacccggagaaatttccctcaccgctctcctactcctcaccattgggatccttaaccacgccttcggcttctcttttgatcttctcaatggaaggcagggaaggggaaggagaaggagaaaattgtggttgacatgcaggacccacctgtcatttgccggaagttatagcagaaccggtgttatgtggtacatatgtctcaaaaagccagggttttatgataaaaacgtaatatctgggcttttgtaatacatgtgcctcaaaacctggcattttgtgaaattgttcatatttatatagatagttcatccttgtttttctccatttttttgttattcttttgaagcctattttaaaaccttttactaggatccttacttattctacttatcttgcaggtctatgggctaacagcctgagagctgatgactatcaaggtactacttttatttaattgcatattttccttctgtat

SEQ ID NO: 67516 - DNA, 965 bp, Oryza sativa
ttttaaaatagagaccactaaaattgaagtggtaccaagtaacaccaccaaaatttttcatctctattctataccaccaagtgggaacaaatctaccgaaaataccaccaccatcagttcatggggtagcagttttaagaaggaccagaatgtgtgccgtcgccgatgattctacatcacttccgctagtacttgctggagatccctccattgcctgtccaccacgtcctcagtcccatccccatggacggcatcaactcgttcccggtgcccctgttctaggttttggccttgaatggccagtgtggccacctatctttatcgccaaccaactcctcgacaatcttgtggtgccatgggtggcgtctcaaccgtcattgtctcattgcgcgggctggtggcggtgtggctatgtgctgaccagaggtgagggaggagctctctgcacacagttagcagccgcaacggtggacggtaacacctatgctactccttgcccaagcttgatgcaagcataaaatctgggtgtgctttgtgcagttaaggcagggggcttctcatggagtaatggtgatctggggtgatggaggttcatgctgagagaaatggaaccatggaggagcagagacaatgaagaagaagattaggggtatttatgtcatttgtcatcaaaattgagttgagacagcttggctgacggtagtacagtttatcttttagagtggtattttttagacaatgacggtagtacagtggtacgagtatttttttagaggttttagcctatctggtggtttttcttggaggtgtacagtttttatggtattacttgctaccgcttaaattttggtggtattgatgtatccctcttatcttattttcagtaaaattgagaaatttgcatatgtgccatcgcaaaaaactggtttcgctagaatgctgttgctcaaatgggctacaataaa

SEQ ID NO: 67517 - DNA, 1585 bp, Oryza sativa
ctgagtcatttaccgtctaagcacaaggttttctcatttgtgtgtaccattaaatcactgatgacttaaaactagaaggtcacgagcttggtagttgaagcgtggcacagccaaactaaattaaactaacaaccataagaaaattatgtttgtgagtaaagcaataagctctcacatcgacccatcagagaggggtggttgcaaaagtactttccttgtctttttcttatttaaaaaagtgtcaagtttgatattatattatataggtagtctatgtatatgaaatactccatagtgttacctttgtccattgcagaacatgatatcaaaaacaaacacacaaatgtctacctgcaaagtagtcaaaatatagtcagataaaaaagacacagttacaaaaaaaaaagatggattagtaagcatattatgcattcctaataggtactgccactaactatttgtctatccacacactttctttcaactttcatcacaggcatttcagtgcaaatgaacatcctctatgctaggaaaactgattcatgctatgaactatgaaccacaaaaaaaatatacgtatttgtggaactgtaggaatatctaccacagaagttgaaattttgtcaactacatatctgattattttagtgataagtaataagcactgaaaaaacccggtaactgcaaagggacttgttcattcaattaaagttgttggtgacaaacataaacaattgagtacaaatttctttgattatgtttccttgtgaaattctataattataggaattcatcatgcaaaaatattgcccgaaaataatgttcaagattccaaagtaacaagcacaatactttgtaaataaaagaataatggcatcacctttatgttctgaattgcaattgaggagtgcttgctccctctctctcttgaagacagctcttggaatgacatcagtttgtttcctttcttcctatcgattcccacaaccttgttttgaatgcacaagcacaagaaacacaagcctaaggtgaaggagtgttatattatgaagaaacaaacaaatgtgagttcctcacgaacaaaacttacctcggcgtcaagtataaagctggatacttcgatgctgcacagctctttgatcatgccaaccagatcaggaaatcgagaggttgactctttcatttgccttgaaaatatttgcacagatccatcatttgatctgtgaatctgggctcgctgaccatcatacctggaagcaacattaataaatagagtgcaattatttggcaggaaagatatgcttgctaagtcaaaattcctacaaactggagatatttaagaagttgataaggggtcatgcaagaaaaggtttgaacttcttatgttaatcatagatatagatttcagattttactaagaagagtagacgacttcttatgaaattcaagctcaacaactagcatgagaatagggaagctactcatccattctttcttccttcatgatccacggttgtcataattcctcaaatataatccattagtttgcttaagaaagagtagagtcagaatagggctgcaggaa

SEQ ID NO: 67518 - DNA, 9951 bp, Oryza sativa
aatagaactggttaaatgttcagagagatgcctcatttgtttagtttgtgaggacaacatagtcttgcacacatgggcctatcgagtggttaaattagttgctgcaagattggttggtgatcaaggtaaaaccatacaatttttagcaatctgggagtttgcaaacaaagaagtagctctcattcagacaaagaagcatatgcatgtttctcagtccactgatctcaatatttgcatgttacatctaggctctcatggagtatatgctgatagtagtggtgagaggacactgatcttgatttggggaaacgggaatcaaactttgtggagaagtggctgagaaagggggcgctcttgcctcaaaggctctgacccgccgtcaccaccttgccgccgatgcgtatgcgactgcgccggagccatggccgatcccctccctggctcgctgctgctgctgcccccctgcgcactgcctgctgctgatatgcgcctcccgtccgcggatgcgcgccgctgccccgccgacactagtgcttgtcgccgcccgccgccgtgccgccgtgcgcagtcgccagtcgccgtcggtgatgtggcagacaaggagaggcggagagctgagagcgtgagaagagaaagaacgcgaacagaaacagatgcggcgctcggtgatgcggtgtgatgcgcgagagagaggaggtgggattagggttggcttctattgggctgtgatgggctggttgttgggctgagagatgtgggggctgaaacaggccatgtgtggggctgggctatagaatttgggaaaatctgaaaaatatgtaggtactagtccactaaattttttttcacaagtagggcttgggtccaagctgccctaggcccagttccgctcctgtatccactgattttgcgactcggatactattttatgcagattttactggaaaataaccaaacaattcatgatgtgcatcttattacattcttaggttgtgttcggcagtgcaggatgggaacctatccctcttgcacgcaaaacagagcggtctattatcacgtaattaattaaatattagctatttttttttgaaaaatggatcaatatgatttttaaagcaactttcgtatacaaaaattttgcgaaaaacacactgttaagtagtttgaaaagcgtgcgcgtggaaaacgagagaggtgggttgggaagatgaagtgccgaactcagccttaatctgcatatgaactgtctgggtttatcctttttaaaattttcttaattctttgttgatgggaaatgcagcaccttgatcgagaaggaattagcttttgctgtcgaactacatatgatgaaaacgctattactaatgctgttgagatattcaatactaccaggtaattgccttgttctgttataaagttcattagatgtgacctttttgaacttgcatctgtattaatactgttttatccccagtggtgctgttcacttcatggcatcgaataatgactctggtgtaagagactatgatatggagaggtttcagctctacaagcattttcagtttgaatggccagtgaatgtaagtcttttttgtttatttgtgacaccttgcttttggtaaacctactataattagggtatgcatgtatgattgtgtagacattcataatttcacattgccatagtttcgctttatgtggttctgtacttctttcttcatggtgtcgaataatgactcttcaagataaaaccttttgatttcctttttctcatgaaaacataattgtgcactgccttttaaatgtgttgttaacaaatagatccaacatcagtatacggagatcaaaaccaatggaatgctttggatgttttagtttctgtactctggtctcacaattcattgttattttggtgatgcagcatacagcattgagtcctgacagaaagcttgctgttattgtgggggatgatcctaatggtttactaattgacgccaattcaggaaaggtatgccagcacacacgcaaacctgggcataaaacgtcacatatatatgataaccaagctgtgatagaaaattatgtgacattgaagtatggcatgcatgataactggttactttgtttccctgtgcagactcttcattccttgaaaggtcactttgattactcgtttgcatcagcttggagcccagatggcagaacatttgctactggcaaccaagataagacatgccggatttgggatgcgcggaatctctctaaatccctccatgttttgaggggtaaccttggagccataagatcaatccgcttcacgtcagatgggcagttcatgtcgatggcagaaccagcggactttgtccacgtcttcgatgtcgggagtgattacaccagaaggcaagagctggacttctttggtgagatatctggcatgtctttcagcccggacaccgacatgctttttgtcggtgtgtgggatagaacatacggcagcctcctccagtttggccgtctgtataatcactcgtatcttgactcgctgtgttgaggtgaggaacacaaagcagacgttgggcgcgctgtgcctcagctgtgcaccctgtgctgaatcttgtcatcatacattaggtatcccaaatcagaatttgaagtcgtttacccgataattcaattaataaaacttgtacccttctgtatgtgtatataaagaatgtacagagatgcctatagcctgtaccagggtagtgcgccaaatcatgtgttaggttgcagtgagaaatgtgatgtgaaccttaagatcgatgatgctgtaaccggaactgcatcatctgtctatctatcaaccgaagccaagtttcttggtgttttctgggtggaagctgtgcgcctgtgcctgtgctttgtgcttgccttcgcttcggatgtgatcgtgcaaaggttcattccttttagctggtttggctagagtggcggtatcttgtttatgttttgactatctgcgtgctattcgtattgcagtcttgtagtccatcagggagatctctccggatgagtaggccggaatgaattttattttttttaaagaaaatgtcgatacaatatgacaattagtcgtaaaatcggtatgcgccttatcttcgaatactccattaccattttaaaagatgacaatccaatatgacgccttctgttctccgaatacgtaattttccgttggaaaagaggtaaacccaaaccaaaaacagattatccgattcgaagtttcgaactcgccactacgtatccgaatccgaatacgattagaacgatcgtcatctctactatataacgatgtctccccgtggatctcatgaacccccgatctctctctctcaagccacaccgagtagcacgtacgactgcacgaagcggcagagaggctagggccgacgtgcattacgcaagtgctcgcgaggtggcaacaatgaccagcgaatcgccggccatggcgacggcgccggtgccggagccggagccgcagccggagctgtccacggcggcggccagacggcaggatgaggagcggaagacagcgctcaggatcatccgcaacgagctgaggctgctctggcgtgacccgccgccgtacttgcggcccgggccggagcccgtgacggaccccttccactgggaggtggtcatcgacggccccgccggcaccccctacgccggcggcacgttccccgtcgacatccagctccccgccgccggctaccccttcgtccaccccaaggtcaccttcaagactctggtaagcgcacgctcgtctgcatctctgcttgttcctccgatccgttttgcgtgatgcaaatgtcttaaaacctcatctgttatatggtttaaattgcataaaattataaaggttttgacgtaaggcacgtaaccccgtatattattattctgaagtttcacgaaaccacggtattgatcattttaactttgatctaccacactttttaattctacaattacatctcaaatttataaggattttatccattgtataattgttacacctggctttttaaaattttaatatagaagtatgtcaaaatggttaactatgtgattttataaaactttaaaaacatagtattttgggtttatgtgtcatgtgtcaaaatgtttatggttttgtgtaacttggacgatgataattgggttttagttttacgaaacttgctctttcaaaaaaaattgcatggatcgaatttgagtgcttgtctctgcaaccgcaggtataccatcccaacatcgacgaggaagggaacatggtgctggacgccgagagctggagctgcgccaccaagctccgcggcctcctcatcggcttcgtctccgtgctctacgacccgctgctcgactacccgatcaactacgacatcgccgagcagtacgcgtacgactacgagcggtacgaggcggaggccagggcgtggacgcgggagttttcctcggcgcccgtcgtctcgcactacccgcccaacgccgtcgtcggcaggacgccgccggccgttcctcacttcccggcgacggcagccaggagaagagcggaagcggaagctaggaaaagagctgctgccgctgctgcatcttcaggttcaggtgagagcctgtggaggagggtaattgggtatattcagagctggtctccttaccggctacttcatacagactagctgaacaaactcgaggaaaattctgtgtagaatggtttatatgtttactgtattgagacttgagaggtatatatatatacctctaatgtggctgtaaagaatttgtacgtgattagtacaggaaggctgtgctgacgagagtttgtctgagcgactggtattgttcgatgagttggcatctttaagactttaggtctatattgagacttctagaattcacaagtcagaacattatagtgataaggaaatgttgattgtttggctccaaattagtccgtggggaaataagcaaacccttctctcgagaaaagaaaactggtgtaacccgtctccacattttttttccttctctctttggcacacggaaggccatgctcctcatgttttacaaattacgtccaagactttggctatgttttaaagtgattctcggattggctactccctcatttcttgttagttgcgagcatgtttcctgaatgttaaatggtgtaatttttttacacttgaggtatagaaccatgcacaaatagtttgtcttggggagtacgcattttccattgaagaggcctatgtgttggtctgttggagccgacgatgttttcaatcacaactaaaccgagaatatagaggatatggtaagcccaaaaagaggtcagttcttgaatggaggaggtaccatatgctagccatccattccacttaatctaatggcctgggaaggcttggtacttggcgctggcggtactgcatctctcgaaaaagcaggtttcgaatgctgttgatggtgggatgacaaatttgtactttcgcattcaggtaccaagtcggagcagaacaccgtcaccatttcttcgctgcagtcatctactcatcgcatcctcaaatcgaacaaaaattgtagaggcgaacatggtgacgagcctgacgcaactgatgtggcggtctcccgggcagcattgaccttgggggatgtgggccgatggggaacgctggcgatttcggggtacccccgttgacgctctcgtttcctccctcctcctggttcgatcatgacgacagtttttttcattaatatctaattagacttataaatgactaattagggatagggattcgaggtggggctaacacccaacgagccccaacagtggatccgccaatgatagtacgtggagaagggtagtcaagtatactcaaagctggtctcctaccgtttgctgcgtagagactagcataacaacacatggaaaaattgtctttatattttcttttggtatatatagtgccaattatggcataaatacacctccaatgtactggtttagtgttttttcttatattttaatatagggccatgtttggtgcggctctatatatatcccaaacctattgatagatttgaattttgtatgttaaattatagtggattaaaaaaagtttgggatgatatgtaagcacctctaagttagaagaagaggacggcgggatctggcagctcgaggcatatctttctgccctcttgcaccccgccgtatgtacgttcactgcaatcatcggtctttggtagaactctaccgcaatcatcggtctttggtagaactcaagcccatcggatctgggacgtcagcatgaaggaaggcaaagggtggcgaggaggaccaccagcaatggtgagaagaggaagacggtagcaacgacgacacccctcaacctcgagagcacactgcacacacaccttgcctcgacacctctaactgggtgtcgctgcacccgctcggcccgcacccgcacatgggccgggcctggtggagtagctccgacctggctcggaggtgcaatttgcacgcgccgatcctggctcgctcgtccactgtcacgaaccaacacaatcacaccaaatctctcacacaaatgccaccgatatattgcaatccactaagaatacaagtgtttagggatacaaaattgaggagaaagagaggtatagtttgggaagagagatcagacaagaggaagcaggagattgggactagagaataggaattgagaggggaagcagcagcaaggaggaagaagctgtcgcctgaggcgttctggtaattgattcatcgatgaccctagctgctggctgctttgcctcttttctagtctccttctccctagctgaatgggcccaaagccagcccacttgtctagcctcctggaaggacatcacaacagcccatgtacatgacattcttcccccgttaagaatcggcttgtccccaagccgatgcaactgactcgccagattaatgcccccaagatcctagggtacctgcagggaaatgtcttgttgggcagaatcccagaacaattgtttgatgaccttcgaaccatctgatgtagaccctgcccactgttgaatccacttatccagcatacataaaacctgagcattacaaccacactctctaccatgcttttgctgcctcaaccaccaagccttcacgccttcttcaccactactatcagcatatactccatgagagcctagatgtaacatgcaaatattgagatcagtggactgagaaacatgcatatgcttctttgtctgaatgagagctacttctttgtttgcaaactcccagattgctaaaaattgtatggttttaccttgatcaccaaccaatcttgcagcaactaatttaaccactcgataggcccatgtgtgcaagactatgttgtcctcacaaactaaacaaatgaggcatctctctgaacatttaaccagttctattccacgagaattcttactgaaagtgctagcttccaaactgagatggactgcaccaagttttagctgctccctttgtaacaatagctcatgtgtctgcccatgttgattccattgaagaataagctcagatgtacatagcaactgttgtagcactgcccatattaaatcccaagaattggcaactgacagccataacaccttgtttgtatattctcttctaataactttcacatttgtccataacattagtttcccttcagatatacacttccaagaaaaattgagcccttgccctcctgctgcacacaaactgaatacctcactcctccattgcgaaggaggaggccaaggttacaagttgaccaactttcttgttgaaaccctaaatgcctcaccattgtttgatccgaattgagtccaagaagtatcatctagtacatcattgttgttactctgaacctgaaatgaaattggaatagtgtagcactgagcatggcgatgggtacgtctctcatgtgacttgcaagtgcaattaccatcaacattagctccactgaacaaacaatcacaccatgcatcgggtgatggatgggaaatcagcatgagcagcaagaacaattcatgatccccatatgcccaaccataggttgaatgatgtgtgtgttgataggccttcctaaaggcaccagagagacatatctcataccaaatacactatccaacaatcagattttgcagcaagccctcagtggaattaattgttctactcatgaattgggcaacgctgtagttcaaggagacttgatgagactcaccatataaattcagtgtttcaatttcagtttgaacacttgtttgaataagtggcggccagggttgtaagagctttaccaccatgcctccgctgccttgacaaagctgtggatcaggccatggtaaaggccgagaacctgaggtcatctcagctttgttccatggaattgctgctctccaaggtggtactggtggagggctagctgtgtattctgagctccggtcaaagcaaccatagagtacttgcaatttcaatgaaacgaaagagaggcagacaactccaaagtagtcacggctcaagcaccaactccagttcctgggaggaattgcattgatgattaacaatggatctctgaagcataaatacatagtggtgaacttggtatccacttccatgagctccatccactcctccttggccatgtctttgccaccatcatcatcagccaactggttctcacacttcattgaacactcgatggttgttcccatgccaagcttggctgtgtcaacatggttagttgagccggcctctgtactgacctccaatgcgatggaagttggatcagtgttggcactcaacgctgccacatctctagtggaatccttgctcaaggataaatccaccttggtgtggcgaaatgcctccagcatccgatcgatcttggtgcacaggtcttgtctaagttctccaccgccttgtccatgtcagtctcagccttcttggtctcgttgaaaggaaccgatgtcaccatggctgctgatgtaattgagggtacagatgaagctgttgtagcagggaacacgcgttctagtgcagcagcaatactcttggccgctggcctggcggtggcgctacttggtaccattgtcaaacaggtggtgtgcgtggcggtggcgccatctccagggaacatctagacgtgctgcacatccagtaagcagcccccatcgtagatgtcgcgaccgtgggtggcggaccgagccctctccgcgtcatggctggacataaatgacacaagagccttgacttgccatgtgctcactgcaagaacctgcaccgccactgctccataggtatcgtacacttgatgcaacacctcatatgtcactggatatatgatctggctcacggtgacgtgaaggacagcagctgagtcgcctcttggacaggacgatatttcatcgaacaggtggtgggcatctcctccaaagacaccaccaccaagttgctggcagttcctctgaccaccagcgctctcccacttcatctccacaccagaaaccccacgaatcgactactctgataccatattgtcacgaaccaacacaatcacaccaaatctctcacacaaatgccaccgatatattgcaatccactcaagaatataagtgtttagggatacaaaattgaggagaaagagaggtatagtctgggaagagagattagacaagaggaagcaggagattgggactagagaataggaattgagaggggaagcagcagcaaggaggaagaagctatcgcctgaggcgttctggtaattgattcatggggaaaatccaaatacccccctacaagtcactgctctttctactctccccccacaactcaatattgttcaaaacactaca

SEQ ID NO: 67519 - DNA, 20736 bp, Oryza sativa
accgatggttggtgggacttcttgaaagtaaaatatgaattccaacgatagttttgttcaattattaaaatgctaatgacaataaagattaagcgacggatgggtcatagaggagtatattggcagcatttgacgggatttctaaagattctatttggtgtattactaacagtttttatatgtcgaatcaaccgccaccactctactcttttataggcttgttatttaatttatctcaccgtgtgttttagatggtctcttttttaataatctttatttttatcaccagttttagttatttataaattgtattctattttaaatcttttttctttttctttttctaatttcagaattttttttaaaaaatatttaataccgtatagtgttcttttaatatttttatttttcatttttgaattttagttgtttcaaaattgtattcctacttgaactctcttttaatttttctaattttggatattattttattttttattctgaattttaattaatctcagatggggttcttatatggattcttctttaaatattgcttttttttaattctgaattttagttgattttaaattgtattcctacttgaactcttcttttattttttctatttttggattttatttttatttttatttcgaatattaactaatctcgtattgggttattatatggactcttttatcaatattccttatttttaatttctaatttcagttatttttaaattatattcctacttggactctcgttttatttcctaatttcgtattttattttatttttatttcgaatttcgattaatctcgtattgggtttttatatggacacttctttcaatattgctttattttaattccgaatttcagctatttttgaattgaatttctacttggactcttcttttctttttctctgattaatgtgggaatttatagccctacagcgaacgtagtgccttagcatcattatattttctctcatataataacatatatgttttctcaatgtattattcaaatatattaaaatgacaatataattttaaatttctaaattgtatttctatatggactctgtttttatttttctccgattaatatgagaatttcgcgcaattacgcggctagcacccaaacaaaatcatatatttttttagtatgattttacttaaaatttattaaatagctatctagctatctcattgtcttaagattttgaaagaccaaaccttatcatcctcgtgtttctaattatatagttttcaaaagtcacaccagttgctaccccttatgtcatctccttttttatttgcttgctcaatctatcactatttctattcattcttcttggaacctttaaatttggattttatagtttttagagtttattgtcatgttgggtttcatttttataatttctagatgtcccgtcaaacgttgccattatactcctctacggcccgtccattgtctcttctctttgttgtcattgagattttaaaaatcgaacataattatcgtttgggttcattttttactttctagaagtcccgccaaaccatcagcggctttgccattgtactcctctacagctcgcccgctgtctcccttctttattgttattgagattttaaaatcgaacatgattatcatttgcttttttttactttttagaagtttcaaatctttaaaaattggacttgcagtttaattttttataatttttagaagtcccatcaaacgatgccactatgcccctctacagcccgtctgccgccaaatctttattgtcattgtgattctaaaaatcgaacataactatcgttggaattcatttcttattttctagaagtcccgtcaaccgtcggcggctctgcaattatactcttatacaccccgcccgctgcttctactttttattgtcattgagattttaaaaattgaatatgattatcaatggggtttttttttactttctagaagtcccggcaaccgctttccacgtttgcttcacggcctgcttgacgtccctccttttaatcgtcattaggattctattttggtgatttattaacaatttttatatctcgtatcaaccactaccactctactcctttatagctatgttacttaatttatctcgtcatgtgttttagatggtattttctttcaataatctttatttttatcacaaattttagttatttataaattgtattccaaattgaaatcttaattttctttttctaatttcagatttttttttaaaaaaaatagttaatatcgtattgtgttattataatgtttttattttttattttcaatttcagttgtttcaaaattgtatttctgtttgaactctcttttaatttttctagttttagatattattttatttttattctaaattttaattaatctcgtattgggttcttatatggattcttctttcaatattgcttatttttacttccgaatttcagctaattttatattgtattcctacttgaactcttatttttttattttcttttgccaattttggatttatttatttttattctgaattttaattaatctcgtattgggttcttatatggactattcttttaatattccttatttttaatccgaatttcagttatttttaaattgtatttctacttggactctcatttccttttttaattttggatttttattttattgttatttcgaattttgattaatctcgtattgggttcttatatggaaacttctttcaatattgcttatttttaattccgaatttcagctatttttaaattgtacttctacttggactcttctttttcttttttttttcttttttttccgattaatgtgggaatttctaaccctcacagcgaacgtggtgtctcctttcaaagctgttttaataatataatagatagatagatatggacgctcagctgttcagtttgcctggacaatgccttatgcttttctattttctgtttaaaacaggtttgaacaaaattaaaaagaaaaaagttgatctctcccccacgcaaccacatcatatggtccataatgtttatatcattggctaatttttagtctaacagcagctttcaaaccgcattcttttttatttgactatgttgtactactttatccaagcctcagctgatgaagaggttcagagagatatttaattatttacactctttaattattccatatcttataaacaacgagtggtaaatagttaaacatgatatcttaaaagtagtaaatagttaaatgtttaggaattaaaagagagaaaccggtttacgggccgtcataccattaccagcagaaaacgctcgttaagattcacgggaaatgcgtggctttacctgacgcgtgcgtggcttccgtgcatgccttattagctccaaagaccaaaacttcagtacaagaaacgccaatctaggctagctgttagttgcctgtttaagggagatgagcaatgagttggcttgaaagaatcaacgagatcgatccgtcaagccactcgagcttctcaagcaacctaaactaacacctccgtctcactcctccaggcacgctagccacgatgcagttaggcatgggctagctatagctaatagctaagctcgatcgatctcttcttctcctcctcctcctatccactgtccaaaagacggtgatcgatctgtctccgactgccgccgccgatgtcgtcgtcgtcgtgcgcggcgggcgccgaggccaccgggctggtggccatggactgcctggtggtgtgctgctgctgcccgtgcctggtgctgcagatcaccgtgttcctcttcgtcaggctgcccaagaaggggttgtcaagtccaagaggatcatcctccggagatggcacgggagaagatcatcatcatcggcggcggcggcggcggccaagagaggctgcagcacggtcgacccggctgcaggcgtgaagaaacagctggaggagctatttgacgacgacgatctattccaaggcgcattcggcggcgggatcaacggaggcggcggcgacgacgaggaggggtggtggaaagagaggtgcttcgccgtcgacgacgacgacggcggcgtgtgggaggcgctgatcgagcaagaggggctcttctggttcgggagcttctggggccggacgacggagcaggtggatcgtccggatcagtttggagacgacgaacatgcccacccagccttgaggtttcctctcgttctcgagagagtttgtgactaaattagctagagtacttaatttatcaatgcaagcttaattagggacagtcgcaacataattcaggcgttgagctcggtttctggctgatgattgctcattgagttcttaatcaattacatcctgttccggccatttccatttgcatcgctcttcagtggacaactaacaaatcacaaatgtacatgtcacaatattaacttcagagtcgagaagggacaatgaataaaaaacacacggcattaagtctgtaacacagacgctgacggagccattttctctgctggcctgcatgcatgctcaccctgcacctgcagcgtccacttggtctgtatattttcagaggactttgaatctccagacggaagtgtatttacaacttcgcgcacacttaacaaatcacaaatgtacatatcacgatattaccaatatcatatatgacatgtatgattaaacatatcacttcacagacataatacatagaatgtaaagttcaatctacacaatactccaaaatacacaaatttggctatgaacaataatgttgattgaatctatttatgttcttttttggctgtgtggattgaatctgtatgtttacggtgttcacattctaaaaaaaagagtaaaaaatcaattgtagtgaatgacatgtatagaattaaagcattggtacaggtaccaaggataaaaatatgattttgctagtagagaaaaaaaagaacataacggtccctaaatttaaatcggtataccgcgtaggtactagttaagtcgtttgtctggtattggcgtacatgttcttatttgcgtcatttcccctagatatacgtcacgttctctaagattctcattcacatggtttcctatatatttttgttttattccaaataacacgttactagtgtaaaagttctcgtttgtatggttttctttatatttgtgttttgttcccaagaacgcgtcaaaactcctctttttaattattcgtgtcacttagatcttgccatagcttctaccatgtctccttgcgggtgcacctgtccaaaatgtagaagaaaaacatagaaggatatctcattccagtcccttatacaacaaaatttatgaactatatgtaaataactaatcaactacataaaataaatcttatttgataagattcgcttagccattaaccgttcgatctcgtcccatgttgaatcctcaaccatgtagtgcttttccctttgtttcattccagtgaaccactttcaaccctataacaagaacaaaccgaaaagatagaagaaataagacaacctatttttccccataagatctattcaatgcccaaattaaacgcatgatttacattttttccaccaaatgctaccgagcaatgcaaccaggtattcgattcactcaaaatgcccatattttatatagttaattactcaactaccatgatttttattctatatcttaccacttttttgatccatggtccatactgttttacctctcaatacctctaagtagctcgcaggtatcataaaagctcttgttgtataaattttttattttgtataaccttttgataaaagctctcgttgtatcaatggtatcacggtttttattttgtacaaaccttttgattgatactcctccgagaagcaaacgagtacgcatgcacttggagttatagaagcccattccccaaatccagtcaccgatccgttaggttccgtgttagctagctcccagagcgtgccggcgacatatgtatcgctgccgaccgccgtgcacacagaatccatccagtcggtgcgcggtgcgccgtgtctcggtcgacaagcgacaccggacaacgacctcagctccacgcacacgcacgtgatgattggattttggatcgtatacgtaccccacgcattacgccaatataggctcgcgtaacaacatcaaacacgcccgcgtccgtcacgctttggtcccctccgcaaccagccgccgcctctgcaaggcttcgtccgcgggggacgctggtgagctggtctgcgcagctcacgcgccgcgcgcgcgcgagcgaaaacaacgccgccgtgtgtcgcgactcgcgacgagccgacgacggcgactacaacgcccaggcgaccagcggcgcggtgacgggccactcctaaacgcgagcgtcgtgagtgggtcgacgtcgacccgactccctggcacgaatctcgaggcggtcgcgcgcgtgggccccgcgaatctcgttcctactcctctcctctcctctcctctccgtctcgcttggccctccgtggtgacacgagccgtggccacctgaaaaacacactccgcccgggccgcacctcctagttgatggatttcagcgtccgagctcgcatccagagcccgcaccggtcggccgcccacttcgtcgccggcgaggggggacgccgccgcccggcaacgtccagggtatccttccgctccatggcgtcggccgcttccgtggaggagcctgccgctgctgccggcggcggcggctgagacgaagaggggaccgagcggcgcctccttcatccgggaacacctcaggagtctcgccccgtaccagcccatcctgcccttcgaggtaggagcagcactctttcccactggtggttgagtttgtggagaacgctgcaccgtttcccgtgccgcgcgaggtgtttgtggaaattcccccgaggcccccgaggctgtttggttctgtattgtgaaagacagcagtaaagcttagattactgagcttatataggagtagtattaccaagcttactgttggttttgtgatgcgccacttttatagtggttttgctgttatctgaaatttagaactctccttgctaggtgttgtccgctcggcttgggcgtaaaccagaggatataatcaagttggatgcaaatgaaaatccatatggtccacctccggaggtgagtttcttgtaatacccaaacaagagtagcatctacctctaatacttgaaacaatacattcttaagaaacagtagtttgaccatgtcaacatgaaccatgtgttataagaaattaagaatgaatcctaataattcaaattcaaaatagtactagcatattataaatcaattcaaagtggcatattagaaacactagctatctttgaacttccaacagaaaatttaacagatctttgtatgagcatacgaagggctggattctcattgtacataatttataccttctctccatctaatgcatatctcttttatacaggtagctaaagcattaggaaatttgaagtttccctatgtgtaccctgatcctgaaagccgtcagttgcgtgctgctcttgctgaagattctggtcttgaatctgagtacatacttgctggatgtggtgcagatgaattaattgatttaataatgaggttagcatgtagcttgttttatacctgctttttgcacgagatttttgtatccgagttgagtaatagcctagttttttttttaataaaaaagtaatagcctagtttgaatggtgaaaatgcagatgtgtactcgaaccaggtgacaaaattgttgattgccctccaacttttacgatgtatgagtttgatgcgtcagtcaatggtgcacttgtgatcaagggtaggtagttctttcttgagctgtacttctatttactgagccttctgtaatgtcttaattcggtgttcacttcttatactgtttgacatgccagttaccaccctctaatgtaatcctgatttgaactcttatgtagtaccgagacttcctgatttttctctagacgttgcacagattgtcaaagtggttgaacaggaaaagccaaaatccatatttctgacatctccgaacaacccagatggcaggtacacctttctcatgcgagaatggggctgttttggttgtatgttgtccagattctgtatcttagtatttcgctgaattacctcaattctatttttcagcataatcaatgatgaggatcttttaaagatccttgatcttccaatacttgtagtgctggatgaagcatatattgagttttcgagtcttcaaacaaggatgtcatgggttaagaagcatgataatttgattgttcttcggacatttagcaaacgagcaggtctgtagtttctgtttgcctttttcttctctggtctgcaccgggctatatcctctgaaaaatccaaaaacctcacccgttttctcatagtactgcatggaaatcacttatctgtactagaatttctatttttcgttagataattttttttagtgctgctgcattattatgtgatgtccagacattgctaagggagcatttaataaaataatcaattcttcttatgttgccaactcattttactgaatcatgctaatttttagtagttactagcatggctttgtctagctgattcattgaaggcatttttgccacacaattatgaaccaaaaatgacacctcattacaaattattgataatgcaggtttagctggacttcgtgtgggttacggagcatttcctctaagcataatcgagtatttatggagggctaagcagccctataatgtttctgtagcagcagaagtttcagcctgtgctgccttgcagaacccgacttatttagaggtatgtgctctggaaacatatcataaataaatttttgtttagtaatttggcatctgctaactttgtgcttctgttgaacatttcattactgaaggaagtgaaaaatctgctactacaagagagggacaggctgtacgatcttctcaaagaaataccattcctaaagccatttcccagccactctaactttattctctgcgaggtcacatcaggcaaagatgcaaagaaaataaaggtttgcactgcttgttagtactccctccatttctttttgtttgaagttggttagtttgaaattgaactaaccaacatcatacgtttacagaggtagtatatgttactcccttcgtcccagaatagaaacatttttagcatagtgtcaagtcaaccattcttaattttgactattaatagcaaaaaaataaaaaaaagatcaataatgtaaaattgatgttgctagatttatcattgatcaaactatcataatatgtaactctttttatatttaaaacattttattttgatagatattattggttaaagtagcatctcgaagactgtgtcgagatccaaaaatgcttatattttgggatggagtacaagtttctgctgtattttgttgtggtacaatgtaataactgcttctgttgttatattcttaggtggtaaaatgtcaacctggaagtcaaaatatagttattgtgtctaagaccattactattcatactttgaaaggaaatgctgatgatttagtttcaacaatataatgcctgcagcatcattcacataattttgttcaaaaacaattttcaggaagaccttgcgaagatgggagtaatgatccgccactatgacaagaaggaactaaagggatatattcgtatttcagtgggcaagccagagcataccgatgcactaatgaaaggcctgaaagcacttcaactgtgatcatcccatctgtttgacggaagcactgaagcacttgcccgtggtagtgcactagatgcagtctctcaatggaggttgcatcaatctaacacaaataaggtgcatcctctagggtcgattatgtctcaataatacactcttctgttttgaccagtggcgttttgtccagcatttttgtgttggtcgacttgggtttcttctcaaggtgattgttcgaagcaagaatttgtactgccgtgccctgattggaataaatatgagcgtaaaagtatggcaagtctactggctagattgtttatgcaccttctttttaaaaaataaaaataaaaatcttcagacattgcaaatcccatgtgacatcacaaatatggagagtcatgttcaattataatttttcagtgaggaattgaagcacatactccctccttccgaaaatgtttgacgctgttgactttactaaaaatgtttgaccgttcgtcttattcaaaaaaaaaaataagtaattattaattctttttctatcatttgatttattgttaaatatacttttatgtatatatatatttttacacatttcacacaaatttacatttcacaaaagtttttgaataagacgaacaatcaagcatgtttaaaaaagtcaacagtgtcaaacatttaggggaggagggagtattaagctattgccattatggttcgcaacccggtaggcctgaaaagggagcatcaccgcatctgattatccttttcgtgtcctagcgaatagcgaggctaaacgccatcaaaaggcacaagttctttccatgtgagcagaagaaaaaagttcgatgcggcacaacatttgcccatacaacaccacaagcaaagcaaagaacctcccggagggcttcatctaaagcttcttccatcgccttcgtgcaggcgcaccaggagttccgcagttaacaattaatatcgaatcccttatataacaattaatatgtttaatttgaaaaaaataagggcaatatcataaagttagaaaaataggagtaaaatctctgctaaagttgaaaacatggataaaacataaccaccacaaatatttcatagctatattgcatttttgaaacacaaaaactaaatgcaattacaatacaaatattcttaaatatgagggtccacatgactaaaaccattgtcgaggacatatctctttaatacgggtgagggtcctgtaccataatatcacaactggtatatgggtcccaccctcctattgtccacacgtcagtgtctataatggtagtgccattatagtagaggatgtgaatccccttactacataacggtttcaatgggtcaaaacaaccataatgacgaaactgttcacacattgtgattccttgtgcattagctccgcacactaggttactttgatgagagctatgttcgcacaatgtgatttcaaatgtccttttgtgttggtgcctgttttatcttatgcctaatcctatttcgcccttttgtatgagattgagaggtttgctgctttcatctagttgttttcacctattggtgtcatattgtgtttcctttgtaaaaatgggtaacccccatatcatgactcttccgtatgtggctttcaaaaaaaaaagccgggccgtgaggccttctctctaaaaatacaatgtgatttcaagctacattctaagccaaagcttttatacctttaatatgatacgtatatatacctttaataatctcggatacaaaataaatgtacaaggccacacatcatgtattgtaaatacgataagtagaataccacagctatcaaaatttataggttgcaggttagtacaaatgacgcattccccgacattccatacttgctcgtcatgcagcttcgtcgaaaagcctccatggaaatctcctccaaatcttcgcaaaagctttgccactgtgcctccatggaactgcaaacctgcgatagtagtacaacaaatgcataatttatccacttcaagccctgggaaaatcccatattacaaaagggtccctcccttcttttcgatgcccataccgcggcttcccctcctcctcaagatcgccgccgcgaccgccgccggcgcgttggcgctcattgtcgcggcggggctccggcgggatgacgccgtcgcctccctccggcgggagatacgcgacgccgtcgccgccctcgtggcgagcaacgaggacggcgtcgtcgagggggagggcgaaggcgaggacgccgccgaggccccggcgccgtccgtgctgatcacggggttccgcgcccacgggaagagctcgctggtgaacacggcgtgccgcgcgctcgcggccgaggaaggcccgctgctgctgcgcgcggaggcgtcgccgccgggcggcgggtccgacggcacgcggaagcggcggagggtgaaggcggcggtggccggggatagcggtgacgcggggacggacgaagccgtggtggagcttctggacgcgcctccgctccccgaggcgacgagggccacgagagctgacatcgatgcggcgatcagcggggggaacccggagtgcgtggtgctggcgctgcgctgcgacgcgcccgcgaaggagcggaacgccgccgtgaagcgcctgccggagatctccgccgccgtgagggcgaaaggttagtctgctcagcttcaagaaggttctagaactcggcaacttagcaacagtagcattgaagcattattctcaatatctcatttactatgttagtagtattccttttgcgcgtttgcgaaaaaaaaaaactatgttagtagtataatttttcgtagatatctcggatgcttagacaatgctatattgctatgtccttagaagaaagaagatgatgcgatttcgcatcgtccaatgtaggatagttgtgaattgtgattgcttaaagaaatagatgcaattttctaccatgtaggtaaaaggcaagggatggtaatttctgcaggtttggtttgtggacacttgatggttaactagattgtcagttttgaatagttttctgatagagatttgctatcatttggactggtcccctggtgtcatgttgtcatctttatgttcaggtgtgaccgtcagcagttaccaaatattgactgtttgatggagctttttgtgttattaatacacgagcacagatgctgtgctgatatatgctaatatgcatatttttcgaaaccatgaagtagtgcagtatattttgtctataatgtcctgaaagataaccctttctgatccaaacttgtgtagttgtgttagaatcagggtattgcaaatgttcatggagattcctttgtttctctctttcttccacatctatgaagaccttgctattaccatattttactcagcatatgttagcaaagatgaatatatttgttgacgagcacttgttaacaggtctgaatttgattgttgtattgactttcaagaaggccatgagatcagcaagacaagctgaagagctcatacgagaggtttcattcagggcgagaacagattgtgtctacttcatcgagaactacacctggaacaataatggtcccaaccttcgccatcctcctgtcatcaagaacgactttgagacacatttcacggttctgacaatcattcgacagtgccttgagttcatcaaattaaataggagtcaatccaagcgggaggaaaatggtgagaagggtaattcaggagatgttaaaggtatactggaaaaagtcttaacagcaaatgctaaatcttcaggagaacttagcgttaaacctgcactggaaaaagtcttaacggcaaatgctaaatcttcaggagaactgagcgttaaacctgcagatgtcaaacctgttctgactgttcaatgattattactgaaatgtcagagcaattcgtgcgcacactcaatcatcacacatttgcacaggtatgacttactgcagtactttgtatgcgttgtatgaggtagtttgctacactgcacaaagtgtatgttcattcattcatccgttctgtatgatgttatataggtctttttatttgggtgtgtggcacataactgatttgttggtattgccatcatctagagacataattaaagaaagtgcctagaaaaaagcaaagtggaaagcctcttgctatatatcatcgctgtttaacatcactccatacaactctaactcaccaatattatatgatagcattacataggataactttatacattatagtcaattccactataatcaagtcccaagatatacttataaatatatagagatttggacgaaacatgaataaaccatcaatgttggctcttccttattctcttcaaccgatcagttcagccttcagaaatccaggcaccaacagtagtaatctgaacccgagagtgccaggagttcttctgggctcatcctctctagctccctctgcctccaggctgggtagttgttctgcgtctcacctgaaccggaggcgtagtctctcgggtgggcttgcgatctcatcctaatgtacagcctcatcgctgccacgcaatcttcatagggatcctgaatgccagtgtggatatcatacctgcaatagggattcaaggatagtatcttcaacattaataatgcaaagtctaagagtctatagagattgtacagctgacttagcaagtttgcatacccaagatatgcctgtgtaaggtactttagggagttgctcagcttgctagttttcatcagtggtgggtactttgcagtatccctgaaaaaaatgcagagataaattgtgtcagcaagggagaaactggcaaggtctaatttgcagcaaattaatttgccttgtgctgctgacctgatcatgaatgccgggtactccagtcccaggcgctcaagttcatgctccaggccatggccaacgaggatccttgccctcccagagctccttggccgtatcttccatagtggctcaccgttgcacaggatgtcctggatcctcctctgcacaagcttcagtggcattgcgtccctcaagtactccggccttatcccagtcatttcatacctgaacagaaacatcataaatcatcccctcattcatcatctcataaaactatccatcgatctatgcctttaatttctactgctagtttctatagcagtatgtttattgctcggttttccattatgtcttttctgcttttctggtccgatagatctacacatgcgaacaatgacagctaaaaattgtactactagctaacactcagaaacatcatcagtaataaaataatggatcatctcctatatattttacctgtagtttgtgacggtcgtggtgggtttcacataggtctggaagatgacgttctcgtcctctccgatcaggcacaccctcgcgcagatgtcgagcgagccatcgcttcctcctccgaccatcttacacgccatggccaccgcacggcctccgtagctacccctgggcatctgcatgcaaacgcaagaaaaccacgggcaaattcagcaacaagccttgcaaactagcatgcgcagtgtaactgaggtgagaggggattacataccggggcggcgcgggtgaactggcaggtggaggcgcggtggtatctgacggcggcggcgctgtcgaagaggttgaggcagatgctgcagccgcgggccgcgaacacgcgcgcgcactccaccttgggcaacggccctgcatgcgcacggcgtacgcgagaaaccgtcagataccacgcgaaaactccacaaaaactagctcgttgcatcaaccgagcaaattaaaaacggctacttgtgtactcaccgatgaggtgctcgcggagggactcgagggagcggcagtgcttggcgcagacgccgcagcggggctcgtgggcggagtggaacgacaccttcatgtgctccaccaggtgctccatccggttgtactgcctgtagcacgccgcgcatttgttcctgcgagatcatcattttcattcatcgattgagttcgatcgcgtctttagaatatcgcgagcgaggcactatgcacgcatttatgaaattctgattctttgcaccggcaataggggataagaaagttgaaaaggtactcattcattcgtgcgcagaatatgtagtatcatatatacatgcatattcaaggtattgaatggaactagctaggacaagaaaaaaaagggtcctatatatctagctcgatgtttagagcacgagaagaacgtactaccatgcatgattaaagcttgattaattagctagttcatcacacaccagtcttgcatgctcagctcatcttgcaatactactgtagtaatggcattcagtttgtgaccatcttacctcagggtctccgaggactccctcctgctgtccatcatatatagcactactacaactcctgctgatcgagaattaaggtttctgtctctagttgctcttactgatcggtcgaccaaggtttctgatcgatcagttgtctccctgaaacctcgaggggcgctagttagctaggttggtgaggacggtaggcaacatggagaggctatttatagaggcaacaaacgttgaaaggatggaagaaccttcacgaggaagaaggaatgacccctgggaatcaccgtcttgtcgtcactgctgcatgcattctgaggaataagcctgcagtttatcgtaatctagctagtttagtatgggatatatgcttcctagtatctaaggttcctttcttgatctgtctttaccttttcttagggacacacagacacctaggctccttaagtagttgtcactcctaaaacacttttaacacgttgtttggagactttagttaatgacatgtgttaaacagtgcagcatcaaaacccagccttcaaaccttcacgttggaaatgctacatttgggacaacatgctagctagctagtgcaagtgtgtgtaactcatcaaggtaaagcacatatatttacattctgttgatcgaaaatcgggggcaaaggtagaaaagatctgaaaaattaaccgcgcagaattttatctccccatcggtcgaaagcgggaaattctggctgtcgctacaacgtactcgttcacattctttcagcaacgatatgtaaattcagacgccgattttttcttttccccggcctctagtcatcaagtgtcgactcgatcggtcaagcgactcatgaaaaatatataatctaggttcgctgttctgaatcttgtaaagaccaagttgcgcgacggcgagatcagttttcgatcgatccgccaaggtgatcacatcaggctgcagtgtatacgtcgagtccgcttgcaagcaacgctggtcacctcatctgtcgatcggctatacgtcgatgagaagaggagggagctggcccgtacgtgtgcaactgtgcatggaggaggagaggaaagcacagtggcattgaccgtgtgcatcaggtgcagctgagaggagtggcctttaatttgccctaactaatggagtagcagcaaccagcagctagctagattgttctgtgctgtgctgctgtggtttgatcgatggatggatctgtataggttgggttggtcatggggagggaaaaggtagatattcccggtcaaaaagatggccgtggaaaggggccggggtggggggaatgagatgagcgggcgacggcgacggatctccgggaaagagagataggcgacgaggagcgagggctccatctctcgtttctctccgtcgcggattggtggcgcgcggggcgaggtgggccgaggagctaagccccggcccgcccggaattccaccgatcgagagagagagagagagagaagccgcgctagtcaaaggaagctcccgtgacggagacggggccggattccctgtcccccgcacgggccgtcgcgcgcctgtgcatggtcggtcggtcgatcgctcgcccgcgcgacgtcgaccgcgacccgcgcgctgcggtatcggaaaaatctcctgctgcatgcttttcactgcaatcataggagggaggaaggtagatagcccagcccggccagcgcctattcttgcagctgattgatcaccatgcagcacagttcttctcttcttacgtatatactacagccgtcctaaaatattactacctataatagcgccgtgtttagatacaaagtttttcttcaaactttcaactttttcatcacatcaaaacttttctacacacacaaatttctaacttttccgtcacatagttccaatttcaactaaacttccaatttcggcgtgaactaaacactccctaggtaataaattaaataacaaattaatctggactcactttgtccaaattctcgtattagaatttattacatgagaacattttcggagggggaaagtatctctcatgtcgttgatgcttctcttccggctagctccacaaggtggtgggttagacgacctgggttcgaagcctctccccttctaatgatttgatattagttccttccctaatattcacgtcttttgttgatgcttctcttgtttgtcccacggatgcttaatttaccgagttatttgcagctccatttcgataagtttggacttaattaacttgtgatatattctatcatggcaaaaggaacacattttagattctccatgtcctaaatcctctaccccgccatccacaatctggcatgtggctcgcatctgtgcatcagacggctatacttacaatgacatataaattttatgagtttttttattaaaaaatatacatctaaaacagttttaaaagaagacaccacgttcattgtaaaggttagaaatttcaacattaaccagagaaaaaaagtttacgtaagaatacaattttgaaataactgaaaattaaaataaaaaaagaaatatcgaaataatattcaatatgtataacacaatacaagattagttgcaatttaatataaaaaatataacttagacattacaaaaatataaataatagtccaagtaggaatacaacttagaaataactaaaatccagaataaaaaagaatattaaaagaagagaccatatggaacacatcacaagattaattaaaattcgaaacaacaaataaaataaattctaaaattagaaaaatagatattttaaataggaatacaatttagaaataaacaaaatttgaaataaaaaaagaaatattgaaaaacaatccatgtagaacccaacacaagattaactaaagtttaaaacaaatacaaatataaaattagaaaatagaaaaataaaaataagagttcaagtagcaaaacaatttaaaaataacaaaaaaataaaaataaaacaagaaatattgaaacatagtctattttagaacacaacgatggcaaataacgacaaagagatgaataacatacaagatgtaaagtggtagaatggtggcggttgatgggaaatctaaaaactataaaacaacacctcaatgatgattgggtatgattttaagaatcacaatgatggttaagaggagggatagtggcaggccatgaagagtagtgtcatgtgtcatggtggttgacaggacctctagaaagttgaaaaagggacccaacgataattacattcaatttttaaaattccaacaataaacaagatgagagcgggcatggttataaaggagtatagttatgaaatttgtcgggtactctaagaacttaaaaatgagaacctgatgagactgatttttaaaggtcccaaataaaatgaatagaagttatgtcagattgagcaagaaaataaagctggcaaaagagtaagggggtgaccgatggtgtgacttttaaaaactataaaattgaatacccgatgatgataatattcgtttttaaaaatcttaagacaacaagatgactatttagcaaattttaaagaaaatcatatgtaaaattttatataattttgaatgggtgcgccatgcaattgcgtggaccacccaactagttttttagttacaatgttatatttgtcaggaacatatcttgtatgcacaaacttcatgtgcacaccccatgcataccatgtcacaaaaaaaatctagaaaaaaaatcgtgcatatactttcaatagtgttacacctatgtgtaaaatcttaatatcaaattcattatattttagcggtataaaaaaatctgaaagtattttttgttgctatttatgtagaatgaattcgaaggcgggactttacacgtaaatgtaatattactgaagtacatgtataatttttaatacattttttagtgataattgttagttggtatgcacgatgtatacacgtgaaagtttgtgtgcataagatacaccatatatgtcactatataaattttatccgcaagctctagcattcactaaaggagatgtacattaatcccatgtggatgaggtataataactgcgtaaatattccttccgttttagatcacttttcactatagaatttaaagtttttatcaaatacttgccatcctcacattacaaagtgagacgatctttcatctcctcaattcatcgatagctttgggaaacgattaatggaacatagttaataaggtaacgatgtataggtgcggaatttgctagaaaaataagaataatctgaaatggagggattagaatatatagttttgacttaaagttaaaaaaaagagagataccataatgctacaattttgacttttacaggcgctagccagtgcatttttctaaaactcccctttttaattgaatacatttttt

SEQ ID NO: 67520 - DNA, 25120 bp, Oryza sativa
atttatgcacaattgcacagttccatgaaatccaaagataccgttaatgaatgtttctagattaggtatcgggactgtaaaccctgcctataagtagtcttggttatgcttatgccaaacttgtaatcagcgaggcctgtgtcctttgttcagtgtgatttggtcaaggcacaccacaacagtgtagctgtagcgaagcagtgccactagtagacgtccttctatgcctcctaacaaaactaagtaatctcaatcggtccgaagtttcacccgattgagatatggtcgcactgccatggtagatcggcataaaactagagcccgtcacggataacacttatctgtgacgggccatagttgagccccgatggagatgagggttccatatctcaatcggaacctaaaagtagcccgtcacaaatgacaatcatctgtgacgggctccaactaaagtctcgattgagataagtttaatgcccgtcacagatgacactcttctttgacgggcttttattaaggcccgatagagatacttgtatactcgtcacggttgattgttttagggccattacagatatttgttgcacagtataaataccccccaccacctagtgtaattgtatcccactatttactattttggtgggaggctgtagggggcgattttctgtcttttttccaaggaaaacagaaaattcctaaaagtgatcaaaatggagcaataaagtgagtaatattaatcattaattgagcaatttcatcacgtcttattttagcaatactgatcttataagatgtgcctgtaattttttttttttttgcaattgatcgaagttccgtaaacaaggaaaaaaaactgaacaactccttagttacggtttactgtttaccttacataaaaaaaactgccactcttctcacatataattataattgaatgggttatgtttcatttgtattattttcttaattcttacacacaagtatatttatacaattagactcattaagaattcatattcccaaggggcctctgaatctcttatgtttacgaagaaaaatatggactgcatgtgtttgtgatccctttcttctcatgggctcataccatcaatcacacacattcaccttcatccttttaactcaaccaaaaagatctaaagcctctatttgagattattgagcgaattattactactgattatctatttataaatttaatattttgacaaatacatttaacaagatagctcaaactgcacggtttaagcaatactatatttcgaaacgtggtagtacaaataatccgtttcagtaatccgatcaataagcttaccaaatcatccttctcaaacggttcaagataagggaggaggtccatggccggagagagcagctgctgtactgatgacgccaactggcaatcaatcaaccaatcaccagcttacaattcggccacacataaactcgattcggactaaagacgccttgagaaaaaatccgctttccttactcgttggcgcataagagataaatacgccttcttcctcgtctcatagtagtatacacaaccaatcatcgcgatccgccctcgcaaacaaaaagaaaaaagaaaaaagaaaagaaaaacgaaacgaaagcttcttcttcctcctcccatggagtcgcttgcgtcgcaagcgaagccggcggccgtgctctggctcgccggcttcctccaggccgcgcgcctccaccgcgtcgtctccttctgcgccaggtttcgcccgctcccttctcttctcgccccacccccaccactgcttccccatctcgaattctcgattcttggcgcgtcgagatggggggattttgtggtggtggtgggggagtttttcctcctcctctcgattcgctgctcggttgctaacgcttttgtcgtgtgtggatgcagctcgaggcctctgtcggccaggatcgcgcagtgcttctgctcaacgggttcatctcctggggaggtacagtttgctcgtaattgaggttgaaatctcggctaaatttgtgcttgtttttttttcgaaatttattatgaaagggggcggccaaaattcaatttgcgtgagtgacacagtagttgggggtataatttgccttgtgaagcaatttagcctggggttagcgtgcaatcggcccattgcagtaaagaccaaagaggctagcaaattagcgaatcgtattatatgtctgagtctctgagaatgtttagcctgggatgctgtagggtctctgatggtgtagacaaatatgctctccgttttggaattattcagggcagtagggcacaatgagcacttgatttttgatatttctcttctctagatgagtctaagcggtctgtcactttgtttactcaagttcttccacctcgggattaggggatttatatgcaatgtcatgatcttgttctcaatattactagcatggctgtttttctgttccatctgattagtaccctttctaaaataactcttacactttatagcttgttaaccctaaaatcggtggtcattccaatcctttcgtggatactgcctggggattgcagtcagttgcaagggcagcatctgtgtgatcacacagtagctgtagcgacctattcatttctacgctctgttcttattcaaatattctatgtaagttcttctctttatgcattgaaatatattaaggatactgattgtgttgctttttttcaaataaatgtataattattatttaacttctgctgagactagaaggttatcaattactccctcagtcccaaaatataagaagttttagagttggacacggttattaagaaagtaggtagaagtgaatggtggagggttgtaattggatgagtagtggaggtaggtgggaaaaatgaatggtggagggttgtgattggttgggaggagaatgttggtggagaagttgttatattttgggacaaatcctgagggttaaaagttgttatattttgggacggagggagtagaaaatagcaattgaatgatacaccatggtaacttgtcttttcagtagtgcacttaaactttaatattataacttcagtaggtggttgcagaactcatgacttctgttacaatgatggttaaaaaggccggaagcctcaattatatttcccaatgacatcttgatgctttatatgaaaactcctagatgcaaaataagagtagtttttttcccctgattccctggaaataacttgtgttttctgtcaatttacctccccaccatgaccttcagtactttatatagtttagtaccttaatttatatattttcattattacatacttgacaaataaaaaggagaaaatcaaagtgttgtatatttctgttaaatgtgggtttcttataacagaatatccttttcaggtattatggttttatccactttacatcttcagcttcgtgttgagtacactttggtacgtttagtctctgtccacactggatatcttacttcccttgttgaccatactagtggtttacttttcctttaaagagcaaacacatggtttgagttgataacagaattacctagcagcacttgatatagtatatatttttatagtaagtaaatagagaaagacagaatgatcataacaatggtactatgcatgtatgagcctatcataccacaattaaatcagtgaatttctgttgaactttagtgcttctaaatgtcagtattacaatatttggttcagaagttacccattttcaatttgtggtatgctctgggattatgagctcaaacataaaatatttcagtaagccttctcagggcattatcataaattgcaaaactttctgttggatatacgacgacacccactttctgtttcttttatcacctcattgatggtgttttgcatagtttcatttggtaaaacccacctgtcttgtaagatgttactgcagaattaagaatcactgagtaatcaaatcaaaagtgttactgtaatcttgtatagacatttgtattagcaacatagcttgaaaatatttagatgggtttgtaactcctatatttttgcaacatgcagatgtaattactctctttatgctttcatttctctaaatcttaagtgagttctctgtgttgcagtccttgggtttcaacactaaattgtgatgaataaaatctaaacttcgatttactcataggcacatatttacaatttctctatggaaagctcaattcttgattttttttttctgcattgttacattattacaggtatggactattgttttaccatcctcaagattcccgtatttcatatactaaacagtggtgggcccaattgtaccttttgtaacattggccatctcacgtcaggtataatgacattgctaagcatgctttggatgttgtgaaaagaaagagcctagatgcaactaaagcattggatgctcacaccatatctgaatcaacagagaaacctgaagggtttgatgagtaggttcacatgaaaactcgttgattgcttgttgtttttacatgttctgcatgttgacatgctattgttagggttgcaattggtattggagaacaggtctattcaattcttcttttaactattttctttattgaggtatgtttctttgctcatgtttttccatttgtcatgactcacttcacatctaatttcacagaacatgttttgttggcacctcatgctcatttaagcttatctagtgctattcttttatgctatctttttccactgatatttaagttgatgctgtacaggtttcagtaattggttacataccttactttgggaagcctatgaatttcctgctattatctttgatgtatgcctactactgcttcgagtatgtacatcttaatgtctttaagcattctttcaactccctatgtcttatacatttgccaggttacgttattgttgtaaatttattgaactattcttgtcaggtacaagtggaacttctttgcagtgagcctgaatgagcggcttgatttctttgagtcaaattgggccttttttgctggattcggtatgttgataatcattcattgcatatggtgcaaaatatatgcttttgccttcttaggccatgatgccctgcctgtttcagctttggactgtaatgcaaagtgattttgcattttaaagttttgatttttaagaataattttaggtagatttttacttgtattcttagcaatctcgagaagagaactggacaaaagtcacaaagagaactcctaaaatccttatggttatgcaaatgtaattgttggaaagtaatctaaactataaacctttttgtttcttgtgcatatgttcttggcaagaaatacatgcatctctaatcgtctttatggaaagtgttggtacttatgggatcttaattctctcaacttgtggtcatcatgcttggcagttagcagataagtcatctattggaagtaatcctgtaccaagctgaacgttgagcattttcttgtaattttcatggacaaatatatctcggataggttctcaggcagtcctagctatttgcggcatgcatgttccttataaagtttgcaggatcctatataactgacagttgttgatctgttttgatgtacctttataaatggcatatgttactatgtaattctgtttctgtacattcttcgacttactccgtgtatgctagcatttatgtgattgacatgttctttgataccatttttatataggtagtccatgtgtacttccaattttcttcttctctcctcttacaagttatggtgtaatggcaatactttatccactggtatggagaaacactcactagcagcattttttgtttccatttaaacagcatgcagacatacttgctcttgtaaaataggcatagaagctagacatggaaaatcccttaaaagcactaactcataatgccattcccaattcttatttgggccaatttgtttggttccatcacaaaaaacacaagagttggaaaataccgtcgcacgtgtcattgacaggtgggtccagacaccacatgtcaattgtcattcttacatatgatgttaaattttaactcatttatctctacgatggtatttttccaaattctcttattaaaaagaactcaatccgcaattctacatccagtccttttctccaccgaaactggtgtggaaactggatgagaaaaaacagtatcttcctttgttcccttccatctaataatatttcccatccaacatattctgagtgcagttatgcaatgttgtctgttgcagtttgtattgactgctgcaggtacccaagcagaaaaagtaattgatcaactgaaaccttcgcatggagggaaactgcagagaatacctgttttcttcatagctaagcgactaacgtaagcactcatcatatcactcattcaagaaaattgcattgttatatcattcaaggcttcacaggaatcatgccattttcttgtatagaattagctaccggtgctaatgatgtgagaatagttaattgctattgtttgatatattatcttttaaccatatccttccaagtaaaaattggtattggttatttaattcttattttcatcttcttatagtcttaatctgaattagaattcagtacagtatgctgagtgctagtattcagaatttcagattaatttccttttagggattatcacagttttcctgcaccactgctactttgcttcccttgggtgcactataatgtattgaaacttgtctgaacctgtatgtgcaggactcaagtgctgcaattgtttccagaggtacacaaagaacaatgaaaggatccacataaccatagcaaaggaaacaaacgctgtgctgggctttatcacagtgctgctgttgaagttacacccgaagggtgtataaccagaactgtaaaactgtaaatattccgccattgcgattgtatatatggggataaagggaattaaaaaaaaaactatacttgtgcaatgatgtcattcatatttgtgtacataagtacataacaacagcaacatctctttgttctacgaaatgttatagccagcagaaaggttaatgccattactagtgctaacttctaaagtgattctcgttggttctacccttgtaggtttctaggttcactttgtgtattcgagatttgcatgaacgcgtggcacatttgacatgaacacagcccaagtcgttaggaatttaagacgtcaactaatactttgacatattcatgtatacctctttttttttcctttttggcaatgatatattgcgtaattcaggacccgggaatacgccgtgtacctgcttgacttgcgtgtacatactccatgaaagcgagcgtgcgtattttgtgttaaccactgtagcttaagactgtttatcactagtactatttattaagccgaattgccgaattgacgtgtaaaggctaaccatgttcattaattcatggattatctaaccacgtgagtcgtgactaggtctcacacgaatattgagcgcatttttttttcacatcagaaatttcaattgacccgaacgatttctctatgtacaagagccaataccaagatgtaatattaatattagtattagcttaaaaatatgaacatcattagcctatttttttcatggaagcagcctttaagattgtatgagaccggttttgtacttttgtaaggtgctagacaaatttccatgatttcatcggcgcagcattattagctggtagtttgtcctcttgtaattcttttctcagtacatgaccatccataccctcatgtcttctccattttgaattagcatattagcatgcagtcatgtacacaatagtacaatacagctagatgtgtacaatgacaattctaaatactagagtactattactactatcattgcttagaaacgaccaaaacaaaggcagctgaaccccgatcagcgactaacttgccatcaacaataatcaactatattttctcccccaatcaaagcatgcatggtagtctgctttcttcctggcaattttgtctgccatcttccttcagtttctatcatgaatattatacataaagcattttcctacaaatgtgtaaacatttttttatatgaaaatgattggatggtgcagatgaactggactttcatgataataattcacatctcacacaaggacgaaaaagttggtactttatgagttacacctccgtaaaaaaaataatacagaaggcaacttaaaaataatttataggtaatttttatatatatttatattgttcgtagcttaaaagctagtgttgaaaaatataccgccatataacagaaaaaatactaaaattaaattaatgttttaaaatttaaattttggttgtggctgataaaccaccgagcatttgtgttttcttttaattaatgcattctgtggccggtgatcggattgaacagtctttatttaatgcatcccctgtttcaactaagaagagttggctgctatgagctgcaccctaaattttgtatggcaactggagcagttccaattcttccttgtggatttgcacaattctcccatttcgtgcatgagtgcctgtcatccttgcacagcatcattgcttgatgttgtgttgccacctaactcattagcataaacaaaaggatgaacaggagctaagcatcttacccactataggagcattacttgatgccattgccatgtactccattactacaccaatgcaaatacaaagaacataagtactcagtttcatcatgattactaaattttctgtggtgtctctggccaaaatttaccgtcagctatgatttgccaaaatttggtacaccctctgaatgtttgctgtctctttacaagaactcttctgtgttacttagtgatagatattgagtttattggcattgtaggggatgtaataatcgttaatgattaatcattatatatggttcatataataccagacgaatgagcattaattggtcgttattacgaacccctcgagctaatcaatatctcagatgcaacttagatctcatgatggattggtggagccgaagctgcagtggatgtagctctcagcttcctggaccagtactaccactgcccttgtgctgggttcactgatccttttaagaatgttgagctagctagctagttcatcttggcaagcaacaacttcatcttcaatgcacttgcattacttgcattgtgttatgatctcttgtctttttggcaagcttgttggtgcgaaggtgaccggccctgtcgtccggtgcgtgtatcatcaccattccatcgaatccatgttatgatgtgaagtcaacttaggcaaaaaaatagggtcatttggacatgcttatgtttgatgagatgtcttgttgcaaagtaggccaccttcatgtcaagatatatatttacagtgtaaatggcaagattcccagtattatggtagaggaagtttgcctcagatgaacttgaatgttacaatgattttcgaagaaattgttggtttcccttttcgccgcgtttggaacgagggaatttcttctgtgttttattgcgggaattgaaccttttttcctatgaaatctattcaatactttcaccaagcattactctacaagagagatgcaatcaaatatatggtagtacatattaacaggcagaccttttttcctgttggttgtcaacattattgttttgattccgtcgacccacaaattaatcaatttcttgcttttcttgaagactaaaatttcttgctcattatgatgctggttgaaaacccctgtttgcgcaactaacccatagcgtatatgttatcccaatcggtgttaggatgagcgtctacatccattaccaagtaaaaggatcattccccaattggatacaggtaaaataaaggaaatattactgaccgaataataagcaatgcaattaagcaaatataatttctgttataattcctgttactttcttgcagtggcactgctcatcatcagtgcaatggttgtagtgctgtactaggcttgtgtaaagcgccgaaatgcagctgtgttcctcttcttctttttcagacaacagaagctctgtctcctcgccgtgccggtttgtccctcttttccactcgtgcatgcatgtactagaaaagatggaatcatggaacaatatggtacaattaattaaacttatactaactcttacaattattgtgccttttctatcaaaaaaagataggagtatattcaatctacagaaagttactgaaagccgaatattattagcctagaattcagcgaagaagctccaccacgaaactcctacatttattcgaaatggcttttttcaaatttgcctcgcttttgcagatcaatgattcgaagaggagaatttgtcacgaacttttccttgggatttccctttcgtttctttcttccagaggtcgtactggcgatgtgtgcgcgcgtgcgcgcactctcctctcctttcgctttggcttccgggtgattgtctccgcgatacctacgctggctttcggctatctcctcctccattgaaggtaacagattaaccgatcagtgcgcattgcaccacggaaaaaccaaaggaatcggaaaaaaaattctatgaaaattccttctttttagcttctgcaaagggaatgaattgcaattaagaaaggtttttcctttttctttgagataatggaataaaacttcagcctttactcaacgagttacagccaattattacataaatttacccgataacgagcacacaccagaaagtccataaaagcacacccaaatactagcaaacacaaactaatatgcaccaacactagataaagatctcacaattattgaatcttatttgtgaaccttcgttcgaagttgacgaaaaactgcatgatcattgactcaaattaagagatgcagtatttattaactcgatgttttcattacaccttcttagccattacattgccctgaaaattatatgtatatgtatgtttttttaatatgatttgccctaaaaattaagaaaggtttggagtgagctagctagaaatcgatctgttgataattggtcgattcgtacaatttgattaggacttaggagttttgatgatgctctgtgttgttgcacagtgcactagtggaagccggcacagtggcgtctctgtgactggcacgttgatgacatggcacctactgcgtgtgtgccatggctgcctttgatttgtttctggccagtggtaatcagtgcatgcgtggttgctttggattgaatatgatgcttaatttggtgtagagcaattaagcaagcctagttgacatctcagttggtgcatgtaatgtactatagtacagtatactttcgtgtgcttaatcagtactacgcctggccagttgaatttattctggtttatgcatgcaaaaaacaaaaaccaagggtccttgaatttgagcacagaaatggaattttcgctctatgactccttccttttgaaccaggacatgatttccaaacttttgaactgctcagttttttaagaacctttttgagcatttaatttttccaagttttaaatagttaatccattcgtttgcatgctcaaatattatcacgaaatcagataatgcatcactcgttctaaacaaaagaattgagcatatagtggaattttcgtactattcatgtcaaatatatataatttgatgaaatggcactgaccccacaatgtggaaattcatgtaagtagcactttacggatttttctatgattggcatagtgaaatgacactatcacaccaacccctcgtacgtggtgtggtaatgttaattcggtacaccagtatgccaatcagatcgatatcaaaagttcaccgcgctagttagattagcgtggcaagacaatactgttgaaagatgttgcaggtggcgtgacaatgttttttcatcgtgtcagagaaatgccaaggggtttttcagctagttacataagatggtaggctagacaacctgagttcgaagccttacctcttctaattatttgatattagatctttccctaatattcgcgtctttttaaattggcgtgataaaagattcagatgtaaaaatattttttaggagtatttacttttaaaacttaaaaagttttattaaaatttcgcagcttgcaacactgatgaccatacaagttagaatcagcataaatcgtaattacgagatggttggttgttagagtagctggaacagatgattagatgcaacaataggcatgtaatccgacaaatcaaccgatcatttgcgacctttgcgtcgtaaacaaacggtgtgaattggccaggggtcaatcggcggcgggttagtgcgtccaaatctccgtttataaaatagtcatgagaaaatcatactgtttttcatccgtatcaactgatggtttcgatcgaccaaaaaagacaagaagtactggagtttgaaggacgctggagggtgccaactctgttttacttggttccgtcgttacctccccgtgtctaatccacatctaatttattgacaaatgtttttttatagtacatcaagttggtaactaaagtttcctggaattgaaattggcttatgcatgcatatgttccatttgatatgacaaatgcgtttatttctcgtgtcaactggtatttacgttaaaaggagaactaaattttcagttgaatatatggcctcagctcattgagatatcctcttctaactgtagttgtttctttccgtatattttgaattcagtcccatcattttttcctacagctgactataggccgtaacacttattagggaacaagaaataatttataggtaattttatatgtgatgttattagtgacttaaaagctagtgatgaaaaataaattacaacaagaaacattaaaatcaactataaaattaaatttttggtagcggttgataagcttatagagtattaatcatcatataaagtttttcattaggaacaagaaagacttaactaccgtatattttatttaatatgagtatgtggtaagaaagaatcaataaacattctccatatacacaggaaacaagtgtttaactacttctaaatgcatagattacgataatgttgcacatcaaaataaaggattaaggttatatgatatgataatcagtatggaacggagcgagtagtatataatttgatacctcatgataacggcgtactaataatcggcaaattttgctacaaaacaccacgaacccactttaaaaatatgcctaataaaactggacactcttcattggtatacacgcttgaaagattcacatatgtttacctatgctgcgaaggattacattaccatctcaagtgacagatcctcatactcctctgctgacgtgtacagagcatgccagctcagcatccacgtcacgcaactccccgatcccacgtggtcaccgcgacctctctactcgactactccataaaaacccaagcgaactcacgcctacgcctccaaaactccacccacccacccacaccgtcgccatgcccaccgacgccgccgccgccgccgccgcctcgtcgccgtcgccgctccttcctccggcgccaccttccgccgctcgccgccggcgccgtcgcctcctcacgtccccgaacccctcggtctcctcgacctcgacgtcgtcgtcatcgtcgtcgtcgtcgtcgtcgtcgtccagcctctccttcccgttcgctcccttctcgccggcgccctcgccgttccaccaccgcttcctctccccgctccgcgcctccgccgtgcccttctcctgggagcaccgcccaggcatccccaagacgcccgcgcgccagcaccagcaccaccgcggcggctgcggcggcgggaaggtctactccacgccgctgcccctcccgccgtccctcctctccagcaaggtggtggtcgccgacgaagaccgcggcggcgccgaccgcctcgccgtctccgacgacgacgacgacgcgaaggccgcgaggaggaggagtcggcggcggcataggcggaggctgctgcagcggccgcggcggccggcggcgctggccgccgccctgacggactggctcgccgtgctgagcctgtaccggtcgtgcacgaggtccgtcgactgcctcgccgacgccggccagccgccgacgacgacgacgacgacgccggcggcgaaggccgggtgagaattgagatacgtactttgcgttgcgtggacgggtgggtgcgattaagagtgtgatttgcggcggattaatcaataatcacgtcgatttgtgcgacactgtaattaattaaggtgggttttcttttcttgtctgtgtgcatgtgcttgctccaacataattagtggatggattaattcgacacgattagtacagtaggctgctaaatgactgtatgtattagtgctgctgctgttgcgattggtccatttttcttctttttcttcttcttttcctttttaagaaatgtaatttggtcagtttggtcgctcatgtcatgctaatagtaatccattctgctcaatgtgtggtgttgcacgtttactattactccaagcctgtttggagaagtttctaaccgtttaaattttaactcaggtttttagaagttgtagttgtagaagccaagagttgggttttccggcttctccagattttcaccaactgtttttcataattttaaactcccctaatggggcctctgttagtatggactgtggttaaggtacatctgccactggctggtgggttcactaagggcctgttaactttgatgccaaaaaaaaccttaccaaattttagcaattttgacaactatgccaaaattttggtaggatttcttacatagttatcaaaatttagcagcaaattaaatgtagccacttttttagcaattttaccaatatttggtaaggttgaaaatgacatcaaagtgaacaggccctgaatataattttctcctcgcactctaaaataaacattacaatatgtgtttttttacaaagacatgcataaaataattcacattttctttgataattaagttcacatattggacctaccaacatagatactgcttggttctcgttttacaattctaaacgatttaaatttttaagttagattttaaagaagaattatatatgaagatattttacttgagctatgcaatgaaagtgacagaaaaaacatcttaatgtcgtccgaaattcaggtgctttggatttcgattataatataaagatttaccatgcaggacctagagttattcaccaaggatatataaaaaaatgtaaatatttttttaattatctaaccaaactatatatatgaccaacagttcagctgagatctctagcgaatggaatagaaatgttccatgcatttttttttttcttctacatttggtcactggctcactgctaattatgcaagcattagtttaggttggctgatcagcacatgcagtcggcggtttgaaacaggctgcagctctgcataaaaggataattaatttgtgcaaaaaaattcctcccacgtgcaaatatgtatactacttatttcgttcgtattataaattgctttgacttttataaagttaaattcttttgattaagtttatataaaaatatactataaacatttatagcactaaattagttttattaaatctaatatttaatatattttgatagtctctttttctatattgaaaatattgtttttttatgaacttgtcaaagtttaagaattttgaaaaaaaaagatcaaaacaacttattgtatggattatataaaacgtggtactagtaccgcagtatgggatgttccaatgttttatagtttccccttaacgtgacaatgcacgaataagcttgttgacttgacagcatattaatcaaatggatgtccaaatctagtcaccaaacattcaaaataattacaaataagcagtatcatggcccgggttataagcacaatttacatacaccctaaattgcaaatcctaaaaatactagctctgtgcctagctatgtaaactggtacggttcaaaattaatttacggcaaattatttttaaagaaaaacaatcgtcaccagttaagttattttgaatacatgcgtgcgcacaaagaatggaaggcaagtagtagagatattttgatgaaattatattttgtatagtttgaccatgagaatgtgctgtacttcacgctcgtctatcggactatcggaggctcggagcgaccattttcaaggttcaaatcaaaatctccaacaactcacatgtttacaatgaaccttcgactgtgaccaaaactgtaatttaaaccaaaaatatgataaaccgcaagacaaagataactagataagcataaaaatgttttttttttgacaaactcatacaaacaaaaaaaaactaaccaaataaacagttgtaataaaacaatactaaacttcacaacaatcttgaataaccgacaagtagaaaagaaaagtagtagcaaaaaaacaaaaccagtgttttctactgtgtcactaattttgttttaaccggacgattacatacaaaccaaacctcgtttttgtcaagtactcatcgcaatcaattagtgagtgcgaggtttaagaaaaaaaaaggattagccagtacgatattaatgtctcgatcagacgatcagctcactaatcactcagccttatgtcacagagtataaaaatgcaaattataataagctgcttccttcgtttaaaaatgtttgacaccgttgactttttagcatatgtttgaccgttcggtttattccaaaaaatttgtgaaatatgtaaaactatacgtgtacataaaagtatatttaataatgaatcaaatgatatgaaaagaataaataattatttaaattttttgaataagacgaatgatcaaacacgtactaaaaagttaacggtgtcaaatattttgaaacggagggagtactactaccagcaattgcaagatgcacagtaaacaggcaaagctagctgtagcattagcactagcagcagtggatgcagagacagcgagacagggcgttcgttgggtcgcgtccctcgctcgtcttgaccacgaaagagccttccattggcagatgctgctggtacaaccgcatgctaattggagtaattaaagtcatctgcaagaactagctactcagctggttgatgttgaattcgagctgaatttcctattaaattcctgtgaatttggtgtttaactccagcaacagtgcagagctcgcctggttagagcatccgcaatggtaaagtaaggtgctctctataaaatatgtatatcttagcaatagactagattaatagtaaaccacctcaataatatgtctacatgggtatctatagctctctcatgtattgcctcgtttttctctatagactatctctaaattagtagatagctttgctctctctctcttcatttaatatcttccatgtaggaaaatatgctgacatggatctcttgtagagagtctatagataaccattgtgggtgcccttaggttaggtgatgatgaacattggacagggctatgtagccatttgtgccactcaaagtcaaatcgcgatcgggaaagtaggttaaggctatgtttagttcaacacaaagtttgaattttggttgaaattgaagatgatgtgactgaaaagttgtgtgtgtatgacaggttgatgtgatggagaaggactgaagtttggatccaaactttgcatctaaacacagcctaagcagcatcggtgcaggtgtgacactgtttctaccaaatcgctctcagatctgcgtgagtaaccaaattgatcgatcggcgtcagatctgggcagatggactgatggatagcaaccactctgacatcatggtcttcagtaattcagggagtatactgtactgtacttctgctgaattggatcaatcggaagaggtaacttgacgctaaagctactactactgctgatgagctacagcttcgtcaaccacgcatgcgttatttaccttggccgaggtgaaagtgaattcctcgtttgactgtaacaaagagttaatcctgcttggagtgcaagggaattcatggcagaatgcagattaatcgatactactagtcactgatccagtagtcgacactggtttccaaaagtcagcgcaaagtctctctctttctttctctctctctcgtattttgtccgtttcatataaaaaacctattatcaaatatgagatatcttaatattataaatctgaatagaaatagcttatattcagattcgtaataccaagttagtaatcctgagttagtgtaatagtttgattttctggggacgaagagagcaagctagcaaccctacatgtgcaatatgcacatgtgcaatcgatcgatgagtgcttgttgccgtcacgtcgggctgtcgctgattgatccatactatgcctgtctggataaaagcttttcaacgcagaactgtgcatgtgtttgcaaatgtcatgggtgaataatgctgccatgtcattgccggggctgggtcccgggaagaactgcactgactgcgttcttgcgttagtggcttcatgcctgtttcgcgaaaaaagaatttctagttgtcacattggatgtttgacctgatgtcggaagggattcttagatacgagtaaaaaaaactaatttaataactcgtctggaaaccgcgagacgaatctttagagcctaattaaactgtcattagcacatgtggattaatgtagcacttatggctattatggactaattaggcttaaaagatttgtctcgtgatttccatgtaaactgtacaatagttttttgtttttatctatatttaatgcttcatacatgtgtccaaagattccatgtgacgttttgaaaaaaaaattggaaactaaaccaagcctcagataacaataaatagccaataattggaggaccttttctcctgtaagagcaggtgcaatagcagattttgaaccagctataaacacattccgatgagataaaagatgagagagaagagtagcgggctataaattcttagtcagctgcagcatggactccaagatacatgtgtgtatgataagtgggaccagatattaattgtgtagtatatatttataggtaactattggctattaagttgactatagatgatttggagccagcgattggctattaaacttgctctaagagcaagtttaatagtatagcccactactggctccaatttatctatagccaattcatacaatagttgcttactatactattaatatatggtcccacatgtcatacacacattgcgtcttggagtccgtgctatagctggctataaatctgtagcccgctgctcttctctcttatcgtttatctcattaaaatatgtttatagctaactaatagcctgctattgtacatgctctaagagctctgaagatagccgggccctgtttagatgggactaaaacttttaagtccctatcacatcggatgtttgaatattaattataaatattaaacgtagactattaataaaacccatccataatcttggactaattcgcgagacgaatctattgagcctaactaatccatgattagcctatgtgatgctacagtaaacattctctaattatggattaattaggcttaaaaaatttgtctcgtgaattagctttcatttatgtaattaattttttaagtagtctatatttaatactctaaattagtgtctaaagacagggactaaagttaactccctgatccaaacatcacctaagactgtgagattttgtgtcatcgatttgagtagtagtactagatgatatgtcttgagatttgagagttgacattgttcctaattcgcttttgttaatcgaagtgtggctcgtgagatcgatcgacggttgcattggcagcgtgtgcaagctcaatagtggttgccaattataaggctgagtttccttttttcacttttccaactcatatctctcatttttcatgtgcatgcttttaaaactattaaaacggcatgttttttaaaagaaaaaatatacaaaggttacttaaaatatatattgatttatttttaaactttttaagttaatatttaattaattatgcgctaataggaacaatgtttttcgtgcgggagataactccacctcccttacacagcctaagggcaggatctaacacgagtactctttcatcctaacataaattagatttacgtgttagatttatttatttggggataaagagagtatgtatatcgacatgtttttttttagaacgtggaaatttggtattaattgtttggtctcttcgtgcacttatctgaagctagcttcatactccttccatcatattttaagtgcagccatactttttcgtgctcaattttgatcgtctatctgaaaaaaatttaaaaacataagtcgcgcataaagtactattcatattttatcatctcataacaacaaaaatactattataaaaaaaatttaaataagacgaacgattaaagttagatagggaaactcatgatctcaatggatggagtaccagcgaggcgtattttatcgtttgttttcctcgagttatctgaagattttaggtacggtcaagtgggtcatacagtatgtactagtagtacaatctgctggtggcgtcagtagagatactcagcagagcagagcagagcggtgcagtaaattggctacaggttgggccggcagttctacgtacggtgtgctatctgtctaaacggctgtttgtctgcagcaaactaatcaatcagggttctggtataagatggaggcaataatccgatgaatgatccagtttggccggtctataaactactccctccgtccaaaaaaaggcaaaccataggtttccgtgtccaactttgactgtccgtcttatatgaattttttttataatttgtattttcattgttgctagatgataaaacatgattaatattttatgcgtgatttgtctttttaatttttttcgtatttttttcaaataagacgaacggtcaaatattggacacggaaaccagggtttgtctttttttttttgacgaagggagtaaatggtaagaccggtttattgtcgtccttgtcaaattttatttttattttttacgattacacgacagacgcaggcctacacatatataccactctatactcacaccgacgaatacgtccccacatattccgagagatgaaaactaccggcacatctctcattccgggaatgcgccctcaccaatttgttacatggttgatcgatcgcggccatatataaccaaacatgcattcagcaaagctagtataaaagacacaaccaggatcgatcacgtacggtgccggccggtcacgagcgccatcgccaaataataatgcgcctaattcgatagctgcgtgctgtagctacacattcattcgcctcgcatgcaggcgtacgtggctggctcgattatattgaccgtgcggttgagggcggccaccacgtacgatgataagaagaagatgcacggatgcaatgcatatgcagctgcaggtgttgattcgaccgaccagatcgacgacgatgtaatggatcatgtatggataagtcatcatccgaatcgatcgatgatcgatccccacatgacatgcatgatcctgcaatttcctgccgaccattttgccctaccccactatcaattacgggtggtcgatcaaatgaaatctttctcgcgctccctcgacctagtttaagagcatacttgcatgcatgaaaggtttcttctaattttcagtttggacaagaacaataaaaatgagcgatttgaacagcttgaaaactaacattccaaaaacggaacgaaacattagcatataattaattaagtagtacagtattagctactacctccgttttttaataaatgacgccgttgactttttctcacatatttgaccattcgtcttattcaaaaaatttacgtaattataatttattttgttatgagttattttatcactcataatactttaagtgtgattaatatcttatatatttgcataaaatttttgaataagacgaatggtcaaacatgtgagaaaaagtcaacggcgtcatctattaaaaaatagagggagtaatttttttaaaaaaattaatataacatttttaaaacaactttagtacgataacttttttaaaaaaattcaccgtttaaccgtttgaaaaacttgggttggaaaactcagctgcggaacacaggctgagtagtaatatctgtctaggccctttaatttcacgcttcatatgcatatgtatagcctcttattcttctttttttttttttgagaatttgtatagcctcttcgatcgtataattaaccagcgttgcgtttggagaacggccgagcacacaagagtgtgtcctagcctgccgtggccgtgcgtacgcacgtatacacgtacacatgcgtgtgcgtgcacgctgctgggtggtggtggtggtatatagtggatacatcagccggccacgtacgaaacacgactactgccctccaggtagctagctgaaattgcgacgacgacgacaccaattaattcgcatcgcacccgtacgtacgcgagcaatcgcaattcgcaatcgacgacatacatccaacactggtcgcgcgcgctactgatgcaacggcgcgatagcacgtacgtacatacgtcggtacgtgcgagatttatttcttcgacgtacggcgcgtgttaattaattttgctgtgtacatatagcagtacacagcttacgtgcattatcattccgttctttttctccaacaaaaattaaatgaagattaaagttttcgttctttttctccaacaaaagttaaatgaagattaaaatttttgtggcacgttttctaaactgctaaacggtgcgtttcgtacgaaaactttctatataaaagttactctaaaatactatattaatctatttttcaagtttgtaataattaaaactcaatcaatcatacgttaataccattttattttacgtaaaaaacttaatttttctctttatttttatctttaggagaaaatagcatcaccgtatatgacagtagtggtgtatctgcagtgccgtgtcggactcatcatcgtcgacctgaagggcccatatatgtgtagtgcagatgtatggctacaaggcccatggaagcgaaactttcactagcgtttttttagtcccacctcggggagcctagcgcacgggcgcggggtaataacatctccagggcgagctggtggcgtgcccaaatgaaggcacacccggcgcaaccatgcgcggtatgcgcatttagcaattgaaaatgctacgcatacgatcttgttacgataagacgcaacggcacggacggcaacagcaaaacgtcacgcacggcgcagtctaagcgtacttatgagccctaaagcccagttcacctctaaacctaactttacgttcactactccaaaccctaaatctgactttcatgttctgatctaatctgcaagtgtgaaactaatccaatagcatacgcatcgaagacgaaggtatggcatcttatttacttgattttctttagcttcacaatcatctttttttttacattattctctctttcttttttttcaaggaacatatttgtatgcgtaatttgcttaaccatgccacatgataaattcaatgttgagtgctaagtacaattactatatacagtaagatattaagaagaggattgcttaagatatgattgaaaagaaaattgctttggttggctcattggctctccaagcaagccaaccagatagcaggccaggacgtcaagagcttgggcttggatataggatcaactgaggcctgagggatccgtttgattgtacaaccatcgtacgaaataattcgtacgtatagcagcgctgggtatgaaggcacacccggcgcaaccatgcgcggtatgcgcatttagcaatacctaaaccaaagttaagtaattggagtcgctgcagggtgacagtgcgagcgtatgacacatacgcttagcaaaaagtaacaacttttttattgagatttcttttccgcattagcactcggggctggttcactttgtagctattttgaactctactaaaatttagacaaattttgatatattttggcattaccaatttttttacgaattacacccccccgaactatcgcggtcaaccgaattacccccataaaccacaaaaccggatattcttcaccctcaactatgtaaaccggacgaattaccaccctcgacccaatccacggtggttttggtctatatagcgtacgcgtggcagtccagtcagcattctatattaaaaaaaacatgagacccacctatcatactcctcttcctctctctctccctctctcccagcattctatattaaaaaactatgagacccacctatcatactcctcttcctctctctctctctcacgggtcagcggcaagcggggacacagagcggcagcagtggctaagggcggcggcctcggcgcggagctgcgcgttggcgaggcggacgaggcccacgcggtcgcgggtggcgtgcccgcgcgccgcgagctcgcggttgcagcgtcagagctgcccagcgcgtgtgcggagctcgtcgaggtgccgctgtttgcgcgcggactcctggttggagatcttccggcggaggcgccgctcgtcggcgtcggcatcggccttcctctccggcggctgggtcatcatcacgcggtggctgcagcggtggcgccgtcgaaagcgagggcgacacgcgggaggtccatgaagtcttgccgacgccgacacttcctaaatccccatcctctctctctctctctctct

SEQ ID NO: 67521 - DNA, 1789 bp, Oryza sativa
cattaacatctatataaatgtgtgtctagattcattaacatctatatgaatgtgggcaatgctagaaagtcttacattatgaaacggaggaagtaactatgtttggaagtctgggtacaatccacaattgagcagacaagcactaggcctggcgcccctcttgtccctttgtcagtttcatatatattggtccttccctctgacaacccctttgcccaatcccagcacttcatttgagtctgcttgctctcttgccttttttcttggcctctacgatactatgagagagcaggactgtggagcacacaacacatggtgggtggtggggaagctgtgattgactgccagccttttgaggggcagctctacagtacatagcactctctggctccctctctggcaggagggcttcttcatcggcgatcttgcagccatgcagatgggaagcatgtgttgcaagtatgctgcttctcactatgagctttgattggcctggtgatgagttaatgcatgcatggcatgttgtggaagagcagagtggtgctggcctgtgccgatgggggcccatgcgaaagtggattgagaagaagagaagaaaggaggggatgaagacaaattgtagttttgccattattctgaaggcaaaaaatatcatatgccactctttagtttctcattctaggatttcccactcttctagatctaattgataatttgccactcacttgatgtggttgatctatgaatttccacttgatggcatataagtgaatctggtatgacaattttcaagtgccatataagggaactagtgaacttgattgccagattaagaattttctctaagtgatgcctttctattttcataattgtaggagcaacatgaatttgaacttagtgtcatcataggtttgttttggttacgcttactgtttctttgtatgggtttcttcgaattcactttattattggattgatgtgatcgtacttctcagcattgagtggtttcacttagcctttcagttatgaattatactcttttttttctgaattgagtctagttgccaatttatcatcgttagttaactattatactattattaattatgcaaaaataattttgttgtagtctggtgagttcaccctcattgcctggtctatgcattttatttgtacatctgccaagttatcaatttcttttcttcttttaccctaattccagatggaagaagtcaaggaatctccagtacagccaacgactagtacagctcaaacaatcacttcaagtggcacagctgatttccaaggttttcatggagctcccaagtttgctgtcggagttcctaggaatctaccagctgttgctgccttgcctgctactgccccagtgacttctgcttccctggttaccttgaaaccacctggatcatctcctgtaaaatcagttaacaacccttcagttgttacaatgccccatatggctccatcgcatcttaaatcggataaaggagttaatggtcctcctaatctagtacgcaccggaggtactgctccaccttatctacaccatcagttatgcatttattttttgagcattcacttttttttagagtaaatttcacaaaactacgtattttatggtccaagttgcagaaaaccacatacactttgacacttggcacttaagtacatatattttggtagtgtagtttcacaaaaccacactatcaatgaatggattcacccgcgagatgatgtggctcattcacataggacgaggacatgacat

SEQ ID NO: 67522 - DNA, 2146 bp, Oryza sativa
ccaccccaccccaccctcccccttcttccttattccccagcccgacccgatctccaaacccctaccaccattccccgcagcgcggagccgccgccactcccccccaccctcaccccgcagaccattcggaaaacctagatccgagccttcccccttcccctcccccggcggcggcggccatggcgacccgccgggccctcacctccgtcctccgctccgcctcccgcctccgcgccgcctccccttccccgtgcccgcgccgcgcgccgctccacccccaccgccgcccgtcccccgcgggcttcctcctgaaccgcgccgccgccgcctacgcgtcgtccgccgcggcgcaggcggcccccgcgcctccccccgcgtcgggcaaggccaccgggggcggcaagatcaccgatgagttcacgggcgctggcgccgtcgggcaggtgtgccaggtgattggcgccgtcgtggacgtgcggttcgacgagggcctgcccccgatcctgaccgcgctggaggtgctcgaccacaacatccgcctcgtgctcgaggtggcgcagcatctcggggagaacatggtgcgcaccatcgccatggacgggaccgaggggctcgttcgcggccagcgcgtgctcaacaccggctctcccatcactgtaatgccctcccccctcttgttccttgtccatcactatgtttggaactgtttatttggatctagtctgacgaaatgacggaccagtagtcggtagatttgatctagatgtacggatccgtgtattgattagggcaggctcaccttacagatccgcgactatagtttgttaatgaatccatgcactgatttagtgcggattcacatatcaaatgccaaatggcgaggccacaaatggaatttgactcttacgaacataattatgcaatacattttctatgttcaaatgctgccccgtagattcatttttccagtccagtcatgccatctggagatggagaaaacatttaccgttggataatttggtaaaggtactgaatgcccttatgggccttttccttttcgtctctatggtcccagaatcacacaaatcaaggaggggccttttgtcttttgggtgtaggggctttatgaagggagggttgagagaaaatgcatgtgacccaatgtaggttcccaatctcaaaatgtgctatgggataacgggaagtccaaaaatgtttcttttaaaataaagttaaagttatcatgtgaagttgaaagttatatttgttttcctgagaaacttaggaagcttaagattaggtgatgggggttgaccctttttttttttgttttgcttacagatattgtggtttgctgattataagttctgtcactctgtgcggcttataatgtgtgtcaaactaaagatcatttgttatttacctgtgacaaaaggctatatatattgtccttgaactttgatgttgtaatgtcagtataaccatctttgatctaaaccatgttctttatatttctttgttttgtctgttttaggttcctgttggtagggccacacttgggcgtattatgaatgtcatcggtgagcctattgatgagaagggagatatcagtaagtctaaatgatatccatttgtatattgtaggtgtatgcatacatactatattttcttccttatgatctttagttattgattacctttctttgccacagcaacaaaccacttcctccctatccatcgtgaagcccctgcttttgttgagcaagctacagagcaacagattcttgttactggaattaaggtacactaatttctgtctcttctgaaatgattttcttaaaccctgtgtctttttaaatttcctagttggttaggtttcttaattgtcaagaggcgttcctttttgtaccattttgtcttacacaaggattgcacatttatcaggtcgtggatctccttgcaccctatcaaagaggtggtaaaattggtctcttcggtggtgctggggtgggcaaaactgtacttattatggagttgatcaacaatgttgcgaaggctcatggtttgctttctacagagcttgatggtcatatccaaagtcttgtgctgtgcattgccttatctggttgacctgtttattttaggt

SEQ ID NO: 67523 - DNA, 11979 bp, Oryza sativa
ttttgactgttgttatttattcccctttggaacaacatttccacagtagagtttttggctgcaagttacaatgtttaggctatcgtgattatttagatacaagaagagagcagggttttagtatttaagttggaacttggagatcatgtgacaagaactgtggttcatgagatgaactcatctgttatggtcatagaacataaattaaaacctgatgtggcataaaaatcaatttacctgctatttagctatgctaacttgacaatatttgtcaagccctgtatcatcttccttttcctaagtcaatggttacgtggctacaatatagtactccgcaaggcagcagcatattgttgcagtgtaacaagtaatagaaagtagaagtgctaacattactcttgtgaactcgtgtcaaacattaccagtacatctggccattttcttattagtgaagagatatagtttttatgacagccaaaaatgcgtctaaaaagcaatatgttttgttatccttgtttctcatggtgcattatctttgtcctcgggggtcttacaaaatcatcactccaatgtctactctttttttccaccagtcatatgatcatgactcttatcttgtgctgtctgcatttctaccgagtaatgaattttctcaacatgtcacagggtgtattggacgggaagtatgatgaccttcctgagcagtcattctacatggttggaggaatcgatgaggtcattgccaaggcagagaagattgccaaggagtccgcttcataagcgatgcaatttttaacatttggaggtcaacatgttgtgccttttatgtttgttagccaggacatgtacttacatgcaggaggcccggccctgctgatcgatgtttttcccctccacttttttccaaataaggatttgcagtgacctatttgtttggcttactgcccttcaaggaagaattgagttctctttttgtgtgatgtgcggccagtccggcagtccgtgaacttgttacttgctgaaaacactgaaatattggtctcccatacagcacctctgtgaaaactcctcatttatacttccaacatgttttgagagccgatataagccgtgtttcgattcaaaattttttcttcaaaccttctatttttccgtcacatcaaatgtttggacacatgtatggagcattaaatgttgacgaaaaaaataattgcacagtttgcatgtaaatcgcgagacaaattttttaagtctaattacatcatgatttgatgatggattaattatgcttaataaatttgtctcgcagtttacatgcggaatctataatttattttgttatttgtctacatttaatactttaaatgtgttaaaaaaaattttggcacacgaactaaacacagccatagagcatatcattgaggtttctagctgttccgaatcctcttcgagtttcgttttcagcgtaatttgtatggttctattaacctgcaatttcgaaatttcgatgttcattttttatcgcctcgccttgcatattttccatgtcgcctatatagttaacatcttcggtgaaatattgctctttttttaagaagccttcctgaaatattgcacttgtaatacgtagcgataattttcgcataaccagcttatattttgtagcttaacgtgagacagaggttaacgggcctacaaatttcgcgtttaacacctggctagcaaacaatgggccccacctgtcagtacaccgtgtcccgtctcccacgtgtcccattcgcatccgatttggcaatctcctgcgcccagaaggccggaacagctcaatcgcgaccgcccaattcaaaacgtaggcccggagatgcgatcgctgcggggagccggcccaataaaggctccctcgctaacgtctctctgccgctgtccccttctccggatcccttcgaattctgaaatccccaaattcttctccgcctctcctcccctccccctacagtatttcaaaatatttcaaatcacactacactctccgtcgtctcctctcctctcctctcctccccctctcctccgcctctctcgcatctgaggctccgatcgccggcgaccccagccagaatccgccgccccgtctcgccctccccgctcgacgagaccgcgccgagcggcgaagaggtaagcccccaactcgcctgcggttttctcgggcccgaaaccctaggcttagtcgcgatcccggcgggttactgacgcgcgctgcggcggcggcggtagcggcgcggcgggtgtctcgctgaggaggttggatttgatatctgtgactgctctgcaggcctagtgttcttcgcacctcgcgatgagtagcgcggtgaaggaccagcttcaccagatgtcgacgacatgcgattcgcttctactggagctcaatgtatgtcaccgcttgccgattcaaccatttcccggctactcgtgttggttctggcatggcagtggaggatttacggggtttttttcttctctcgttctgtttcaggtgatttgggatgaggtcggtgagcccgacacgacgagggacaggatgctgctggagctcgagcaggagtgcctggaggtctacaggcggaaggtcgaccaggcgaaccggagccgcgcccagctgcggaaggccatcgccgagggcgaggcagagctcgccggcatctgctcagccatgggcgagccgcccgtgcacgttagacaggttagtttctggctccaccaatggctgtaaaagaggtatcgcatggttggatcaaaagatggaagtcgaattcctgtggaactgtgctaattggcgatggaagaaaaggaagatttagtagagaactaaaagctacgatttctgttgtaagatgatagtactactgcttgcattgttgatctgatggaggtaaaccgtgtagaactccatcagcagttaacatttttctaactgattagtagtagcgtatcaatatattaagggaaagtgttggcagagcttacatttctttctcacttctattctcgactttatgcccagttactgctcaatcggttctatactttttactgctgttcccatgcattagcaatttaggatatatgttttgtaaaatttatctgtttccttcagtttgaatatgttcagcatgaataatatatttactgttttaccggcagcatgactaagttactgcctcaagtacgttttatttgttgaatacattctaccttcttgactaatcaattctgcttgactgtagattttagcacttcctcagccattcatgcagtaacatgcatttcatctgaaattttgcagtcaaatcagaagcttcatggcttaagagaggagttgaatgcaattgttccgtatttggaagaaatgaaaaagaaaaaggtcgaacgatggaaccagtttgttcatgtcatagagcagattaagaaaatttcgtctgaaataaggccagccgattttgttccctttaaagttccggttgatcagtctgacctgtcattaagaaagcttgatgagttgacgaaggacctggaatcccttcagaaggagaaggtcatcatcactaataccatctttatccattttcaccagtcatgttgtcatcgtgtctctatctatcaagaatccttttcatttcttgtataaaatctcactatgccatatacatgtttgtttctcacagagcgatcggctaaagcaagtgatagaacatttgaattctttgcattccttatgtgaggtgcttggcatagatttcaagcaaacagtatatgaggtgcaccctagcttggacgaagctgaaggatcaaagaacctgagcaacactacaattgagaggcttgctgctgccgcaaacagactgcgtgaaatgaagatccaaaggatgcaaaaggtcagcattgcctgtaccattgtagaggtatcaatgaacactttcagtctttaacttggttaatctgattctggcagcttcaagattttgcttctagcatgctcgagctatggaatctcatggatactccacttgaagagcagcagatgtttcagaatataacatgcaatattgctgcttcagaacaagagataactgaaccaaacaccctctccacagatttcctgaattatgtaatttatcatcactgagattgcaaaaatttatgttcgtactgtgttatatttttattaagatatgaatgttcatcgactatacttataactgtaggtcgaatctgaggtgttaaggcttgaacaactgaaagcaagtaagatgaaagatcttgttttaaaaaagaaagcagaactagaagagcatagaagacgtgctcatcttgttggcgaggaaggttatgcagaggagtttagcattgaagctattgaagctggtaagatactctcctgccttactgccttttattgtgcctgacaattgtcataccagacagagttcatatacctggtctgtgttctgttcgcaggagctattgatccctcactagtacttgaacaaattgaagctcacattgcaacagtgaaagaggaagcttttagccggaaggatattcttgagaaagttgaaagatggcaaaatgcttgtgaagaggaagcctggctggaagattacaacaaagtatggatgctagctgaagctacgtggtctttgtatatttgtttagcaaataatgtggtactgatatttcctggctttggctttttttaggatgataatcgttacaatgctgggaggggagcacatctaacactaaagagggctgaaaaggctcgtactttggtcaacaagattcctggtaatgttactcaatgatttatgtgtttggaacttccttatcaagtgcatatttaatttacaattttaactcttgccattactacaatctgatatcctgctgatttgtgctgagcaggaatggtagatgttttgagaacaaaaattgctgcatggaaaaatgaacgaggaaaggaggatttcacatatgatggtgtaggttttcttactcttacacattacattgatcgggtctatttttgtttcttgctgaagtgcctttcttgcaattcttacaggttagcctttcgtcaatgcttgatgaatatatgttcgttcgtcaggagaaagagcaagagaagaagagacaaagggtattatgctctcgcctaatattcatgtattgtctaaatcatcttttcaccttctgtgaatacgctctaatacttgaatatacctgcaggatcagaagaagctccaggatcagctcaaagcggagcaggaagctttgtacggatcaaaacccagtccatccaagcccctaagtacaaagaaggcacctaggcactctatgggtggtgcaaaccgaaggctatctcttggtggagccaccatgcaacccccgaagactgatatactgcattcaaagtctgttcgtgctgccaagaaaactgaagaaatcggcactttgtcccctagtaagccctactagctatcatgtgtcgatatatttctttttcctcttattttcacttgaacatatgtctaactcaagcaaacaatatcaggtagtagaggtttggacattgccggattgcctatcaagaagttgtctttcaatgccagtactctacgtgagacggagacacctcgtaaaccttttgctcagatcacaccaggaaacagtgtctcgtcgacgcctgtgcgccctatcaccaataacactgaggatgatgagaacaggactccgaagacatttacagcactgaatcccaagactccgatgactgttacggctccaatgcagatggcaatgactccctctctggccaacaaggtttcagcaactccagtttcccttgtttacgacaagccagaggtaacattgcaggaggacatcgactactcctttgaagaaaggcggctcgccatctatctggccaggcaaatggtttaactgttgatcaatttatgtacgtagttgaaatctgactgcattttcttgtcggtggccattgcgtatgttggtcaacaatagtcggcctttccagtagcactattctgatttactgcaattgttttaatgttttctacaaccagtaaaacagctctatacattagcttgctcactactcagtacagctttctcggcagcacgaaacatttctgttctctttgatgaatacttcttgctgtggatagggatagttactgttacatatactgtatgccctccagaatagaaacctgttagtacgggaggtattataggaaggatcgttttggaattttggtggttagcctgcacagtaagttccatcagtttctggattgtccctcgcaaagaaaaaagttttcttgattctggtaattcgtttgtcccacctgactccttgaaagtcttctggacatgggaagctatcgtatcgtatcgctcgggcgaacatgatgtgtgtgtcactctcgagtgagcaggccaccgaaggctgacttgactgactccagcaaccaacaaacgagccagtcatttttcaccccggatttttgtcccaaaacacttttccaccaccgtcaagcctcaagcaaaaccaaaacgctacgtaacgcccatcaacaccatgaaatcgagcagctagttgtgcctgctactggccccccagtgccctgtaccgcccgttcttttcagccacccgggggacagaagagtttccctctcaattccggctggagccagagccgcacgtacgacacagtacaccacccgccgcgccacgccacgccacaccgcgcgccgagggcgccgtgaacgtcaagacggacgcgagaccgcgcgcgacgacgggtgtgtggccggcgggggcacaaccgcacgacgcacgtacgctcgcccgcacgcataatgccgcccaggcgcgcgcgggcgggcggggcccggcatgtgcgcggccccggtgtcatgcgctagcccccgttgcaacttgcaagcactctcgccctgtctgtctcccccatgcgtgcggcttccgggcggtttcgtcggtgacattatctggtggctgtgtggacttgtgtactagttgtgtgtgaggagctgtattgcattgcatcacttcatcatcatcggtacaggttacggttggatcatgtcacgtttttggtgatgatgagggcctggagggaccggagtgtgggagtcaagtcctgcacccttttccggggtcaagctgcgtgtccccccttaacatcgcacactgatcagctcagctgggcttgtttcgccctggactgtcgctgtcgctgtccgcgtcctaccgtttgggtacaggtcgtacagccttgtactacctggaatttgtaggcgcgacttcgaggtgcagtgaaagcgaaaatggtgacgaatgatgaactgccgtcctggtgatgaactgcgtgctgcttactcaaagttgacgggcgcgggacaagcaagttccgggtcatttatccagcggatcaagtgtgttctataaacgacacatcatccacgtactgaggccacacactgatctattaatgcctatcatatgcgcatcaaatttagacctaaatttccaaaatctcccaaatttcgggttattttggctgctgcactttttaaatttagcaaaaaaagaacttgttcgaaaatagcaaaagttcttcattttttcaatattatttaattgaaatcttgaagtttcagtccaccccgaaatgattgtgcataccaaaaagtaaaccctgctcacgagtcatggaaattcctgcgcttcaaacaaacctacatgttgttccggtgtttcgtgccaaataaatatgtcgccctgccatctcatccgccctactacatccgtgcaccatctttccctttcaggtgtttgggattcaccgaacacacgagacggaagaacgaaccagcaggttccaccacgcgccgtgcggccggtcgagccgatcgaatcgatcgactctctcgtcagttgtcacgtcaccggcggccgcacgcatcgcaccaagcaaagcatatcataggctcatagcaccggacccgagccccccgcgcccgcggcgcgccgtggtcggtcggccccacgcccggccctacgcgcaaatccactgcgtttccacacttccaccaccaccaccaccacgacccgcccgcgaatccaccgagccggcagcccggcaccacgtacgccaccgccatctcacgcaactttcccctcagaaacacatctgacacaacacaaaatcaccaacacacccatcgcgccatcgaacgcccagttcgccgcccgctgcgccttttccctctcacgtcgtcgtactcgtacgcgtttccgccaagcaaagtccacgccacccgcaaccaccactccatcaccaccaccccacctatatatctcgcggcctcgcatcccaccgcgacaaaccagacacacactcgcgcacacacacaaacactggcacgctgatcacccagaacaaacgcaacactctcttcagctaccaagcgtagccggcgagctctacctcgttggcatggggaaccacctggcgtcgtgcacgatggcgagggtgccgggggcggcgaggggggcgaaggtggtgctgccggacggcgcggtgagggcggtgaaggtgccggcgaaggcggcggagctgatgctcgaggcgccgggccacttcctcgcggacgcgcgcgcgctgcgggcggggggaaggatcgcggcgctcggcgccgacgaggacctcgagctcgggggcctgtacgccgcgttccccatgaagcgactgggcgcgcccgccgcgccggcggacatggcgcgcctggcggccgcggtgtccagggatcaggccgccgcgcggaggtcgtccgccacggccaaggtggcggccgtcgtggtggcgccgcagcacgacgccgcgatggccgaggaggaggaagacgccgcgcggccgaggctggacgagatggccgtgggcgacgcggcggccgaggcggagatcagcgagctcaagcagcggatcagcggcggccgccggtcgaggcggccgacgttggagaccatacacgaggagagctacgctccagcagcaagatgctagtgatagtttaattcagtagccaacaagtaacacaactgggatggcaaaaggccatttctcgtaatattttttccttcttttgaacgctatgtaaaatatttctttctttggcgccacctcttttttcatgttttttttgagagaggaaaggggaatatatggaagaaaaagctcggtggaaagatgattaatgaaatgaagatatttgaacatttcacctacttatgcactctgattcaggtctgtttgcaatgaagaaaattgctcagatcattttgatcagtaggaactagtgcatattttctagaaaacgaactacagatccatctgttctataggcttaaatctgtacttatgctgatcttttaagaaagaattccaagaatctcttcttttttccttctagaatattagaatggattattggaattgtatatttctagatccaaagtatctaaatctagcgaaaaactgttgattttatagcataaaccattttctgcaaggttgcaaaagtccaaaaacaattctgtatgtcagatatttgtggatattttctgctccaatcctcacaaaccatatggtcaatatctgaatggcaagttctggtttgtttggtcaaatcgtatctcatgggctccttggcaacttgttgagctaaaaacacattaattccgtctctccaacactggccgtgattctattggcacaccaacacaagtggctactgcttcagttagagaactgaacaaaagtaggttatggagcagtataaatcattgactatcgtgagggtagaatgactcatgaagtagtagcactcacgcatgccgtgctcaagacatatgaaccgattgtctcgtcagatcaagcaaatcataatgcaaatgatgctagtatatgctaagggcttattttgaaatgtaggatttagaaaacggagaaataggtaaagcatgggattctgatagaaatttaagtgtaaaataaataattctaaaacacaacaatatatagaatcatagaaaactttctatgaggtttggacctcatgttaaaaatcctccaaaactctttatgaatttcgtaggattcaatagttttcaatcatttgttccaaagggctatataagaaaaaatcttttatgattggaattctacaaaacttttattcctatattttcattttaaataaagggggcctaaattcacataattttcttttttttcttgaaaaaccaaaccagctggttgattccagagaccgaagaaattaatggctgatcctttcaggaaaagtggagaacagtgttcttggtcgttctctggtctaccatatactcatttccaaccagttatttgaaaaggcgtcgaaattatagaagtctagtgcaaaaaaagaaagaagaaatgtcttgctccatttatttatgtgacgcccatacgttgcttccaagctttatcaaacagcgacagcaaaggcacgtacgacatctacacagcagctaatgaaattattggctctcagcctctcacactgtgtcactgctccactcattgtatttttgttagtgaatagatcaatcaaccaaccatgtaatcaaagtgggttaattacgctgttgttttcgaaacactgttccttcccccaattcttcagaggaaagcaaagctgcagagtgcagacatacacatgagagaggagagcagaaaaagaaaggttgacagattaattgacgaaatgcagtgtagctactactagcaagcaagattaaagctaatataaagatgctttggaataatgccatgacgcaacccacactatatggtggtgctgtgcttgctaggctagctttgacggtgctgatccggaccagcgaagccacaagtccctccactatcttatgcaactgcaagagagagacagagaggaagagagagaaaccgggatatcaaatcatggcctgcgaatgattaagggggtgtttaggaacttagggactaaatttagtccctctcacaaaattataagtccctatggtagggactaatgtttttgtgagagggactaaagtttagctccactttagtccctccaaccaaacaccacataattgcttggagttcacttgcatgcagaacaagttgcaatggaggatggtgagggattttatttctcaggtcagagccatctgctgattagttagcggagatctcatgcatatcaactacaggctctagctagcagcgcagtgtttacaatttcgttttgcacatttctataggcgagaccaaaatttcgggacgaaaaacgtaaataaattttgagtgactttaaacaaattcacacacacaaaatttgttgggcggaaaatggttttcaaaccctggctagcagtgacgaaggaaattttttcttccagttttaccagtttgcggtggatgtactggcttgtccatcaaccaatctggtaggttaatttgctgcgaaagctgctgtttactggttacacaaatatccagtgactttgtaaagatttcggggtgtggcttagaaatattctatgactaactgttacacacgtactaacacgcgcacacacatacatacagaggccgtagaaatgtacttcctccgtttcacaatataagttattctatcatttcctatatacatattgatgttaatgaatctagatagataatatctagattcattaacatcaatatgaatgtgggaaatgctagaatgacttatattgtgaaacggatatagtagaatacttcctccgtttcacaatataagacttta

SEQ ID NO: 67524 - DNA, 2461 bp, Oryza sativa
acggatcgaggaagatagaggagagtggatctggcgttggcaacctcccttcctaatgaatgccaaatccgaagaggtggcatgctccacacgatgttatcctagcggtgagctcggggacgggactgacaagagggtggcgacgagcactgcgttaagatgccatgatgctcggggcagcaacatgcctcctcccgcactgatctagggatctagggctgagcccgttgaagaggactgcctagcctccactgagctccccttgccatcttcctctcttcattgcccaaagcgtctctggctcccctcaccacaccatcgtcatctggtggagctccgcctctccgagcacaccggtgagttcacctccctcttctctccatccagtcgctggtggcctccctagctacgcactatcgtccccaatgtcatagtggccagtcgcaatcgagcggcggcatcaacttcttgagtgagaaaaaggacgaaagggaggagaaggaagagaatgacaggtaggcccaactttgttatgcatatattttttctaagagccttatgtatgggtctcacctatttttaatttttaattattcttgttttcatattgaaatggtgtgtaagcgccacataggcgctttgtcatgtaaaatacaaagtaaaagtgatatgtagatgccaaataggatttttttaagacaaagaggcaacaacccctggattatttatttgagaactggaagtacaactagtgttgcataacagtcccttaagaagggggaattacatagaggtccagatttaagcatagaaggataaagtaaaatacttcctccctcccataatataagccatggtcaaacttggcacagttttcaaaactaatctttaacttataatttctcatatactataatgtttattgcaacaaaactataaccatcttaaagtaaatttaaatatcattccgatgatattaattttagcaaataaaatttaatttatattacactccctccatctacttttgattcatatttaatcttgacacatgtaccaagaacaagtaattctacttatcatttatactaatataagaaggagttcacccctaacaatcttacaggccaaatcatcacacatgatctcatccgtccatctgccatgacatctaatctcatccggtcttgctgcagatgagttcgacgaccctatccactccaccgcccgtactcctatcgcaatgacactctgccttcgccccccgcatgctgcgatgactccgccctcctcccatccccgcgctatacctcgctccgcactgctcgcttcttcccgtcgccgccgcacaccaccacgccctgccccaccagcgccaggtggatctcctttccgcaggagcccccgccagcgccgggtggttcccctttccgccggagccctgactgggattacccgtcctccgccctcctcgcttcttcccgtcgccgtgcacaccaccgcggcctgcccccgccggcgccggggtggttcccctttccgccggagtcttgcctgggtctacccgacggcgccgaggtggtatgccctttcccaggacccgctgcggcacacgccactttggtttgcgactctcctcccctgacgacattttgatccccttcgcatgcctaagcaacccatgtgaaggacaacgcctccagctgcatcgcctccaagccatcgactgcggccggtataatggaggtgataaggagaggttcgcggtgatttcttccctcctttctttcgcccaggtgaaaaagaaaaatcccctttatatatactccattagttttggtttgcttccattactggcgcactgagacatgatcttttgattctctctagcacctacttttggttcgactggatgaggcaattagccaaacaatagcagtggcaggatgcaagccatgacagccatggaggcaagcctatacctccccatctcttctatatcattatatatgtgtatgttagagtgtacattagattagtcctatacctccccgtctcttttatatcattatatatgtgtccgttagagtgtacgttagattcatctacatctcgcacatagggaggaatcatttgatctccatgttggtaattttgtttttatttgattctattgtcaagatggattagggcatggtaggattattgtatataaaatatgtagtaatccatggtcaactctaggtctgcaacttatttttatgcatgacaaacacaggagtttctctgccttttctgatccgatatttgcatctgtttatctttacataaagatattcgaatatctttacataaatttatcgtactttacataaatttacataaattcatcgtactttacataaattcatcgtactttatctttacataaattaatttgccttttatgtaaagtacgata

SEQ ID NO: 67525 - DNA, 638 bp, Oryza sativa
attgctgcagcccactgctcttccagctctgccgacaaccacacctacaagagctacagctgaagcatcacatagggcagaggaggcatcacaggtctggtttggattcagtttgatgttgcactttgtatagctatatgcagtttcaatttcatcttttgtttctaccaccttgcaatgtgagagttggtacgagaagatctcaccaaagttcactgttttttatattgttcaaacatctaattcagcttttgtagtaaatgtacctcacattccgaaaatttatgtaaaattgtaacgacgtcaaatttgtctactcccacttcttcagccattgcaggttgaggcaaaatcttttttgttgatagctaatatggttgctcaatttgtcccaacaagtattttctaattaaagtgccaaaatatattctgtcatttagaactgatgttacttttacatttcaattggtgcctctccccaacctcatcaatttttcggttgtcacatccaaacatgtacattctcttctcatcctaggtttacagatttgtcttgccctcacctctctgcagtccgctcttgacggctctgaaggacaccaaggtcccaagccttaggttctgtaaatgatcctgac

SEQ ID NO: 67526 - DNA, 671 bp, Oryza sativa
atctattcatgaacctgcaaggcaaattgctttaggctgtgtttagatccaggggtgaaaatttttgtcgtgacacatcggatatacggacacacatttgaagtactaaacgtagtctaataataaaacaaatcatagattccgctgtaaactgcgagacaaatttattaagcctaattaatccatcattagcaaatgtttactgtagcaccacattgtcaaatcatggagcaattaggcttaaaagattcatctcgcaatttagacataatctgtgtaattagttttttgtctatatttaatattttatgcatgtgtccaaacattcgatgtgacaggatgaaaaaacttgccaggggatctaaacaggcccttagttgggtagcaaggtaaatatttttttaatataacattgatttacttgctaaccactatttgaaacatcatgtcatctatcaatatcttttactacagttgggtagtatggcaggcagattgtcagtgatggaactaatgaatgcaatcgcaaaaaaagaaaaaaaaaatcacactaacaagggactggacttcaatctgttagtttcttcacccacaaattttgctagcttccctttctcctctacacaagcctgatacagaataaacaaaactttaattagggagaagaagac

SEQ ID NO: 67527 - DNA, 17685 bp, Oryza sativa
ttcctgcagcccccgccgaacgcctcggcgtcgcaccctccaccgtacaccatcgcgcgctcccgcaccagcgccatgcgcatgcacactagtacactaccaacaaatacgatcactgcacccttcgtcgcctcggcaacgtacacgcgctcctccgtcgtcgatcagtcacacgcacacccttctcctcggcggcgcggcgtgtggtggtgcagtctgcagtgtggtgtagtgggcggcacgggtgggtttgtatatatacacgcgcgcggccgcggcagtcgggcacatggggagctcgggctaaacaaacaactcaagcgtggaggcgcgagtgcacgcgggcgcattaaatgctggaggtgggctcgctgatcgcggctgccgacgccgtgttcccggagccattcgccgtgccgctcacacgcacgcgggcgcgcgtcggggtgggaggatgacggcgtgcgctacagctaacgggagcgtggagcgcggcggagcgagcgggggagtcccacgtctcaagattcccgactcgtctccatgtcacgtggcccatgccatgcaagcagctggctgcggctgcggctcgctctcgccgctttgccgggccggccgcaatacgaccggcatattgtgcaagcccgcacgcacgcacgcacgctggggttgcggggtgagatgagaggtactagaccggtggggagatgagatgggatcggtgactgttttttttttctcttttgctgtgcctccgctcaacttactgtattctggccgtcaatcaatcatgcatgtcagtgacactaaacagggtgcgaggtgatcgatcgcgtaatttattgggtcaggttagcctggctggaattttctacataccctaagctattagatgtgtgcatgcttagctacacctgatttattgcaccgtgccaacacacgacctaattttctataaaatgctactacgtgtgtgtaactccaagttgatagcggtacatgtttctttagaatgtttatgggtattttagttattaacgttgttcggctgtcatttacagcacctaagccagttttcttgttctaggatataagtagttgcattggttgcgatactgtcaatagcagcggagcagcctcattaagttacctacgctaactaatttaacacaaaagcttaaagtgttgagaaaaggtttagactagagatctttagctctattatcgaaagtcacatgcatcgatcactgtcttcaagcaatttgtttacactccaacactaagtaactaggaaatgttttcttttacccgatttgtatgtttagtgcgaattctcagttctgtcgtgctgaattgatcatctgacttgggatttaaccgagtataatcaaggagccgtgatcgatctgaactccctacagttggcaccttccgatcgtaatctcagccgtcgattcttaatccgacggccatcgaccctcacatccagcgacgttcgtgcaccgtggagtacagatcgagcagggaatgttattggcatatcttaagcaggatcctgatgacgtcccacacacagcaaggaggagggacaagatgcttcggattccgttaatacctgtcattgctgctcgctaatcaagcgccctggagtgtaattatattctctgctgctgttgccctgcctgtacttagctaagcttgtccctgacatgattaagaaactcgctgctgtccccccagcttgccttagtttttcttttattacatgtacacgagtctgtgattaatgcacttgtgttgtgacgactataattaataaacttgatattagcagtagtaatttctctccacacatccatggttgcttggtcattaatgccgttgattagcatgctgcttgcatcgatcctctgccacagtttcagcgaggaaaaagtatagtagcaagttggtgatcaagtagcgagtcaaggatgtctatctcgtttctacgtgcatgcacgtctacgtgtcgatcggttactacagtggacacatcgatcggtttaattttgatcaagctgatcgatatgattcacgcggattaattcagctagatatatagcccatgcacacgtcggtctccatcatccgattccgtgctgggtttaattcgcattgatgtcgcagaatcaagcaccacatgcccctccttaatttgccatatttacaggcttctcaatcgtgtgcaattcgtgtggttcctatatagcgaccactagatcgatcaaaaaaatccaggaaaagaaattaagtaaaaacctcgtgcatgcgtgatgcattagctagctatctgagtatatctactcttgatatgacgatcatcagtgattctgaatttctgatgatgaacctctgttactctgttagtacttacttggggcttggtgatcagtaattctgatgatgaacctctgttactctgttagcactggcctgcaccctacagggagaggtcaaagtctggagttttgagttgtaaatgatgacttttacggcgatgaagcgtgtgggatggagtagtaataatctggaggtcaacttggcaaaatcccatcgctgatgtgggaggattaggggcaattaatggcgttcgtgttcctcaattgatcccggcatgtggagctcattaaatgacggcgaccaatctggctggccaactaaccctgctcctcctccgattcccccttacctcttcgcgtaatcctaccggttaatcccagcatcaatcaagatcgagcaactgatccgattaggttatctactcttttccatgcgtcttgccatctcggcaactcctctcggattctcgcatcgaatgcttctgcaggcttcagcagcagatggagatcgatcgatcaagccggcgacgaaccgaccaccatctgacagtgagttcgttcgcgctagctagctgggagcacgcgtgcgtcgctgacatttcgcgggattttattcagacccacgcgtgcgcgtgcgcgatggccatccgatccgaaagaggggaaaaaagtatatttttactggctactctactgctacgaagaactcattccttaaaaaaaataatctagaaggatatgtgacccctcctaatataacgagattcgttatatctttttaggacggagggagtaatcatgtttgatgctgtgttgagttgatctgtaattgctgtgctcggtatgagacagttgttatttgttaagggtttcagttgagctaaggaaagacaggaggcaaagtgttaggttagctagtggctatctattcttgtgtgctatgaatgatagaatgatttatgataattattttatagtcaaacgaatgaattaaacagtgtaaagttgaaaattaatttaaaaccgtttatataagaaatttgtatattataaagtttttatatgatttgcaccatttagaggctcggaaaatattatttttattattccatttcattacaggaaaaacaacacacctctacctcaatttttaatatatggtgcattgatttttccttctgaaagtttgatcaacaatgtttattcagttacttagttaagtgaaatgaaaataatacaactagatctattatatatcaaaagcattttaaacatacctatagtatatttgtctatttgcacaaatatttgtcaagtgaattaagcaagtactagtaccttttgcacaataatattcatatactagtacttgcttaataatttctgtcttaattattgtattgttggggaaaagttcgatcgtaacatgccggatatgtgatattgtacttgcgataagatttacaattagtaagttgagagtagagtgggtagttcattacccgaattggcgcctagtgagagtattccaatcacgattatgtacttgtgataagatttataattagtacgttgccatagttggatatctatatatgtatggagtactcctagttcattgccgaaattaataaaagtgtacgtatacatatgcacctattcaaagtatttcaagtactcgacttgtcctctacataccaagctgtctggagtatctccgctgcttcgcctgtacaataattgtcgtttattatgagtatattaactaattatgattacaacgtactcgtacatgcacggcgtacgtgaaacatttacttcaataattatttttactggtgtaacttcctcttttacattgtttggttctgtgactctaatcatatatactccattcaaatccatctctctcggcgtgaataccgtcaaatgtgtactctgctttgaattggatttaagtataatcaggagaaatttaaaattgtaaagtttgattctcatgaataatgttaggcagatttttacttgttttaattagttctcaaattcaaaatcaacttaaaattaggtcaaccacacaggcaaggtaactcaacatagcatggctacaataatgataggccatcgaactaaatatgctattcttcttatgtgcaagacttttatgagttaaaaaaaactaaatattcacacacatgcacacaaaaaaaaatacctttactcatagcatatctataatttcttattttcgataaatatctgataataagaaactcgtatatttggggtcatgtttaagtgttgcatctctgcaaggaagatatcagttaaattaaagagagatttttatatatgttcgaacccttcttagagtaataagtatacatcttgtcagtcgggttatcggttttattaataccaaaagagtatggttacaaggatatatatggacctagtcaaggtttatatgctagtcttgttggggattccaacgagtttttattgatcagtgggtgcaccggctcgatggatcttgaggcttgatctctgactcaacgacatatcgacttgcggtggcatatgattgttgtgtcttggcttgcagagtatagatagttggataccagatacccatatggcctgcatatcgactaagatagaaggtaggccggatccatatgatatgagatggaataacatctgtttgccatattgccttgtatcctaaaatagcgtacagagaatcccaaccgaacaatgctatggatagataaggtaaccgaaggcgtgttcggctaggtttcctaacttgtaacactaccccctaacatatataagacatgcagggatcccctcgagggcaacagagaataagaaacaccaaatcgacacaatatcaatacatcaggcataatacaatccatcaaaataggagtaggatattacctcacatcgagagcctaaagctatataaacccatgtcttctgcatccatccacttttagatcttgtgcgtagcccctaaattagtattgatacaaaacttcggtatgtacattatatatactatatagttagaacccagctaactctaaaccttaacacatatacctgccacatcatcacttactataaattattacctaaagctcatataagcatggcatatcatccaacttataacgttttagaactcaagcatgtcaaatcatcatcttccatatagttttcacaatatttcaaaatatatctgtcgacgtttgagatcacgactacggtatttgcatgatatggagatcgttggtactaaggtatatgtgagattgaggtaaaaaagatagagacaaggatttttatacaggttcgagccccttcataggaaggtaacaaccctactcctgttggccgaagccggtgttgctctttattcgtctgaatcacataagtacaacaattaggacaacctatctagctgccgtcgacatggcggcacggacaccaacacgtagtcgacgacagggtaatcttcctcctcgaatatgaactcatcgagattagagatggcgttagatccctcttgtcggcctccacaggcaccatattgggtttgtctaggctaatctctgatgtcgatgtcaggcttgtcttggcttgtgtgttgtgtgtctcctctcctcataggaggtcttgtatttatacccatagatattctcttgtccaagtagaactagggagacaagtatggatatgatccgagtagtcgttgtcgttttcatatagaactctactcgtcctttcttatctggaactccttatatatatgaggtatgattccgtataagacttggtatatggtgggccctgcagagcttaatcgattgctgttaggtacgtggtatctataaccatgacaatatctcttcatcttttttacaatagttaacatacattcattcatatgtccctaacaaaacatggggtatcatctagttactaacaattattacaccttagaagtcacaaaaaatatcatattatcacgcaccagcaattattacaactaaagagctcatcatgcaagcatgcaccatcatctccatcacatcattttcacgatatttttaacttatacttattcatcatactataatattcaatatatatttattcatgtatttcgcggtaaaacgcgtgacattatttagcatagctatggtatatatatatatatatatatatatatatatatatatatatatatatatatatatatatatatatatatatatatatataatcactagctagctaggccgtactcctgtctgttggccctgactagttggggaaaagaaaatttttaggtgtcacatcggatatttgaccagatatcggaaggggtttttcggacacaataaaaaaactaatttcgtaactcacttgaaaaccacgagacgaattttttgagcctaattaagccgtcattagcacatgtggattactgtggcacttatggctaatcatggactaattcgactcaaaagattcgtctcgcgatttccatacaaactgtgtaattagttttttttatctatatttaatactacaatgtgtgtccaaacattcgatgtgattttttgagaaaaaattttgggaactacaccagaccttagtgtgtcattaatcagttcaaatctgaactaaggtgaaccaatcagatttataagcaaagaactctaatacggaatctaacctatagcgtggtggcttgttattattgttgattttttcacacattaattgcaataatattctctctgttgatcagcttccagtgagatcagaagaacatgagacgacatgcagcgcactcatgcatatgcattcgaacactgatagttatgatagttttagctgccgctaatgtggatcgatcttaataatactaaaccgaaagcttgtaaagtcagctaacttaattagccactggggctgtcttgtttagtcaggttccatttatgatgcctgtagttggtgtaattggtcaaataatattctactgcaagtttaccttttaaatttttctgtgttgcaaaactagccagtgaaatttgcacaatcgtgcataccatgcaaagctgcgtgaatcgtgccgttgtgtatcctgtagatgctacagcctacatgcatatgcttggtcggtacagatcactgtacagtgagcagtaattatgcatcgactcagatatttgtcccagctcgataacttcctgcatatgctagtaatagtttgtgtagatatacgtccaaaaaatagtttgtgtgcgtatatatgcatgctgatatatatagatgattcgcactgaaacatgtacaaattaaactcgatcgtgataatgtttcggtgcctgaccaacgaacgccgctcttgctgttgcgcagattcattgggaaaaaagaagtctgttcatttatttggaagtcgcgaaaatccctgggtaacgtagtcggtcgctaggtcatcacactgaggccagtcacaatccaaaacattagacatagttttcgtaaactttacatcataaaaaaagtagtactagacactactctttcaatacaaacactatatttccatacttaaatttaatgctacttatctcacatgatgtcttggatgttgtttagaaatcatgtctcatgcaagacccggtttaattctctttcctcatttattcacttaccacatcatctttcaatctaggtgtcaccttatttaatgctatggatatcatcctagtcagagcaaggttaatagtatagccaattactagctccaaattatccatagcgcgccaatctaatagctaattcatataatagttatctagaaatatatactacactattaatctggtcacacctatcatacatacattgcgtcttgtagcccgtgctgtatctggctataaatctatagcccgctgctcttctctctcatattttatctccttaaaatatgtttatagttgtcttgtagtctgctatcgtacctgctctcattggattagaaatggcctgatagtgtgagaatatatttaagtcctctttttttcttttccttttctcccctgcctcttactctcctatttgtttagccgttcctgtaaattttgttcctcttaatacaaaagtgaataattcttttacgtataaaaaaaagtcacgatcgaaacaacaatttgtcttttaagagtagtctggctctgggatggaatatgccgtatattaaactgaagcagctatggctgtatttagatcagcgtaaagtttgaattttggttgaaattaaagatggtgtgactgaaaaattatgtgtatatgacagattgatgtaatgaaaaaggactgaaatttagatccaaacacagactgtggaaaattatgttagatatactgcaactcgtaacgaagtcgtaacagactacgtctacgttctgcatgcagacttttgagtctgcttccgtattagagtagactagctgctagctgcctagctctccctgaaatgtgaggacacagctgggcttcgagattttccttttattaatgggtggcagccttgttaggtgatagacagaagaacaagctctctctctctctctcttcttcttcttcttcttcttcttctcgtcgtcgtcgtttgatttgttcatgacaaacagctacttaaagattctactagtatgtgtatatatgtactgtacaacacaaaagtgttaagccttatcttaaagctataggcagtaacttaacagaaataacggacagattgtcgcgtatgtaactacgctagtaggtactgtactagctacttagagcaaatttaatagtatagccaactactaactctaattaatctatagccaatctaatagctcattcatacaatagttacatactacactattaatacctggccccacctgtcatatacacactgcgtcttggagttcgtgctacagctggctataaatttgtagcccgctgctcttctctctccttatttattttcttaaaatatgtttgtagctggcttatagcctgctattgtacctgctcttagcattggatatctccaagtccattcgtgtgcgtgcagaattttattactgcacccgttaggatctatcgatgcacgcatggcttccagcagacagtgcaaaccgacgaccgatcgatcgcacgtgtgatccgcagttgcattcactgcaatagaaagcactcaagcgtgcgaagaggatcgattcatgccgtcgaaactgtgtgggtatagttactgaaggcagactgaatttagtagtgtttgtgtttcagtttcctgtacctgcatatgacagattatactataccgtgaatcgatcccggagtggcataattgatttgggggtttgagacaaaaccattgttaatttttccattaattgtaggagtaaacccggttgccattaatttcctccacgtgcattaagagtttaacaatctatggctcattaaagtgctgagcactgttcactgaaatcttattgggggcccactagcaggattctaaaccaatcagattgatgttattactgtgttgtgaatattctgatgatccagtaactgcattttgtttttccccaaaggttgttctagaagcattgctcgtgcagcgcccagagcccaagacaaattaaaacctgtcgtcccgttattttcgtgatgaggattctatctcagattttattagcatgttttttaaatagctaacgtaaaaaaaaatatatatataaaaagttcctaaaaaatatcagctaaattaatttttaaaatttgacataattaataattaattaatcatactctaataattttctcattcgtatgtccatatttaatctttatcttcatcttttcgaacgggccttctctgcaattcatatactaatactcatgtataggggcatatcatcatgtattgtcatgactgaggttagttgaggtttaagctggctgaggtttctatagcaaatgtcagatgctaatcataagttgattagccatgaaaagcttcacaatgcacttaagaaatcagcagactagtagtgcaagaaaatggcacaagaaaacaaaaggactcattaattattgtagtcggctattagggtagtcccaaccctccacctaggatgatgtatatagcattaagtacattgccatgtaggacttttaacttatgtgtcactatattaattaagagagagagagtgaagagaggaagaaaccgggtctcatgcaagacacagcttcaacacgagaacctatgcactagacactatcaagttttgcattgcgagagaatagtgtcttcataatagatatagaataaatatgattggtagagaagagagatgatgtatttattaatggcccattttaagaaaccatgggttgtggagtatagtttctattgtgatgtcttattgacacggcaccatagacactacttatggacactatgggttgggactgcccttaggcagccattagacaattcaccatttttttcaagactttgcaattcattcatgtctcttccaagacacaaggctagcagtgaccactcagggtgtgttagttccatggacaatgagtgagatagcacatcgttttccgcgcccacgtttcccaaactattaaacggtgtgtttttttaaaaaaatttctatagaaaaattgctttaaaaaatcatattaatccatttttacaatttaaaatagttaatactcaattaatcacatgctaatgactcatctcgttttgcgtatcttcccaatcttttcaatcccctattcctcaaactcaccctcagtgatcaatttggtcagaaaaacaaaagagagctagagaaacattaatgactggtacatcagtaataacatatatactacacattattgcattatgggtttgaggaacaaataaattgattcataagcagattccatctgatgattcagtctgacgaatatacagtatattcatataacctgatcattttgtgagcacttcgaagcgcaagaaaaagatactgcaatttggtgtggatcctgtagactatatagttaagaaacataagttaattgcaagtattcagagtagtaattacacgtacatgcatgcgcgcaacttaacgacatacatattactataagatcaacctaatcaattaggaatcacacagctcaaaggttctggatcatatcataaatcaactggagtaggtaataatgtcctgattgtcttctccagccctactggggacaagttacaattgagaaagaaaaacaattattggctatttggctgtatcccatgcagtagataaccatttcatgaacactttgactgcagggaccaatgaactcctaccagtcaggctatatatcagattatgcagctctctcctggtacactgcacactgttcaagttcattcgtcccctcaaatgtctgctagtaacttagtaagtatattatttccacttacatgcaactaattaaggcgaggttaccattgatatacgcactaagtacgatgtagagctgccccaagcctggtatcaggagacagccggctgctagatgcaatgttctgcagtcacaaaaacaaaagatgcaccctagaaagtaaaatggataactaccttgcgtgcagggtgatgcttggtgaagaaccgcatgaccagtcaagaggatgaacagaaagtttgattaagtatgatcatgggggtgtgtagctgtgttgttttgacttcatgtaattatgctccgtgattggttttaatacctgtaatacagagctttgtgtttggatgtcctcgttgtatgggacataatacgtactaggattccattacatcgattttgaagaagttttatggggtaaacgaaaaaaaatgcgtatctatacgatcctaggagcatgtttcataatatttttgaacgattgagtagcattgtttttcattaaatagaaggggtattgttcatttttagcccctacaacctttctgaaagttcattttacatatctgaactacaaattggttatttttcaacccctacttttaaaatcgtaaaaataacaaccttaaacatgtgtttagtggttttgtttgaaatagttgcgaatcttagaaatttttatgagttttagcaagcctaacaataaattataaagtatacccaattctatacaaatctataaattattttgggctgagcatttgctttgttagtttgctctaagcatgttaattaagcatgtacaatacactactgattttgccaatgacgactaagtaagataattagcaatagtaaggtaattatgattaatttactgaggtatggctgcatgcaagccggcggagcccggacaagtggccaccaggcgccggctccgccgctggtttgaaatggacatactttgagaactaaataaagataaacatcaaacaaaatccaaagcctaagtggctaagtccatgcatgaacaatgctttgaatgcggtggtatatataatctcttcacggtacaggttaactatatacagataactcgtacattaggttgcatgcgttataattaataatttattacctccatattttaatatatgacgccgttaaattttgtccaacgtttgaccattcgtcttattcaaaaaatttatgtaattattatttattttattgtgacttgattcatcatcaaatgttctttaagcatgacataaatattttcatatttgcataaatttttttttgaataaaacgaattgtcaaacgttggtcaaagagtcaacggcgtcgtacattaaagttacagagggagtaattctctacaagtgtaaatatatggactatatgtacaacattaagcagcatgcatttgtactatgtttctaaaagaaagaaaaatactaagcagcctgctgcacatttgcacgtacggttcgaccatcaaacagacaacaccccttctatttctcttgcattgtctccactctctcgacagtgtgagcgtctcttaaggcctaagcatccaaaatctgaagatttcttcgtgcatgggccaccgtcggtaggcctcacctgcctcctgtgccctcgtgggccgtcgccggtgtctcgcgttgcaccggcaggcggcagcgtcgctctcgcccccattgaacgtacgcgtcaaggcctccatggctccgccgaggagtctgacagttttttatttaacttcttttttatcactttcatgtggcctcatgtttacacgtcagcgagtctaatcacgatttgttctgactgctgccacgccagcagatgcaggcatgcagcttcccaaaccactggaaaaatcgattcgcacatgttttcaaagttggagatgggatatacccgaatttagggttgaaggatgcgattcgaacaaaggcaataggtaagggatgcaaaatagacttatattaaaaaaggaaaatatccattttacctctattaactaccgatagaccgagtttgattcacatctcttaattgtaaaatcaattaagatcggatgtataggctcgtttaatgttagaattgaaataatttattttctcatacggtttagatgagagtcttgttctacgtatcattttgatctggtcttttatacgacacgatgcctacggaatacatagtattctaacatctattattttaaaaattaaagatgtttttaccgatattttggtacgtcatccgtgtataagttggtttttaagttcgtttgcttttggaaatacatatccatatttgagtcggcttttaagatcattcacttttggtaatacaaaatgaatcatataataaatccgtttaaaaaaaacttgcatgctaacttagagtctgatagtcccctaactgcaactcatgattttctaaaaatatatatccaagcgaactcccacagtgaatttcatcttaactaaaccatataacaataataagattaaaataaactttatccgttgcaacgtacgggtattttttccagcagttgaaaatttttaaaaagaagacaagacccacaaacgtgaaggtcccttggaaaaaaagtaaaataccaatggctccacgtgtcatcctctcccattatttctctcctctctttctctctctctccacgaaccccaaggtacaagcttttactgtgcaagtcttttttccccaggtacgtacaaactttgagaccttatagtaggagatcgaggtattatatagttggagaccgaagctgactgcaacccccttcaacgtacaggccaccatgcacatatgcgtaggtgcaatccgtgaccactgaaaacccacggatcgatcgatcgatcagccaacctacgtacgtacgtacgtacgcgttccgcccgttagtgctcatcgccggcccggccgcgcgccgtccgtacgtcgtcgcatcatatcacacgtactgacgtacccatgccgccgccgtgttgcaagtcgtgcggtcgcgccggcggcgtcatcggcgtcgagatatcgagcttcccgggcacgccgccactgcagcgtcgtcgtcggctccgccgccaccgtcacctttggacgactaccatgcgcgattgaagacgaggttttccgctaggacattgctcttcatcttccgggtacgtacgcgttcgtaactcgtagtaagtgtgtatatatactaatatcagacagatcgatgctagctgcatgcacgcagagttcgttaaattcgtctgacgccatatagtacatgacgcgcttgattaattactttctcacggatcaaagcttaataacttgatcgatctatgcctcttaactttctgaatcttcgtaacgaaattctgcctagctcggtttgattttctatgcgtttccaagaaaaaatacacgcgatagcggagccaaattttctaatcctagggcttaaataaaactcagttaataggatattggctttctaaaaagaaattgtatgatggtttaaaaatatttacatataattaattgattatgaaggcaaacctaggtcggcttgccctaggcttgcctccacccttgaaaacacacgtacatgtaagtaaatgtaacatgtacaaacgatgctacaagtagttaactctggactaattctattatacaaattagggcatttaatttgttcagcaaattccttatatgtggacagtcagacacttcctaaagcaaaattcactttcgatcatagttttttattaccagtgtttcactttgtattatattttaagcaatgtttttacttaatcaagtaattttacctttatttcgccttgaaccatcctaactcccttctcaagcatataaacgatttcgagtacactagcttttactcgttaattaagtcccactgttatactaaaactatcgttttgacatatgataagttgatggaaatttataaaatagtcaagggtggtgtactgttgtaaagtgtcacaaaggtaaatccactctgttcaaagtgaaaatatttgttaaaagaggatttaaaccgaaacaatggcaataaaatgtgacgaaaattgaaatttactcagttttttataagtgagacacttgctaactgattttttttattttgctggttgaattgatgcagggtctgatgctcttgctgtggctgtatttgttcgattgcatgagaacatacgtgaccgactacgttggcgacggagactcgtggtttactaagtttgttttgtttgttgtagccgtgcccatggctgacctttttagcatcttcgcgtggctatgccttcggctccctttgcccggatgcagcccacttgaacgtccaagagatttttaagtggtaaattttgaggtcaattataagtaggagttatttacgcaattgtacacgctatgcaccaacctcactttcatgtctatagagtaattaatataagatgtagaagttacatttttgtcttttctttatgggtccatattttcttttctcgaagcgatcgacatgttcatctacttcgatacatcgatgctatatgcgaacttgctaggcccctctgaataaaaaaaattatggaggaatttcataatgtagaaattctataggcaattttcctatgtagatctttgattcaaagaattggagttttccaaattctataaaatttctatgaaatagctcgttgcacgtagattttgaagaaaacttagtaaaaggtttaacctcttgaaaaattcctttgagtctatctctcttatcagattcctgtgtttttcctgcagtctaatcaaatgaccagccatttttgtgtttttaataattatctactttatatttgtatttatgttagaattctatattttttctattcctcgtattttccttcctactattgaaagggaccctaaattttatttggccagcaggcattattaattctgcgtttctgaacaatctataaatcaaaacttgtatatagttacaattaaactcaagaaataaatacggccgaggagaaggagaacacttaaatattataggttacaataaacttaattatattgtaccctcgatactaagagcatgacgaaagcgatcactaatagagctcctcaaataccataagatgagatcgtttgctcattgtcagggagtcaacctgggatgctcatcctcgccacttacattatcatgaacgttccatactatcaccagcgagaaaatttgtcattatattatattatgctaccgttggaaacggttttctctagaatttcatctcgcgtgtagaaattaaatgccacccttgaacggtggcaccgccgcgaccttcttcaacaggagcctcatgtcatttggtcgagaagttcagatctatttatactaccacatcaacgccaccgttgagagggcgccgtcgccgtcgaggccgttagggggagggacggctgtcaccgccgtctccgccgcaccccgccgtcactgcgccgtgccggcgagacaggaaggagagcgggagagggaacgcggacgccgccgtcgtcgccgttgacgctgccacacccgccgtcgccgcaccatgccggcgagaagggagggagaagggaaggaaagtggcgccggtggtgggagagacggcaccggtggcgggggagg

SEQ ID NO: 67528 - DNA, 26602 bp, Oryza sativa
aaacgccagccgggaggcggagctgaaagaaaagctcgacgccgcccagggagtccttgactccgccgctgcccgagagcggcgggtaacagagactgaggcggcgtcccggcggcgcgaggagtcccttgaggcccgtgctatggcgctggaagaacacgccggcgccgtggagaaaggcttgacgggccgcgaggccgccgctactctccgggaggcgacgctggcggcgcacgaggccgcctgcgccgaggaggagtgcgcgctccgcctccgcgaggacgcactcgctgagcgggagcgagctctcgaggaggctgaggctacgaccaaacggctggcggacaacctgtcccttcgcgaggcggcgccggaggagcaggcgcgccgcaatcttgaatgcgtccgcgccgagagagccgcactggagcagcgggctgctgacctcgaggcgcgggaaaaggagctggacgcgagggcgcatatcggtggggcggccgcgggcgaaagcgacttagccgcccgcctcgcagctgccgaacacaccgtcgccgatatgcagcgagcgccattctccaccggggaggccgaggcccttcgcttggcgggcgagattgggcccgacatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttccctcccgggaccgaggacgacgcgcgcgcgcgggtcggggatgctgccgaccacatcgtcaacggcttcgagggctcggcccctcggctcgcgttcgcccccagctccgacgaggagggcgacgccagcggcgaggacgacggtggcgacgaggccggcgacccgggcgcattgggatgagcccccaggcccccgccaatctccaattttttctttttctttcttctttttgtatagatcaacttaatctgcaaaaatgatgaaaaatttctatgttaactttattttgctatgcatatgagttgaggatgatttgtgccgtggtccttttgcattttaacttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgatttttgctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaagctgtgcatgtgtggtagcccccggctaaccctgcacacccgaggggggtgcggggttagcccgagcccgaaacctgacacccgacccccccccccccttcaggggtagaagcgacgaaggtgttcgatgttccacgggtttggcagctcagtgccgtcgcccgtggccagccgtacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcgaagggtcgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggtttgcccagagcaccgctgacaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccatttagtgaacttgtcgatcgcaacatacagatactcaaacccgcccggggcccgtttgaatggtcccaggatatcaagcccccagacagcaaatggccatgacaatggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtacgtgaggcggaatgggctccgcactcgccctcatggatgtcagcaagaagctcaacgccttgtccctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgtggcctggactccgacgggcctcgggggccggtcaggcgcatccgtctcccctaaggggtcgggtcgcgccgacggctgggtaagcctttcttcaaaggcgcccggtggggtctgggctcgcgaagacgcgagccgtgagagttcgtcggcaaccatattatcccgtctgggcacatgccgaagctctatcccgtcaaaatggcgctccatacgccgtacttggcgcacgtaggcgtccatctgcgggtcagagcaccgatactccttacagacttggttaacaaccagctgagagtcgcctaacaccaggaggcggcggatccccagcccggccgccattctgagtccggcaaggagtccctcgtactctgccatattattagtcgctcgaaagtcgagacggaccaagtatctgaggacgtctccgtttggagaggtcaacgtgacccccgcaccggcgccctggagagacagagaaccgtcgaactgcatcacccagtgggtggtgcgaggcagctgagaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaaatagacaggccgctgcacctttcggcggggccgatccccttcgctaggggccgtatccccggggcgttcttcgtccaagtggcctcttggggggcacttgtcttctgtgccgatgacctcggggtcggaggatgaaaggggcggccttccctcagtggcctcggggccgtcctgagggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcagaaggcgttaagtgcggccttcccgcagtggcctcggggccctcctgagggtcgggggcacctagcaccgtctgacaagcgggcagagggccggctccggtcgtcaggggccgtaggccaccgtccgactcgggggcctctcctccccgctcgctcccgggccaagttagcacagaatgggggtgcacaaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtaagggcatgttcagcttcctccgtccaagtaaacggccccgagcgcttgaggagcttaaacaagggtagcgccttctctcccagccttgatatgaaacgacttagggcggccacgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggaactgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcagaggggccaagcctctcgtcaccaccctcgggcttggacgcagcagcgaggcggtcggcgcgctgctccatgcaagcgagcgcgactttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgataatcggctgggacggtcggagcaccatccccggggccttgatggcatcaaaagccgcgggggaaaggatgttgagggccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcgtgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcgcggggagtacgccggttattacgccggcgctcgatgtcgatgcgggcatccggctctccatgctgatcctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcaccagcagcctgaagcgcaccctgaggcgtgctgccgtcgccgtagacgaggaggcgacgctccccatctcgccgttctcctgcatcacctgcgactggtgatgccacggacttgtcgaccctctcaagcgcctccccctgcttagggctttggcgcggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaagcacacactgagccccctacctggcgcgccagatgacggagctcgtggcccctcaccgggagaccgcgcaggcccccctttgccagttcggccgggggcttagggtgagatctcaagctctctctgtatctctctgtatgtggaaagatcacccgcccgcaagacacacgagacacggacgatgtatacaggttcgggccgctgcgaagcgtaataccctactcctgtgtttttgtggatttgtgtatggacaagttacaaaggattaacttcctttcccctcagccttctcccagggaaaagtcccccctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccgaataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacaagccgctatgtaggattcctacaaacgctcctaaaccgccacatggcgctctaataaattttgagaaaaaagaaaaatatctaaccgtttatttttatttaaaacggtggacccgataatactaaccattagattaaatccaccgaccataatttgttacgataaaaattattagatctatttttaagtggaactttaatttatatatgaatgatcttggtgacataaataaacaattacttttttagccgatctacacatttaatttaagacacgcttaagcgaagccatccatgataaatcatttgtgataggtctcatcacggatcaaaacatagcatgtttgaaatatgtctgtagggataatccatcatagaagtaagatcatctatgacaggcgtagttttgacgaattatgcatatgaactaactgatgataagtctccgctttccacttcctctctcagttttatagcaaatgagataaaaaaaataattagatggctaaatatttttttaacatatttgatttttagtttgatccatattgaccatgttttggtatgtaagattatacactaaaagtctatgaaaattcctacaaatgcttctcagctgccatgtgtaccctataaatgctcctaagccgccgcttggcactttgttagattaaagaaattcttaaaaattctaagaaaaaaacaaaacatctaaccattgattttcatttaatccgatggacccaataattttaaccattatatcaatctctaaaagacaagtgcgtgggccgcggttgaagaacgagacatggggcctcttctgctctgcgcaccacatgggcagctgtcggatgggagccacggcgggcgacggcgccgtcgatgtccgctgcgagagctaggaggcggggtggctgtacgtgtgcaacagctggctgtacgtgtgcaacagctgcgtgctgcccaccacggtgggcgtaaaccccatgatcaccatacagtcagtgcgtgtattgcgtcgccaatagcatcgctgactccctgtccggtaaaacgaatttctgtttggatcattagtccctggtggaagattgagaaggaaaatacctcactttaataattcaaacaagaagggaaataccatccctttaattaagaagggaaatacttcactttaatttaaattcattttgttagacctgttttcgaaacgtgcccgcgtgaatgagcgggctaccttcctagttgaagttaaaacactcataagttgaaaaataaaatctgtttccaaaacgtgcaattgtttactctaattatcactagtttataaagtcacgcgttcgcgcgactataattttcctatttatttagatgtgtgtatatgttatttaattagtttaaataagtatttatgaaacatgctttgcaataattgtagctataacataatagatttatcttgattcttttgttaatagtattattataaaaataaataacttaccagatttttatgaacgtatcatttgcagtaagtagacttgtaatctgaaatgccaattcttctttcggctttcagtggtgagtgtaaaggctagggttaatttctattcatctccaccattgtttgtaattacattttattgtaggactgcaaaaaggtaattacatctatcgtcacctctcctaccctccacacttccgcagttctccttttcattttcgttgctgtagcttttttttctctcccactaatcctctgtttgattgccttcctctttttacatattcatataatttagaatgtaggttgtccttctgctcattcatctgcacactatacacatttgagaagaaaccacgtggtaccgcgaacgatcgctaatttataatcgcactatccatcaactgcttaatagttgcggcaatttcggtagcagcccaagtcgttattgttgattagcacaagaagtgtccaaattattttccagtctgcctttttagctaatctgttccggacacggctcgccatacaaattggacacaagatcgcttaaattactactcgtttttttcccagttgagatttacaatttttcgtcgaccgaagagctcgatcgatcggtcgatcgaccacagatcatggattcccgtaacctatctcgtcgcaagcagagagctcgcctggaacataagacggccgacggcgacgagcgagagaggagcgaggaagggcgccgccagatcgccgtgcggttagccgcggtggtctccgggtccctgatgctcgccgccgccgtgctgctggagatgcacatgttgatgggtggtctccgggagctcgacgccatgagcttctcgggcttcgtcatgcagcacgtcgtcgtcgtgctcgccgccgccggcctcctcctcgtggcgttggctggctgcccgccgtgggacgacgagcggcggcgctgacggcgcatctatagctctctgatggcgatagcttcgaaaaaaaaaggttaattggatcatgctattataaattcttcagttttaaaatataccatttcaactatttaaaggtatgccattataatttttcgggtattgaaaatataccattacataccctttggatgtgtttaataaaaattttggaccaaattgtcctcgtcttcttcctttgcctcctcccatttctctctgttgttcatcttcttccttccattgcttgctgctagaagacgtaccgttggttggttgcttgcttgctaccgggcagaagctagtggaatgtattttggatgtttgactaactcgattcggctcagaaaaaaaaagattttcagattgagattaggagtacacagtaacgatcgctttgttttgatcatgcacagggcgcgctcgtcgacgagcacgtaatcggtggaccacgccatgctggccgagaaaggagatggggaggaagaatactagttgccagatccaaaagggaaagaaatacatactgtgtgtccaccctcatcttctcccttcgtcttctcccttcgtcttcatcttctcccttcgtcttcctttcccttctcccctctccctccctagatgcagctgcctgcaacacacagtatgttggtgttgcccacattcgcgaagagcctggctgaaccgctgccccagccatgtgcgtaaccacgacgcgcgcggtcgaccattctcagctgcccgaggaagttgacgtacgtccatagcatgccacgtggcagacctcgtgcggccaatgccagcaccattactcttgacttaagatcaactggacaaaaggtcacaatttagacctccattacgagtttcaaagttagacgacctgtatcattttctccaaatgcttcacactttagtttcactgcaatagaataggtcgctttgcagtgacatggaattgatcaggaagataaagaagaggatgtattggtaccttactgcttgaaatcgtcccaactatcactgaatgtcaacaatgcatcaacaaaagccatccctgcaattgccttcgcttgttggcaatgttctttggaattggaggtctttagaattggaggtcccgcgtaggcaatgcgatagtgaaaaccggcttcctctccgccagcgtcgagctccctcttcagcccttcctcatcggtgggccaccgccgttgcctattggagccgctcctccacttggcagtggtgttgtttgagtggctgtcacatgggccatacatattttgttttcatttatcttttcatttgattgatatatggatcctatattttctgtttcatttcttaattttctaatttttgcttctagtgacaagtcaacgtcatgtgggacaaggaccaagtcaatccagccacgtaggcgtcacgttagccgaaaattatcttgagacctcgtttgcattgattttgggagttgagggcacgttatatccgatattaccgtccaaggatattatttaaacttgatgttaaaagataagtgacctaaagtgaacttgttcctcaaccttttcatccctttagtctgatactgaagcacctatccatgtgcacccaggcttcaattgagcccatcagcccttccccggttttcgtttgcagctcaaatgctcgtactattgtagattttatttgaaactgttctattaaaacccatatcaacgcacatgatattattcagtttcagtaaatgatgaattgtggtaagtcttgcatttgtaagatgatttgtacttagaaccgccacaaccgtacgcattcgaaaagttattttcgtaacagtacgtgttagaaattatcgtcgatattaaaactagacaggttcctacgaagttcaatagtgtacgaacatacggggaaacgatatttttttttgtgctttttgcaaatgcgtgaagccgtgaatggatattcgatatataactcggaggcaaaactcgtacgttgcccaaagccccaaactcacaaatccatacagtataattctttcagaagacgaaaacgtagagatgtcttgctagctagctaaaatttacaattgatattaacagattatcaaagcgtacatatataaacaattgcaaagaggctattaagcgagccattcatcatgcatgcctagaaacaccaacacgtagacgtagttcatgagatcaacaacttggaggagattgtgcaacgggcggctgcggcggcggcggcgcggcgaggcgggcggtgccggcgatgaggatgtagaggggaccgggcgggtaggtggcgccgaagaggcggaacccctgctgcttgaaggcccagacatggacgacgtccttctccttgatgccgcaccgggcgatgaagtcgaggtagccttcccccttgatgatggcggcgccgctgctgtcccaccgcgtcagcagcagccgcttcatgccgccgcgcaggtgcaccagcgtcaccggcagcccgccgtgcgacctccccttcttcttcttcttcttcctcccgcccggccccgccgtctcctcctcctcctgctgctgctgctgctccgcgacggcgacggcggtgtcgctctccggttgcggcggagttgttactgcagcttcctcctcctcctcctcctgctgctgctccacgacgacggcggtgttgttctcctccggttgcggcggagttaatcctgcagcttgagcttcatcctcctccttgcgcaggaagctggcagcgatggcctcgcggcgggtgagcatggggatgaggctgcggccgacgccgccgcacgcgaggcggaaccgattctggtgcgagtcgaggtcggtgcgggtcaccgttttctcctcgatgaacaccagcggcaggtcgtacgggagccccagccggtagaacactatcttccgtatccacgacggctcgttcggcacttcccccgccgccagcgacgacgacgacgccggcgccacggcggcgagcgggaccgcatcgatgggcgcagacgcgaaagccgccgccacgtacggcaccagagcgccggccgccgcccgcttcttcccccgtagacgatcttcctcccccgccccgccggcgacgagaagccgcttgcggccaacgacgcggtggctgttgccgttgccgttgccccccgccggcgccatcgtaggctgtgcacccccttgctttttgccggagcacatggccgccggtgaggtcgtcgtcgatcggagatggatcgatcgacttgagctgtgtcgcgaattcgaccgagatctctctagcaatggagacgcggggttgtggatggctctcatcccgcaatgcgcagcgctggatttatagcggcggggaatgctcgtcgactcctactcggactccttcccctacgcctatctgatctgatgcattcgtcgtgttcgtcacggaatgggaaatgcagttcgtgtaaaccgacttggaaaccgatggcccactagatcgcatgggtgatttgggcttaggcccactcgctggtattgctcatcgagtccgagtcggactccaaattgtctaatgggctaccggcccaaaagtacgcgtccactttagtatgggcctcgtgtccacagaagcaacaccacaccaccacgcacgcctccgccgccgctccatggacgccggcgacacatccgccgccgccgctgtagcccctaccccggcgcggctgcgggaagcgctcgccgccctctccaaggtaatcgcgcaagctgagccctaggatctccttctgccgtgtaccctagctaaaccctaggatctccttctgctccaggcgttcgagtccggggattgctccgatggatccgccgcggcggccgtctccgacctcctcaacgccgccgccgatgcagctgatgcggaggccgacgccgaagacgaggcggcggccggggtcgtcgaggagatgctccgggaggtgcacgcgttcctctcgtccccgtcctcgaatcaggttcgatatcctgtgcttgcgtgtgattggtctctccgcgtggtgtttcatgttgcgattcgcggggtgggacgggagtaattttggtgatctcctgacattgttgccgtctcgtaatagttggccatagatgctctctcactagagctggtaaaacctgtggcgaagctgggggcactgatgaggaattgctgggacattgccaacgctatcattgaattcttcgtgtcaaactgcaacccgagggacatgctctccatcctatgtgaggtcagtcacgcgtgcgtttattcttgataaatcctggcatttggctttacagttgcgtcttgcaatgttgatgaaattcagaatatagacccatacagaggtaacctgtgtctcctttaactctgaaagatcctgtgattggaaagagttctggtttttattttattgagggatgaaggaaaaagtccatttacaagactgaactatcatcaaaatctgaaattcaactcggaactttgaaatgtgacactattctttaccctttcaaatagatctggataagttttatagttttttaaatatgaactgatgttccattgtttatttgttgcatccagtccaaacttgcacaatgccagggcactggaatgtccattcataattgagcatattttcattttgcattcaatatttccagacgacaatatatctctacctccttccctcgcttctgctctctgggttcctatggtatattgctcacctttttgtcatgacattatgttgctttaatacaggcagtagatgcaccattggcatcaaatggctcagtgtactttgttcttctattcaaggagctagccaaaggtatatgtttttatatgaagatttccacagccatctctctgctcatcgtttggaaattttggtttctaatggatgaatttccagataggaattgagatacttaatgctctatgcctatatatatataagtttagatatattcgcttgacatatgttacacaccttgtgtgaatattaactggttaacatttgtattattaaatatgttttttttctattcttcctagctaattgtgctttgggctagtgcttgttttgattcagaggaggcatactgagcaagtaaaagtcacacttcctgctgtccttcgagttatgaatgctgttataccagaatgtgacgaggaacatggaaagatcatcgttgatatgtacaatgcagcacttagaattggcaatgccattcaagaaatgtgcaaaaaaatggtttgttgagttaaaatgccattcaagttgaccctgtgtcctaaacaatatgcggtcgccttttcatttgtcttttctgattaattttgcattattgtttccatcaccaaaaggtaaaccagacgaatgaagaactctgttctgtacttagtctatactcccttcagaacatagtaagtacaaaactgtgttatttatatatgttattttcaattagatttagaaagatttattttcttaatatgttattaattattatacactcctatcttgcaggctcttgtatcaagatgcaaacaacagcatattctctctgcttgtggttcagttgttcttcagcattcaaaaattctgacattttgtgggttcacttatttgggtcttttgactggtaatgatgtcacctcagccaccgataagatttcaaaaggtgtttaacttttccaaattatttttcacttggaaatattgtattctgtttgcttgattgtcaactgatgcatttgtttgcaaagtgatgtagatgaagatgcggatttgctcgagtgcttttcttttgcaatgaatggtgcaaatcttgcaggtttgatgatcattttgactacactttcattggacaatgcatgttgtttagataccacttggtcacatgcttgagctttttgcagttatctggacctatatggatgatgaaatctcaaaatatgctggcgctgagctggaatcagcgctgaaagatgttaagggcaaccatacgaggatgtggcaagcaattaacattcttagatatgtgttgtcttcaactcattacccatgggtaataaaatcccacagtttggacttactgctgactatagctaatgaaagtcgtattgaggaaatcaatgatcatgtagatgtttcatcttctggtcctcaaatttttgcaacactcaaggtaatgttacgctttacttatatatttaaaaatatgtcccaatctactatatcaacaatttaagaacattcacaggccattgaaagtgtcatgatttccgccccagatgcattaatgcggaagaaagcttttgctactttgaaacaggcaagtatcatatatactgttgggttttttctttctctttgttttaacaattgtcatgaatatatttttgacttgtgtttgtatatgtctgtaagataatatgggcaggatggtaacatgttccttcttcagtctgtactgtggcatttcttctttttcattttgaatgtcacttctttataacgctgaaattttatcaggttatttcaatggtgccatcctctcagagattcaacatcttacaggctcttataaagaacagcatcttcccttcattggtaagaactaagaacacaatctctgcatgcagtttaaatggtattctctctatcccaaaatatagcaaccaagtactagattagatgtctcgtagcactagtggtgtctaatcttgtactaggttgctatattttgggacggatggagcaagtaagagcatcctgttgatgcccaatatacatatagggaaagaaaggaccatacaatggatctcagattttcagttaccgccacctaacattttctggtgtatgatgtgcttggattgatagaaacatgcagttttatgatttttaacttcatttttcaactccatcctttaaatcgtgaattatgttttttcttctagactgcacttctcctagatctggtgaaggatgaagtttcgagagagattcgtcgagctgatcaggatattgttgaatcggatcaattacaagatggtggcgaatggccaccaccttggttttctcatgcacttgagttggtggagctgatcttgaagcctccagaaggtggccctccttgtcttcctgatcatggtgaacaggtaccctctttttatgtcactactcatgaggagcataaatatctgttggaagaactcaggcaacagcaacatagatggaatagcattagttgatacaagatgcctgtttccgtattaaaataaaaggaggatgactgttgggcaggaatagatctagataagacagacatgaacttggagacttgtctaaatccacagaaggacgtcaaggactaggagagttctgttcatctttaccttattaaatctcagtgaaccagctgtgtcatcttaggctcttgagaaattagcgaatgattataacaaatggcttcaatacttataaagatactcttaacaactgaataaaatatagaataattaaagtctcaactccaatccaaaacattgaatatcgatctatcatttttcctttttcttttcgacttaatttgtcagactctcgtaatctcatttttgtaacttttaacattgaatgaatttatactagtaaattgagatgagaaatgcatgtaaattttgtgggaatatttcatgttaaatttgatgtataaatcaaagctggattgcgtgaatatctggattcaccttatatgttgcccacttgtgttgtgcttcgttattcttatgtgtcctgctaaagtggtaattttgttttacatcattttatggcttatgcctagaaaataatctgccatggttcacttttttttatttgtatgcaggtattatcagctttgaatttgctgcgatttgttctgataatagattcaagaggtaatctacaaaaaacctgtgcttaaaattatatgtacttaactgaactgtaacaataattgcatggatttgctattgcaaaactaatgctacatgatcacaccatctataagactataatctgcaagtttctctgtggctctcgaagcttaatgttttcataaattaaatatttgattaaacataattttggttatcaacgtgctggtgcatggttctaatgttcatttatctaaccaatagttgtctaaaacactttcttctttttcattcttccaaatgtcctttaataaagagctgtaacattgaaactctgttaatgtgaacctatatagtgtactaatcccaagtaatgtgttgaaaaaattgcatatgtcctttttagtttccaagcttgtaaacccatagaatcaaagatggctcgagacataaaaagaagtggttgcatcttatttgaacaaaagatgcatggtgttcgacttcatgaatggattaaggctcatgtgatttagtcctgggattaatgtgaatcgtcagtttgatatatttttcccattttgtccaggatcaagatcaagaaaaatgtttggggaagagactatgaggaaggtgtactcagagtggctgatgccattaagaccaattgttgcaggaattcaatcagaaagtgaagaggatggtagcgacgttgcaaatcatatcatgtgctcgttaaatcctgttcaattagtattgtaccgctgcattgagctggcagaggaaaagatgaaaggtttctaacgttttcagttcactggtttttgtacaatatactgctgtctcgaggcaaaacatgaacaagttgtgaatattatcccaatgatttgaagttgcgtttttttatgttgtacagtgatactgtcgtccttcataattcattttgctggatggtctcgttcgctttttgcaaagctgcaccggccgagccgtgcccgcgcgccacgcatggccgccacacggctccggccgatccgtgcccgcacgccgtccacgcgccgcatggccgccgccgccgcgcatggccgccgaccgggcgcgccattgacggggagaagaaaaggagagggaaaagaaggaaagaggaagaagaaagaaggaaagaaattagcggctttgcaaaagagccgctggattttttggaaatcacgcgcataactcccagcatggaaactttttgcgcataggaccctagcatttcggaaactcccatttctaaccatcgactgcatggaaacttagaaataggcccttaaactttgcagatttcgcttatatttcattttggagcatattatgtcttagtgcaaattttgaatttaaatttattaaggcattatttactgttaatgaatattttgaatttttcgttttcagtatttatatgaatatatgcaactttttcaccctttttctatgtatgtatttgtacgcatttttaatatgaactctagtatttctttattgaatatttcacatttcttattcgcattgcctatgaataaaaatattggaaaaaccatgaaatatttgcattcatatttgcgactatgttactagaagtaacttatgaatattttgtcactttttgccacagaatgttaggaatcacgaataaggagttcgccaaactggcccagcatggccagaactacctgacttgagcatccaatgtctagatcgtccttggggccaagaagctccgccagacgattgggatgggcaccccgcaggaccgtgcgcctacccctgatgagaatgatcaggcgctgcacttcctgcggcaccacctctgcaccacgctcaagaatgagtacatgggatttaggagcccactcactctttgggccgcactcaagaagtggttcaagaagttgaagtacaccatcctaccccaagcagagcaggactaggttcgtcgacttcaaaagtgtctccgagtacaattccgcgatgcaccggatctgtaccaacctctccctctatggtaaggttatcacggacgcggaaaagatcgaaaagatgctctccaccttccaccctagcgtcgcttagagcacttgtaactacaggcaagtgtcatacaaggagtatgacgagatgatcgacatcatacaggtgctcgagtctcatgatgaggttcttcgcaagaactttgtctcccagacgcctagcaagagtgttggccttgaagttaatgcttaattagtgttgactcgacacacgtgcatatcccacaaccataagggctccctccgaaaaaaatggaaatttttagcagaggtacaagtgtagcctaaattccttgacaataagaaggattatttccagtcattcaggggaagagaaataacccttaaatgatactccctccgtcccaatatatagcaacctaggaccggatttgacatatcctaggactatcaaatccggtcctcggttgctatatattgggacggagggagtaaatgttaggaaaaatggtcaaacaaaggatgcacattttaccaagcaccagcgaatgcaaagtatgaaaagcacacatgagaattagataactgcctatcacttttgtgattcggagagcatgaccaagttgcattactcgaatataatacactggaggagggtgaaataccgaagaatgcaaaggtatacctcatcttgtctagaggcctcgaaaaaaaataggacaagaactctggctccttaaatctctaaagtaactggagacgtttggtgaaaacgggacgaaaatgaactctcaagctcatagtcactaaaagtaaccccagaatttgagggggagccagttcagagctggcaaatagtatgaaacctcaaaacatgcataccacatcttcccatcaaggaagaaacccagcagtcggagtgcacaccaacactggtaaaatgaaatagtcatgcccatatcaaagaatagaagcataaaaaaattgcatatccccatatatccatggatactcgcataagtgtcacatacaagtatacaaaccaataagaattggtaatgagacatgctatggacaatattctcttcatatagcaaatcagtggcagtcaacccagagttgaaaatcaactaaaagatcaaccggcaacgctgacctatagttgacaatgaatggctaaagaaattttggattgggcactgcatacaagcattaaaagtcccaaactaagttgataatccgaatatcatcacataaagaaagaaagctcattctttccgaacgagtttgagataaataggtagaaacctatgttgctttggcccgtaagcctacaacacatgaagaagcgaaccatagtatatcagaatgtgaaaatacataggttccttggatatagttcaccatttttagcaagtaacacggttcgagctttgtccaaaccccaaaatcattatcaaaaagataatgatatgtgcatcgcaccaacactaatagactatacaaacactataagttatgggaaaatcatgcaatatttaaccattagagcatcactcgaactatcttttgaaaagatacgagcaacgagttttgatggttcacacttaaaagagatacggaattcaaggggagaattttgccagtctattaacaaaagcttgaactgaagagtcaagtacccaaaaccaattaagaaaatcgatacaagaatttggctaggttgtactctttttttccttgcataagttttcatgcagtttcttattaaggtttttaatgaggcaatctatgcgacatatctgcttatgctatatactatttctccaatttttcccactgggtttttatgaagttttaacaaggcatggacatcacatggtgagtgtccaatgggagtgttaagaaactttgggctcggcccacgaaggcctggcccaaatacacttgggcctatcaccgaaactttcatatttaggattgcactatataaagagaggagggggctactcttttacagttgatcgaagaattggaataagaaaaaaagtctcacctcaactatgtgtcttcactttatattcttagaattatacaactccgttggactaccccgtagcaagaggttgtataataaatttaactgtcacgagtacacgccaacatgtttcgtgagtacacatgctaattatgctaacgaccgatttaaccatcttgatgtccaagcttaaagacctaaacttcggatccgtctccagtctccgccgatctcgacaccaccacgccctcgacgcgtcgcccctctcgacctcccactcctcgatccaatcctcgccgtccatccttccctgcgtccaatccccaccctccattcgacctccttcttaactttcagcgccgcccaccgttccacatcgaacctccgccatgagaccaccaccaccccacctcctcctcctcctcccccgccgccgccgccacgcctcctcctcctccgccgccgccgccgccgccggagagctcgtcggcgccctctccgccttgccctcccccgactcggcgcgacacctcgacgccctcctccgtcgcatcggcggcggtggcctcgccgccgtcctctcgtccctgccctcccctctccccgcggcctccgccctccgcctcctcctccacctcctctccaggacctcctccacctcctcccgctccgaggatgacctcctcaccccgcgcgtctcggcgctcctcctgccctccctcatcgccgatcgcaccgccatccggacggcgcgccgcctcctctcacgactcctccacgtccacccgctccgcaccgccgcggaggcggtcgagacgccgcctccaccccctcctcggacttcctcatccacaccttcatcacctccccggcccaaggctccctctgcagggccgccgacgcgttccgcgttctctcctcgcgcggcgcgccgccctccatcaagacctgcaatgcgttcctcgaagcccttgttcgtgcaggtcagctcgatgccgcccgcgaggtgttcgacgaaatgcgtgaaagcaggaacgtcgctctgaatgagtactcgtataccgccatgatcaaggcgctctgcaaggctggaaaggtggatgctggttttgagatgcttgcagagttatggcgggctgggcttcagccaacggttgtgacgtacaatgtgcttatggatgcactgtgtaagagtgggagggtggaggaggcctttcgattgaaagggaggatggaacagggagggatgacaccaagcgtggtcacattcggtatattgatcaatggtcttgcaaggggcgagcggtttggggaggttggcattgtattgcaggagatggaacagttaggggtttcccccaatgaggttatttacaatgagcttattggttggcattgtaggaagggccattgctcacaggcactcaggttgtttgatgaaatggttttaaagaagatgaagccaacagccgtgacttataacttgattgcaaaggcactgtgcaaggaaggggagatggagcgggctgagaggatattggaggatatgttgtcaattggaatgacagttcattgtggtttgttcaatacagtggttgcatggcttcttcaaagaaccagaagattggagtcagtggtaagcattacaaatgaaatggttacacgaggtatgcgcccaaatgatcctctgatgacagcttgtatgagggagctttgcaagggagggaaacatcaagaagcagttgggatttggttcaagacattgaacaaaggtttaggtgttaatcttgcaacttccaatgcgctaattcatggtctttgtgaaggtaagtacatgaaagaagctacaaaggttatacagaccatgttaaataagggaattgaattggatagcatcacatataacattatgattcgaggttgctgcaaagacagtaaaatggaggaagctattaaactccatggcgacatgaccagaagagggtttaagcctgatcttttcacatttaatactttattgcatgcttattgcaatttgggtaaaatggaggaaacctttcatctgttggatcagatgaaaactgagggccttcagcctgatatagtgtcatatggcactataatagatggtcattgtaaagcaaaggatattcgtaaagcaaaagaatatttgactgaattgatggatcgtggacttaaacctaatgtgttcatttataatgcacttattggtggttatggtaggaatggtgacatctctggtgcaattgatgctgttgagactatgaagtctaatggcatacaaccaactaatgtgacttatggtagtcttatgtactggatgtgtcatgctggtctagttgaagaggccaagaccattttttcacaagccagggaaaacaatgttgacctgggagtaattggttacacaattatgattcaaggttactgcaaactaggaaaaatggttgaagctgttgcatactttgaggagatgcgttccaggggtatatctccaaataagcttacttacactactcttatgtatgcttactctaaatctggtaacagtgaagaagcttccaagcttttcgatgagatggtgggctcaggtgttattcctgacaatattacttatggtacactaattgcaaggtgttctgaggtaaattcattggataaggatataggacatactgctgaattgtcctcaggcgctttaacaaaagatgatcgtatgtataacatattatctaatggaattaatgctccttggtgccagaaagaagctgcttccagtgttgaatgatgtgtggtcaaggaaccttagggcacaccttctttgttctgacaagaaccgtccaagaatgaacagggagtagggagaacatgtggccactgattctgcctttgatcttatgaattttacatctcctaacagttccctccaattcatttggtcatggtcaatctttgggagctatccagcaacagcagaggttgttctgaacatttctgctcaagtttacatgatcatccacctactgtcttgggtggggtatccaacag

SEQ ID NO: 67529 - DNA, 17907 bp, Oryza sativa
ccccctaacattctgcacgctatccggtaaccaagttggaggccaaatggctcgtttgttaacaaattaagcaaatgattcggtctttctaatagcgacgagactccttatgtgggaaaggacgatgatgctgtaattgtgcccccaaacgctatggcaatcaaagggggtaggggaatggaggcatgttccgaacaaatcattctccagggcctacgcaacaggcccggactccagatctcatcattcctggtcactcgcttcaataatgctggcagggcagcagcagctagggcacacacacgccacaccaggcaacagagacggtacccctggttgtatgctagtggctcccctcctgtccatggctttcattaaacgccatgtctccaagaagagcattgctaagaagcaacggcgcaatgcagtcatggctcaaatgagtattatcactctcgtgagtgactaatatgatttttatagtaatatatacgtgatgagaacatcggcgttgcctgttcactgtgcaggactgcatgaatttgcaagatcagtgcaaggaacctttttaactgacgatcgagcagctgacaatctgaacttgaactgtcgaactgaaccgatcagttaatgaacatagctgacagaacagaagcaagcattcaagtagatgcgttaaatgttttaattgtttctaggactatcatgttcatgaggttttaatgcaaagtaggagtacgtggtatagtagtactaagatgtgatctagtatgtgatcgatctcaccgtggtcagggcgcggaggcacttggagcagccggggacgcctggctccgcgcagtccttctccagcctcctcgccgccgcgtccgccggagcccattgcccgccttccgccggcggcgggccgcacgtcagcctcctcagcctcaccccgcagtagcagaacgccacgtcgcacgtcccgttggcgcccggcgggcgaggcagcgccgccccctccgcccgcagcgcgcggtccgcggcgcccgcgcacgcctccgagtcgtcgggcggcacgggcatgtccacggccgcggcggccgccgacttggccggcctctgcgcgagcgccgcgggcgcgtaggccgcaaacagccacgcggccagcggcgggcagcagcgcagcctcgtggtcagcgcgccgccgccgtcgacgcaggaggacgtcacggccgggaggagcgacggggacggggtcagcgggcacgtcgacgacgtcccagacgcggcgtccgactgctccgggaacgccgggatcgtggcgctccctggctgcgccggggtcgccgaggggaagatcagcgccgggtcgagcggcgccgggtccggcaatgccgccgccgtggagcacggcgcgaggcgggacgccgcggccacgtagaggcagaggaggaggagacggcggcgaagcggaggcatcgtctctctctcgtctcgcgtctcgcgcgcgcgcgcgtgcgtgcgtgcgtcgtgcgcggcgggcgcacgcgcgtggtggtttttctggttggatggattgagagagtgagagtgggagtgggcgagtgaagtgaaagcgtggagagtgaatgagtgatcggctatatgcctatatggacgaaatgatgagagaaagctttgtgctttgctggtctagagccaaagaacgcatgattagattggttcttgtataatgttcttccagagagcaaaaccagccgcagccttttgcaaagggagctcctttcatctgtggatcatttttatcgttttacagagagagctatcttctttctttctaccttgtcaaactttgtggggctgtgcattttcgagtgttgtttcagggaagctgcggaaggcgggttaaagtgacctcgctactcaattcagcttaaaaccagcagctttgttgtaatcctgtgtttgctttcagttcatttgctatccacttcaatgttcaaattaaccgtctgatcgagtgctactctagctagtatggcgtatagcacattgccactcgatgtttgctcatgcgtgaaggctgaaggcatcacatacgccctccttgtgtcacggtcatggctagtgttttgtttatgtgagacagagcagcatctcgcagcctacgtatagcctttgcagctgaggtaatactactactcgtatgctgccatgaatcattctggagagagcacagagtatcatgtgttactgctggcgtaatagtttacgactcgtggtaaggtaggtggatattcgttttgttttcagtgcgtgtattatactactccatcccgttctaaaatacttttcgttctaaaatatttaaccacttatcttatttaattaaaaaattataaaattattatttattttatttataacttgctttatcgtcaaaaagtattttaattataacttatctgtttttacatttgcactagttttttaaataagaccagaccaaacgttagaatcaaaaaatcaaacaacatctaatttgggaattgggacggaggtggaggtagtaccagtagtagtatacgaagctacagtgcatgcaccaggctaggatagatgctagtatgctacacatgctgataggagtgccaaactaagggcttattcgtttcaaatgaattgcaaagaaatattataggaatagaaatgagttttaaactatcattcattttataggaatgcactataggaaaactataggaaagttttctattcctccatttttgaaggaaaagcataggaaaaaataatccacttcaacctaatatttgcgtttcttgggttggtttgctcaataacataggaaaaatttctgagtttttcaatccataggtttacacatatatttctatagtattcctacgtttttcctattcatacgttttgaaaatcctgtgaaccgaatgagctctaagcaaatactccctccgtctcattttaaaggcagccatttttttccacgtccaactttgatcgtccgtcttgtttaatttttttttaaaaaaattaaaaacataagtcacgagtaaagtattattcatattttatcatctcataacaacaaatatactaattataaaaaaatttaaataagacgggcaatcaaagttgggtgcggaaactcataattgcacttaaaatggaacggagggtgtaggttattacaacgacatcacatctcacttgctgataatggtaccagtatttagttactacctccgtcccaaaataagtgcagccgtggatatccgtgcccaacatttgaccgtccgtcttatttgaaaattttgaaaatatttagtcacacataaagtactatttatgttttatcatctaatagcaataaaaatactaatcataaaaaaatttcaaataagacgaacggtcaaacgttgaacgtgaatagtgcaaaactgcatttattttgggacggagggagtaataactacgtcgtctgttcatctgtttttagccaaacacacgtagtatccacctagtaaatgtttacagattacaaagtcacagtatgacggaatgttttggaacaggagtcgctggcagagtgaacgagaaatgcgaaacggagagaacgtaatactagtaattcagacaacagaacgcatcgtccaaggagataaaacggatggtggcacacgccgtccgagcgcacgggatcgtcactcactgcacgcctacagcacacttacgacgtacggctattgctggcctgcacgccctgcagccaggagccattaacaaaagcgaaacactgtcgcctaccgcattccaccgcacggcagggaccgcaacacagcagcgccacgcggcggaagcgacgacgacgacacgccaagagcgcgactgcgattctgcgaaagccgagaggcgcctagccttgtgaggcggcgacagcctcgctttcaccgtctcacgcaccgggcggcggacgacggacgcgcggttgattgcctctcatccgcggcgcgtgagcggctgagcgcgtggaagcgaggcgcgcgcgacgtatttcttgctcgccttgaaggcgccacgaccagcggcgtgtggcgtcgcgcgtgcgcgggtggttgtggtttcactggctcggttttaatcccgtgcgtggcgcctgcggcggctgtcggtcacgggcgccaccagcgtccagcgagcgtgtcaagcgagacgtactactactactactactgaacctgaacggatggaatgttttgttggctctcgatcgtccttgttctctcgctcgctcccggagattccttcgagtttacacgcatgctgatgcacgcgctggttttttgggctgaggctgttcgtttcataacacgcctccgagcacgcgcacgcgcatgttggaatcatcaccgcgtaccatataaaatcctggagggatcagagctggagttgcatgctactggatgtacattgatctcactggcaatggagaggtgtgatgcctagtagagtagtaggccggcccacaagagctggggtcataagcccagcttgagttacggacaaaagttcacttttactcccttaagtagtggctggatccaattcatacccttcaaccgcaaaatcgggtataatcactttgccaagcccgactatttataaaccatgaaaaataaaacccttggttgttttgagagtggttttcgctaacatagtttctacatggcagccaactcataaaaaagaatttaaaaactaaagtgggatccacatgtaatcccctctctctccttccctctctgctcgtacctctctccccattgtcttctcagcacaaacagggtggctgctgggtggtagcaggcgatggcagcgaaggaattggggtgtgcacacggcggcgatggcatcccctaagcctaatccgtgcgacaatcgtcttcatcctttaaagccaagtgatcgtggtagctcatcgacgacgtctccaacatcgctatccttgctaagaagaagaccaagtggaagcggtattgcttccacgagcgggagaggccctttccgtcctcttcgccctctcctagttggctcaccgccctacggtggtcgtccccagctattcatggttggatatgatcgcgcatggtcccaccaacgaacatggtcaagaaagacaaaggggtggtcgatcacaatgacggcggtgaggcggagtcagagtcgggcatagtggtgcccccgcacaagtgcagcaacttctcattagctgtgatgttgacggcgcggcaggtgtgcccggtggtggagggccacgatgctgctggatctgcctccctcaccgagctcgggcctccagagttggtgcgcagaggtgacgacgatgaaccttcgaaattcccatggaatcaatccagcagcaaagggtgggggggcagcaaggacaacgtcaatctcccttcctcctttctcctccatctcctcgagccttatagagctcccgcttcgccgtcgagctcctcatcgcctgtagcggcaccactacaaaaaaatatatcctgcattcaaccctcagtgcgccccgagttgttcgccattgccgcgttgtcactaaccggtcgccaccgccgtcgccaccaccaacttccgaccgcagtgctgcacacctgcctcaccgtcggcctaactcgtacccggctcgccactcacgaggagaaagagggccgtggtggtggtggtgaccggtgagcgacaacgcagcgatgggccatgtttagggccagaccatagcctctctcggcccacttcattctacttgggccgaacttctcccacgagaaaggccatcgcccatcgctactgaactacgagtaccatcggattccgactttgcaggctacgacttcgacgaaccatgtacccaacatgccacaaaaccacaatatccaggcgagttttcttcgcttggccctcctgtcgaatcgagcagtcatacgtcgtgccgtcgtatcgtcgactcgtcgtcgtccaactccaaccttgcgcggcaaccgggtttccggtttccttctcctgcttacaaatcgtcgggcccgggcacctcgtgactactccctccgttccaataaaaaaaagacaaacactggtttcgtgtccaacgtttgaccatccgttttatttgaaaaaattatgaaaaaaattaaaaagataagtcacgcataaaatattaatcatgttttatcatctaacaacaacgcaagtacgaattaaaaaaaatttcatataagacgaacagtcaaagttggatacgaaaacccatacgaaaacccatagcttgtggacggagagagtacgtgagaacggagggaaaaaaaaaagaaacagcctgatatgcggccgtcaatcgcggcgcactccatcgtatctcatcatctcctctcccccaccgcgcgcgcgcgcagcccgcgtggttagatcccgtttctaccagcgcatatgatgtgcaaggcactccaagccagaaaaaaatataaatcgcgtggctcgcgagtacatgtatatacatatactgccgtagtgccatggatgggtgtacggaaaatcacaataatttctctctcttcttctaccttgtcatggccatcgccgtcaggccggacaatcaggtagaaacgccagcacgcacgccggcgatgaaagctcttttctttttctttcgccgggcgcttaaaacaaatctcttgtacatggacaacgactcaacatttcataagtttaccgcagtctcaacgatcgtacaattctagagcaaatgatggcgccgttgatcactcgggtcgctctcacaattaaacagaaaagttggcatcttgttcggttcgggcaagtgtggacaggccgctagttggagtaggtgtacgtggggtatgtgccgcggcgatggcgtcatgaggtcgtaggatgccgcgaggttagctcaacgacgaggcgctagtgcgcgcgcgtgcttggatgcttgcgggatttctttgacctcgggaggaagaggaggccaggtcggcaccggattgcgccttttgagtccatatttttcaggcctctgtttctttcagaagggtccatgtcaatcaaaggtcccattgctggttcgctaatgatggatggatcgatcggagatttcgcttttatcgttccgttgttaatttgaagagcatcttctagttgcggaatatgtcaggtttgcaagattttccacacccaaaagttcactttctgatgggttaaaaattaaaacaagaaaaggaagaacagagatgtcactagtaacagtgttcacaagtactttttctttcagtgaactgatgatatttacaagtacttgtgggtatgacgaccaaagaatgaaacaatctgtcaagctccctgtcgatttttttatctccacgctgttatttgtttcttatttttctcaatctccatcaccactagcttatcaaaactctcgtaataaacacagtttgagagagagagagagagaaataaaaaaagaagaaaaaaaacgacgtttttttttctttcttcttttttatcgtggctcgatcatggagatggacacgtcgttgacggactgcgtcttggtggtctccgtcttcatcgccagcgagaactccgacgccgagaccttcttcatctcccgcgccgcgaacagcggcggctgcgcgggctccggcagctgcatctggtcgctgatgagcatgagcaccacgttggacatggtcggccggagctcggggctctcctgcacgcacagcagcccgacgtggaagcaccgccacgcctcctccttcgagtagtcgccggcgagcgacgcgtccatgaactccgccgccttgtcctcgttccacagcttccatgcctgcacacgttcatatgaacacaaacaagttaaaaaaaaaagactctgcttttttttttaccagaaagagtttgatgcaaaaagtttctgaattttttttttacatcttggatcagggtttgctggttattctgaaggtacattgcgccattgcgttggccgctgaggatctcgagcacaagaacgccgaggctgaacacgtcagacttcaccgagaagacgccctccatcgcgtactccggcgccatgtacccactgcaaaatccatcggttcatttcaatacaagttgaggtaagatttgtgcttgatgagccatgagaaatcaggtgatcgatgcacatagtgcaaatacgttgacgtactatgtgcctacgacgtgtccggtgttgacctcgttgctctcctcctcgaagatcttggccatgccgaagtcggagatcttagggttcatcttgttgtcgaggagcacattgctcgccttgaggtctctgtggatgaccttgagacatgaatcctcgtggaggtagagcaaaccacgggcgatcccaaggatgatgctctgccgagtcttccagtccaattgagccctctttctggaatctgacgagacaaaaccgaattagatttacctcatggttactttagttttagactttcagtgttccaagatgaaatgaaacagagcttcagtacaggtcagatcggttaatctgaacagtttataattccaatcgggtttaactacacgcacgaagcacatggacctagtttgcttcccattgacctactttgcatcgatttggtaacttcgttagacttaaacgactcgaaaaaacaataaattatgcagagtgcagaaccacgagtccagctttgacgcaatcatgtgcgtatcccatgtgtatcagtttctcaccagccactaacaaattcaaacaatcacaaaaaatacctataatcctgcaagaatttataatgacaaaacaaaacaaaacaaaaaaacagtaacaaagagagaggaagcagacgaaccgaagaggaaggcatcgaggcttctgttagggaggtactcgtagatgagcatcttctcctccttctccacgcagcagccaagcagcctgaccaggttcctgtgctgcagcttggcgatcagctccacctcgttcctgaactccgccgcgccctgccgcgacctcgccgacagccgcttcaccgcgatctccgcgccaccgcccagaacaccctgatcatcacatccaagaacccaaacttcagtcgatgcaaattggcatatatcaggagtagtgctatttccaggacaaaatctagaaaaatttgctggtgttcataccctgtagacagggccgaagccgccttcgccgagcttgttctccttggagaattggttggtggcgtcgtacatggaggagaggtccatgagaggcaggtccgagttggacagtggcctcaggctctctatctgcgccctcctgacggctgcaaaggaaccaagaaaaccaaatgtaacaattcacaaatttgcagcgtttgcggattgatcatggctgaataatcgatcgatcgatcgatcttaccgttgcgcttcctccatctccagcagtacacgcagtagaagagggtgcagatgatgaccaccaccagaatcgacaccattatcggcatcccattgtggctcgagtgccctggtgcaacaaaccaagaacgcgtaccctgacgccagttcagtcaccttcttccaactcaagaacacgaacatacacacactgcaatatcttcagcaagaaagaaaactgcgcgtacgtacctcctgaatcagtcgcgggtgttgtatccatcagccggcgatgtcgaaaacggtacaacgacgatccagcctcgccttcttctccccggctcttcatcaaaaccagttctctgatgagagaaagccttgggaaattttgcactgcttctctgcaggaatatatacctctcgtcactattgggttgttggagagaggttgcaggctagctagctagcttagccttaatctgaagattggctcgttagtggcttagtgcttactgttgtgctggcaccaatgtgtacagactacagagcatataagtacagctcaggtgagaggagaataaaatggatatgctgctgcctgctgcaggtatggggatggagagggagggggcgttgatggctgcaggatgaactggtttttcaaatgttgctgcaaatatttcatgcttgtccttttaggactgcaaattgtgctgcttgaccattgtgtggaacatgaacacctacgggtacagcgacccctctctctgttattctggttgttttctgatattggacggcagtggatgctgatcatccaaatttttgtccactgcttttgttcagttgttcttatcatcatcgcttgatttgctgatcaatcctgactgactcattctctcgcaaattaatccagctgtactataatctaatcctgccactacaacttgtgatgtgaacccaaacagtaggagtaagtaatcaacgctaacttttcacatgtgctgattcaggattaggtgactgtcaagggggcggtgtgcaagacaaccaccaaaaaggaattagtatctttttcctgccatgtttgagacgtgagcgtgtgaactaattaaagggcactgaaaccagggtaaggcttgtacagctataatgaaatgaaacggggaagtattaaagggttggaagtgtgtttgatttgattcccttttgacaaacgaggacacacgccatgaaaattatttctcggtgtggtgtgggtgcggtgcgtgtgcgtgtgggagcatgacaagctgggccacctcatcggcgtaggagcttgttgccttgtgcgtcaaatggtcaaaacgatttggcattttgtactggttggtagggcggatccggtggtggagatgcacgtttcgcctttttattttgcaaagaggagctaattaaggctatgtttgattcagctattataatctaaattattaggagtaagctgaaacaaatagatagcttattatgatagattgttataatctataagtcagattactataatctggtaagccactctaaaggtgcttttgctttttttaattattgggtggctaacagctaacaaacagataataatcagaaacaaacagctagcagcttattctatatcggcttattataatccagcttatagtaatctagttctataatctatattagaataatcttaagctgaaagaaacagggcctaagactgagttcttttattcactttcctaacttatctcccattttccacgtacatatttatcaaactattaaacggtacaaattttataaaactttttatacaaaagttattttaaaaaaatcatattaatcatttttaagttattttagctaatgcttaattaattatacattaataaaccatcatgttttccgtgcaaggagatggagttccaaactctacctctcaaacacatcctaaggatagtgatgatgcgagcgatgcctacatctctaacatgtgggtctaatgtattgacatcaatggagggagggtccgcgtgccagtcagccagtgtatgtattaatagcatgacggcagtgtctagttattagaatattaaggagctaatgacctctcaattatcatggttagttggtaattttatatggcttacagtttaagcgagcattttaatacgcatcctgcaacggattgagcgagacaggggagtagggggattaagcccccccatgatctaatcaaacgatattcatgggggtgatacatataatagggtggaagataagatggaataagaaatgtcttgcggtggagcatttaggtgggtaagttaagttgacgatcaagacccgataactctccatcagtccaaatcgcagactcttgttgtcatgcgaagaaaagaattctagcgtgacaatgcaatcagggagtagcctccaaatgagaccagtcatggcctagaatttgaatggatgaatgggccaaaattttagtcaccaaacaagttcacctgacgtccctcaattgtatgccgagtctgaccgcaattcaagaaatatgtacctctaaactatgtaaaactgttcaaaacatgtcccaaggcaatatagatgtttggtttcgctgacatggcttcctagtcagcaaaaaataaaaaaaataaatatgtgagacccacctgtaagtaagaaggaaaaatgtgaggtccacgtgtcagcatcatcttcttcatttttcttatcttctcttttgccgccgatggcagatggggagaggcggccaccgtcgactccacgctgcttggccacgtcaacggtggcggcgaccaacccctgcaccctaggccccggcgtgctgctcagcctcgcgctccgaaccacccgacccagccatggatgagagggagatggcggcgaggagagcaccaagcctagctcgtcgtgccatgggtggcgtgcggcattgcgggggatggggttcaaggacgacgacgatgtggacgatgcggtcggcgaagtcgtggacgatggcgatggattcgcacggccgccgctcggaccccaggctgagtgccttcttcaccttcgagaacccgagatggcataccagaaccgccatgcggaatgtgttggtgaaactgccgctggcaatggagccgtcgtcgacctccgcgcgagcgtcgtcgtcaccgccgtccccacgccctcgggagtggcggcgaataaggggacaggcgccgccgacgagcagatctagccgccctcgccctcgacagcagcagaggcggagatgaaggcggtgggcgagagcagcggcctcttctttccccctctcccaccagcctcatctcgccccctctctggctggcaccagttgctgccgccgccgcctctcatccttttgccgttgacgggtgaagaagataagagaagacaaaacaaaaaaaaggaaaagagagaggaggaaaaaaagagatgttaactaggatgtgcgcccccacatacttttttatttttatttttgattactagaatgtcacgttagtgaaaccgggcatctatattgccttgggaatttttttagacggttttacatagtttagggtatacatttctggtattgcagttaggaccttaaatagactcggcgtacaattgagggacgtcaggtgaacttattccatgagacgtacaagccttagtagcattatagttcttgccagagtcatttgggcttggaagttgtattcacctagtaggctattacgtccttcaactataagctttcaacgagttttttttccttaactttgaaaaccagatcaaattagatgaataccccgccgttttgctataggaaattaagttacataatatatacagataggatacaatatgattattaaaaccaaaacaaattgatacttataaattttaagcctataaataattaagattgtatggtgctttgagagaaaaaagaagaaacaatttcaaccatacatctataatctaatggctagaaataattagtgtgatatgacttaatgagaaaagagagaaatagcttaacggggggatgaactatataagtataagtataaatgatacctcctcggcttaattgccgtcgagagtgggaggtgctaatggacgggtggttgctgtgagcgatcacccgtccctcccctaagacggctcccctcccccttccacatccccttcttctctttctactacgccataatttttttaaaaaaaattaaaaaaaaagttagaaaattttatgtatagaaatactatataaaaaatatttgaattcaaattaaaatttaaatcaggtatataaacttttgacttataaactttgggtgtataaactttatatgtatagaaatactatattaaaaaatatttgaatttaaatttaaatttaaatttgaattagatatataaacttttgacttataaactgtgggtctctaaactttaggtgtataagctttagatgtatagaaatagtatatataaaatatatttgaattcaaattcaaatttgaatcggatatataaatttttgacttataaactttggatctctaaattttagatgtgtaaacttaaggtgtacaaactttaggtgcataaatttactaaaatagaaaagtgatacggtgctaaaaaaaaagaaaatcatctggggagagggactgatcgctcctagcgaccgatcgctccttatgactttcggtcgagagtcgtagtctcgtagagtcgagaggatggagcgagacggccgaggaggtccggtgattggcccagtgccgactttacggcccaataattacatagcccaagtggactattttgggggttggagatttgtccgccgacccctccaccgtactccatacacggtgccctcgcttattcccgaagaacaactaccacgaaaccacgcactgtgcggcgacgccattgcaagattgtgaaaactgaaaaccacatttcttctggcgtctctccttgatctggaaactgatgattcagacatcttggacgcataaggtgagtgactgagtgcagaatatttttgtcctggcattgtttggctttatgcttaccccgtcaggagaacggcctatgtgcaaatcatgttgagagattagcccaagaattttgcgtcagagctgtgtaattcttgaatcttgatttcataagcacttcgcagaaattgagattagtcccaagaaattaagatggatcggaagttctttctttggtaaggaaaaaaaaaaagaacgaacatcttccgatctgttctccgttgttacttgttttgatttggttttcgatggagaggatgaagatagtcggctaggagggccggtgattggcgcagttctgactaaacgggccaataactgcatagcccaactgtcacatcgggggtcggagatttattccccgaaacccccagcaggttggagattcatcttccgaacccgctccgccgttacggtgcccctcctactacctcacaagtcacaactccgatgaaccacgcgtacgtgttcctccttggtccccgacgttatttgcgagatcatcgtgaaaccttcaattcttccggcgtttctccttgatctggaaactggacggttcattcaatcatcgtgaaaccctcatttcttccggcatttctcctttttttaatacgcaaggagcgcattttttccattaagagaaataaaagttatttacaaggataaaaggaaaacaagcaggggaccgatacagaacgctatggaaaactataaaaatatctcgcgttaaatttgactaccacgacctcgtaaaggccaaacagcggggaccccgtgattagctgacttccaaagcatggcctcctccgccattgctttcgccacttcggtccaagacctttgttgttgattgaagattcggttgttccgttccttccaaattgtccaagccaccaatgtcacgacagtgttgaagcctcgacgataccgcgccccaattttcattcggctatcacagagccaattgtggaaggatggctcgttgacaggtaagcagttcggactccttatcgcctgaagcgttcaccaccataattgtctcgattcagggcatgctactaagatgtgatcaatgctttcgtcctgttgatcgcaaagaacacaacgatccgggtgtggcaaccctcgactgcgcagacggtcagcggtccagcatctgttcattgtaaccaaccacaagaagaagcggcatcgaggcggagcgagtgacttccaaattggggtggaaaggaaggtgactataggcggattttgagctgtattggcccgaactctctcatttccagatgattgaaccaggagtagtaggatcaagatccaccatttggacaagcgaccaaagctgtagatattctagaataggttggatcccaagtgctcctcggatgtctttgatccattggcgacctgttagtgcctcagccaccgtccgacgccggcgcacgcgtggtggaattttatcatagatgttcggagcaatggaccgaatgcaaccctcttgcaaccagctatcttcccagaagagaatagtttgtccgtctcttaattgacagacggtagaggatgcaacgaagttcctttctttttgcgaccccggaatagctagcccctgccaaggtttgcttgaggaggtccgttgcaaccatgtccacctggaacgaagagctatacccataagctccagattcggtacacccaaaccgccgtagtttttaggggcgcaaactttggaccaagcaaccctgcaacaccctccattagcttgcgctttacctgcccaaaggaacccgcgacggatcttgtcgatgcccttgaccacccacttgggtgcatcaatcacaaccagcagatagatcgggatagcgctgagaacagcgttaaccatagtagcacgaccaattgaagacatttggttggacttccaagtgccggcatttctccttgatcgggaaactggacgtacgattgattcatacatcttggaagacatctgtactaggtgagtgctgcagatttgtcctggaattgtttgtctgtataattctggatttcataagcactttgcagaaattgagattagtccctacaaattaagatggatcagaagttctttctttggcaggcaaaaaggaacgaacatcttccgatccgttctccagcagtgcaacttgacacctgactaaccactgttacatgttttgatctgactaaaacttacatgatggaacgatccatatcatgaagagagaaaagggggttgtatttagtcgcagtacacaagaacatgaccacaaggtttagcaaaatgttaaacctccctgtacgtgtgtcacgctaattaactcccctaaaaaaaggtacattgatagcgctaatgatcagtggcgagagaaaaaaaacaaaagttttgtgcctgcgtacgtatgcatatgcctcccttgattatttatcttcgaacgaggtggttcgttattgattaataatttctatcgtagtttcttcttctacagtagtagttcagttcatgagttgtcccatcagcggcgacgacgacgacaagatggcgtcgagcgcctccttcacctgggatatctccggcgccttccctccctgcgccggccagaactcgtccgtcgcaagaacctgcagttcatcgtcagaaacacagttaattagaacctccaaattctaattctaaccgcgtaatcgcgtgcacattgcgagagatgtgtgcataccttgacttgaagctggaggaacttgacgtagctgatggccttctcgagcatggtgacgaggtcgaccttggtgccgttgggcacgagctcctgcaggatccgcagccgctcgctgatcctctcgcgccgattctgccgccggcaagaacaattcgagttcagttcggtacatggattggtcggagtagcagtaggattttggcgcggaattcagtaaaagtttaattaccttggccgcgaggctttgcgggtccttggttggggtggtcggcgccgacttggccttgcccgccttcctgccggcgccgcactgcttcttgctagggctcatggcctgcgacgactccgcgtgggcccgcttctgcgagccgcggggcgccggcgccggcgcggcgcgttcgggggagacgccgccgcccgacgtgctcgggaacagcagcccgaactgccgcccacccgcgccgccgccgccgccggtggctctctccgtcaggctgaagcagccggtggccgcgtcgaaggcgacggccgtcgtc

SEQ ID NO: 67530 - DNA, 3093 bp, Oryza sativa
gcgggcgaaggagctggacgcgagagcgcacagcggcggggcggccgcgggccagggcgacctagccgcccgcctcgcagccgccgaacacaccatcgccgagccgcagggcgcactggactcgtccgccggggaggtcgaggccctccgcttggcaagcgaggtagggcccggcatgcttcgggatgccgtctcccgtctagaccgtgccgggcggcaggcgggcctctggggcgggcggtacgcgaagtacgccgccaaccaggggggcctcgcccagcgcctctcagagatggccgggaccctcaagcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggacggcgcgcgcgcgcaggtccgggacgccgccgaccacatcgtccacagcttcgagggtacggcccctcagctcgcgttcgccctcgactccgacgaggagggcggtgacgatggtgcggacgacagcaacgacgaggccggcgacccgggcgcgtcggagtgagcccccaggcccccgccaatcttaataacttttccttcttcttccgaggccttcgggcccccttcttgtatagactgatttaatctgcaatcaagtaaagaggaaacttctgtgtcagttctatttattgtgtgtatgagacgaggatggtctgtgccgcggtccttctgtgtcttggcttgaacaagggctcgtgcccaggtcccagcctcagacggcgcgggtcggggctagtgcctggggagatccacgtgtcgagactggccaggccgggagcgcggtgaccgagggttatggatgacccgattgtgggcctttgccgattcccccccggagttcaccacgccccggggcacggctcggttctgggccccgtttggcgattttagccggcccgggccaccgagggcagggtcgggcacaagcgtgctaattcaagccaagattcttcaaaaggaaacgatggcacagacacagtcctcaggaaatcgaaaatgcttttattaaaatacggaagagaaaaaaggtaagtatatgcatgtggtagcccccggccaaccctgcacacccgggggggtgcggggttggcccgggcccgagacatgatacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggtgctgatggtagcgccgcaggctctgctggtagcgtgcggctcggagggccgcgcgccgccttcgctcttccaaatagtcgaggtcgtctcggcgaagctgatcttgatcagcctcgcaatacatggtgacccgaggggacctcagggtgagctcagatgggaggaccacctccgcgccgtagacgaggaagaaaggcgttttcccggttgctcggcttggcgtggttcggttcgcccagagcaccgctggcaggccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacgggaggccggcccccgtgcccggaccgaagtggcgctccggacgaggaagcgccctccgttgcgtgggcggcgcgacgagcatcgcgctggcgctcgatatcgaggcgggcatccggccccccacgcacatcttcttgggtcggaggcgttgacgagggaatggcggacggacggcgggtaacggccgccgctcgccgcgccctccgcctcgacgacatggagccggcggcggcagcgccagaggcctcggtggcggaggaccgcccgccggcgcctaggcgctgctgcgccgtcatgaccaagtcggccacgtcatccagccaacgccgggctggagtctctggatcggggacaacgggcgggtgacgcaggagcgcgcccgcagcctggagcgcgccctggggcgtgctgccatcgccgtagacgaggcggcgacgtgccccgtctcgccatcctcccccgtcgcccgcgggcggcgaagtcgcggatcctccgacctccccgagcgcctccccccgcccaagatttcggcgagagggggacggtggggtgcgagcccgacagcgcgggttctgctccccgtcgtcaccgctagcgctcggagagaggctgtgcgccactgcccgttcggccattgggctgagcgggagaagcttggcgcacacgaaagaggacgagggcttcgaaagacacgcgcgccccctacctggcgcgccagatgacggagcgtggggctcctcaccgggagaccgcgtaggcccccctttgccggttcggccgggggcgctaagtgagattcttcgccctcgatctgaggaacgtcagcgagagaggaagcgcacaagacacgggcgacgtagacaggttcgggccgctgagaagcgtaacaccctactcctgtgttctggtggatctgtgtgtgaaggaatacagagagctcgagagcgagagagagttcaggctcttctctcccaaaaatcccaaatcccctctctcctaggcctgggcctcctttttatctggtcaggggtcaccacatgggcctctcgctgcctaagaaaggaaacatgctttttacaatgagggctagtctacagccggaagtgacctctgacaagcacagcacacgtcttctgctccgctcgtcagctctctcggtggacgcccgtttcaaccttcattcaatggccagcgactttct

SEQ ID NO: 67531 - DNA, 36880 bp, Oryza sativa
aaatgtggtgagattttagtcttcatggtaacgcctccaataagaacattatatttattgcaaaatccaagatcaagagatttctccccaaatctcaaatatcattcttcacggaaatgtttttagaaatagaacgccgttcaagttgacgtcattgccgaaactaactaacaaatgtcaatagtagcaaatgactagatcaatgaaacaaccaataaagaccaatcaccgattacatatccatcaagctaccatatacaatctttatttttagtgtgtgtgttttggctgggtgcatcctaattatgcagaggtcgaaagtgcgctcagtgctttttatcatcttgacgtaattggctgagttcaataaaaactttatttatctaaaacaaatatggaggtcggatattagggaaagctatacctccaccatcactaatcaccactctacatgctactttcttgtagtcgcatggttgtgtaccaatgctcttcatgtggaggcatcaccgccgatgccccaaatagatgacgtggtcaaatgaatgatcagaaccgtattgatggatcggaaagacactaccaaggagactcattttaaagacaagatctggaccgacctatactgatttttcgtcatctcggttcaccatagtgaaaaaaatgactactggatttgtgggtttctgaacctcaggccccaggccatggtttggataccaggggtctagatccatctctagacactattgatgataaggctatctaggatttattttttcaccaccgctatgaggcaggtgccgctggtggcgaggaacctgcctccggtaacatcagtcaaaagtagagtgcgacgaggtgcctcgaggcgtttttggttgttgtcttggttctccatgatgtgctaggttgctagcgagatgagtagctctcatctttgatcctatagctagataaatcttagaaaagggcaaaccaaatctcccctaagaaacatttcttctttgaaaacataaatgaattatattgcctcgcaattgaagtgaactaaaggacatgcatgaatgtgttttattccagaggcatggaaaattttgtaaagaagtatctaacagcaaatctaatgcaaaaatctaagttatacgaaacagttgtcgatcttatcacgtgatcaagtgccggataatgtaactggtgatgctgtcgtgactacacgtgtgggtgactagttggcatcgttgtcgagcgcatatgcagctagcctcaaatcagtaatattcctcacggcggaaaatagtaatattctatattttccatggagatatacaagctttgtgccccatctctctctctatatatatacatatgtgctaactttgagaagattcctagctcgcaaaagaaacagattcatactctagcagatatgcctagcgttgaatgggattccctgctgcaccttcgatctaaagagtaaagaggtgcttcaattcattcgcttatcctggctgcctagctatgtctcttgcattcttggctacagattttcaaagctatccttttcttcttcatcgtcatcttcttcctcctcctatcggagaatcaattttatcgagattaaaagtgaattatccggtctttcgcattatagattaatcttttttataataaaccagctggtgtagtgtacacggtttacgatcgaacacaagacctcacaattaaaactatacacccttatcactgtactattaagtgtatctttaaatgagtcatatgagattagcctagttaaatggtgatattgacccttgatgagagtgtgcgcattttttttctcttctggctataattcattggttgtatagatgttgttggtagggtcggggggagataggcgcatggagcacatgtgtgggtgacttttggtagttgcgaacgagaaaggtggtcaatgagtatctgagagcagatcgaagacggccgctttgttccttctggaggccatcatattctctgtgccttcttttgtcctcagccaaaagttttgcccgccaggatacccttgcctgtagttgtagcataatagctgaaggtgaaggatatatggattgtactaaacgcaaaacagttttaaatcacacgagccgagctttcgtggtgtttgcgatacttagaaataataagaggtggagtaatatgaacggttgatcaagagagggtaaaagttactgtaaataacagtggagtaattaacttataaaataacatattttattttgattggatcaaacaattggctgcatttatcggcattgttttgtagaaaaagaactgttagtctttcgaggcattttgactccaatatattttgtatcattcgttgagaaaatgtaaatccacccatacaatttgtctccaaataaatttttatcattttctaatatttgcatgtatttgtgaaaggacatgtagcctaatggttacaagagcctcaatagcacatgaggtcctgggttcgactccccatgggagcgaatttttcaggatttaacggcgctgtgttttcagtggtaggcgacgtacccatcgatagcgaagcgcctgtggtgacttgtcaattctccaggatttgccggcccaatcttcgaagatgctcatagtggtgagttctccaggatttgccggcccagtcttcgaagatgctcttcgaagctcatagtggtgagttctccaggatttgcaggcccagtcttcgaagatgctcatagtggtgagtgcgcgtgcgttgtgagtcttcgaagatgctcataagggtagggtttgcgtgtgtgtttataggggtgagtgcgcgtgtgttacgagggtctgcgttataatgtgtaattctaaaaaaaatatttgcatgtatttttgtgcggtatcacaaatttaaattaagttgatatgtgtgttcctatataaagtagcgaacgcggcaactaaattagcccctaatttttagcatgcgtacatgcatgcatgattaagttggaaacaatcggcgtgcggagtatccaggctgctgccacggcggtgtcggcggcctagctggtctccgggcaggttggtaccacgcgccgtgacggctcccacgtacgtcaaggtcaactcctcgtccacccccagcgtccagctggcaccgcgaccgggtgatctctcacgagtcatgagaggctgagagcggcctacctacgctctcggtggtatttgccgatcgaccggatatattggccgcctctcggattgcggagagagccagagacgtgttgaactgattaggagtaatcaaagggtggcattttttaagctacagtttataaccgagaaaaacaaacggatataagagaatctggctattccagtatataactaaaatctttttatattatgaggcatgagtagataacccgtatttaagtacttaatgataagcctatttggtagggctcttatagctaaatcacaatcaaacagctccacataaaagtattataaaataaattagaaatgtagagttttgatttagtatgctccatgactcaaatttagacccaacttcataaattaaatttagaagctgaaaccctgccaaacaggcgctgtatgttgagtgcattgtttatttttggaatgattaaaaagaatacacatcagtaaaaaacttgataattatatattgaatgcattgtttattctccaaactgtagtggttgggatttaaagaagatcctacgttaactatcaatttctaattcttatttcaaatttcaagttaattaagttaacaaaatacaaaactgacagtcaagttagacatcaatgtaattctgaatttattattggatatattttaggccatgtttagattccatcccaaaactttacatcctgtcatatcgaatgtttgaacacctataagaagtattaaatataagctaaaaaataactaattgcacagattgcgattaatttacaagacgaatcttttaagcctaattgctccatgatttgacaatgtggtgctacagatttgctaatgacagattaaggtggtgtttgaatctcctgtttcacgcaaaacgaggtgttaataacgtgtgattaattgagttttagttattacgaaattgaaaaatggattaatctgatattttagaataactttcatgtagaaagttttcgcacaaaacgcaccgtttattagtttgaaaagcgtgccactttaatccaaaatttaatccaaacttttcaggactaacgaacggggcctaattaggcttaataaattcgtctcgtggtttacggacagattttgttattagttttttattagtgcccgaacaccccatgcgacacactatataatatccgatgtgacacctaaacaccccctcaggataactaaaaaagagtcttatcaatttgaatatcatgtttcatttaacacaaatagattatcataaattttaaaattaactttaaaatttaaaattgacaaaattagttctagagcatcggaagttgtcgattttggttttatagcatcaaaagttcaaggctcattttgatagcactgaagttacctccgttatttctgtttagcattccatccaaactccagttagttttcttttcttattattatttttcaacaaaaaattagatcaaacaccaatggtggccctcttccacttccttctcatctcgaaacagcagtcatacaggagctcaggccggtcagccatggtgcgaacacagtatgctggctccacgagctcgtcatgtaatacgtgagccctcacgagctcatccgcaaaccgctgtgttcatccgcgcttgctaggtgtgatctatccacgttctagctttgcccggacagcgccatcgtcgatcgatctcgtctaccgcgccgccatggccatgctagagcttgttcaaatcttgcgtgctcaaccaggtccatttcctccgcggccgtgccgcttccgagttcgtccgcgtgcactgccctcggtctcccctagatgcgtcatcctcaagctcatccaatccatgaacgcccgaagtgtcattgtccagctcgtcgccggcattgtcgggtccgcacggaagcaaagccctccagattattgtcggcgcccttgagctctctccgacatgctgccctcgatcaagctcatccatcggccctcaaattcgccccgaagcaccaccctcgcgctcgttgcgggctcgcctgagtgccgacccgctcctccttgccctggatccgttgtctaccgacccaagagccgccgcctctagcatgccagaaccagctgccaccatccaaggctccaactcgctcagcgctatactgtcatggtcgagctcgcctgatgccttgaagagtggtcaaccataggagggagagcgtcaaccataggagggagagcgcaggaggaagaagatagaggtaggatggggtgagccgacggaactgctgacggaatgctaaaaatagtaacggatgtagttttcagtgctattaaagtgaaccataaacttttaatgctatagaatcaaaatcgaaaactttcgatgccatagaaccaattttgcctttaaaatttggttgtggccgtcaacgaagcacttaattagtttaaaaacatgttgaacaaagaaatgccacaaggtgtttacgaccactttctgattgatcaaattcacgttatcagcccagttcataccatcacattttaacgagaaaacaaactgactacttccgacttttttgtttccatcggttcgtcgtaatgttttcgacaactacttcgacttccagtagtaaagtcagctttcctttgtttctatcttttttgtttccataataaaatgcattaacaaattcctacaacacattaaacatgcactgcaacacaaacagaactattttggttcaacttcgacgatggcgcttatgagcagtaaaaattgaatgaaggtatgttacaacgacacttcacttctggcctacgaacaatgcagcctgaactgctttcatttcaggttgctcctaacaaatgatcagttaagcataagtgtgccacactaaaatcaatcgtatggtgtgcctaataactgttgagagacctatatgatgattcctaatgatgcatggggaattagatcctagcactgcattgttgctctagaaaaaaacattgctatcccttgctaagtgacgccattgtaggaacttctggagatatgctaaggattggactgctccgttaccattttctgccccactgcaaactcaatacacacgtcctcggcaattcttagcaccacaatggcaggggcatccatcaccaggtagcaatttttgtccatagtcataggccaattcttctcccatcaagatctggacaacagtgaaacaacaattagcaaggtacgtataacgatgtaggatgaggtggtcaaaaaattcttacatcctggtttgcaaacaaaccaatgtgcgcaagctgacagtctttgctctccaccgaaactaaacgcgtactgagatttggggaacagctgcaatgaaggggcaaaagcattggttccagaacaaatttatcccgtagtaagatgttcccaagtactccttccatcccaaaatatattaacttctaagttaatatattttgggacagacataaaatagtccagttacctatgattaataaaacgggatacgttgccatatcttgtggcatcaatcacgtatgcagtagtccctgtagtctgaactctttccctgtcaatctgagaagtgatttcaaacaagtagctgctaccactttttgcctccctgagatccaataattttcttatcagtttctgagcataataataatactccaaatgttcagactatagaacaagaacagcgtgaaaccagaatgtgtgcaagatgaaaatatagtttaggcagagattgggcatttaggcaagactgggcatcataatgaccaagaaaattcaatgaagcttacatggaatgcaccggagaaattccaatagatttctagcctaaataaaagaaataacaagagaatcatcaaacctttctacatgtcttatggccccatcatccttcatcttcaaaacctctccaatgtactcacatacaaatgtgccctgtggaataggttctgcggctctaacagcccaaccctgcagcatttgacaaaacaaaaatatcacttgtaagcaggttttatcttgacgtcaaaggtaaggtgcaacgctcaggaaaccaaaaaaacaagtggagaatatttcaccttattctcagttctgaagacttccaactttaccagcagtcctctctgcagtactttattctgacaggaggcatcacaagtgcatgatgaattgcactcatatataggatatccttcctgcaaatttaacaacacatagacatcaaattatacaataaaatgatgagaaatgaatgcctagatgatggatatctttgaaatgagctcaagcaaaaggtgtacaaatactcagtcagacattatctgcagacctgaagaacaactcaatatcaatgagcccaaatcccacgcacatcccttttgacattggcagatagctattggaattagttatgtcaccataaaagatgaacgagataatgccaccatggatgtaaaggtcaaatcacgacaaaataaagaggtttgttttttagatgaaaccgttgtatgcgataatgtcaccatggatgtggagcctgtaaattatggttaaagaaccaatctactattgtttctgcagctctccagaagtaagtttaagggtgaatagcaacagaaggcttttgatacagctatgggactcagagattgcattagtaattaaaacaggttagagtatgctatacacgaacaccatagtggataaggacatccttaataagaacatataagtggacatgatattgagctcagggagatggcaacacacaatgataggtatttatttaatcgcagtttaagctaaatttcaaaataagatggcaaacttcttgagaaaaatgtagtgtgcttgcatcataaagaaaaaaaaggttgcattaccagctagtcacagatatcaaggtatcaatgatcagatcaatggggctgcgcttgcttgtgctttggattaatccaaaggtgattttaaattttagatttcgatttaggattaacttttaagggttatttcatctctttcattgcccagctctatgttcatgactgttaagaagacaactaaaaaatctacctaaaattattcttaaaagccaagcttcaaaattcgaaatcgctttggatatcacaaccaagaacagccagcacaactccattcacaaatactggccacttttgactactttattggttcacgatacggaggacatgtcatttttttccaaagcacagcttcacattttgctcttatttaatatctcccatcctcatcccatttgtggagaaaagtggacaagagattatttattaggatagtttggtcattttggagaaaacaaatgtaagacttcccttgcgttggtcaaaacccacattcttgaacagaaattgatggtggtactagtgcacatttctgttcatatttccaatgttcctaaagccatacatgctagagtacttgtcaaaaaaacatgtgtaggtaaaaatatacgccagtaacaattattacctgcaaaataactttgctattttcatcatatgcaaatctaccacgcataggtacaccatggagatccactaggttctcatagatactatcaaagaggctcacatgatcacattcctcaggactgcaatgggcatgagaacaagcacacccaaccatagtgttctgcaggtaagcaacttattagaagactaagttgcaggagacaaaaaagttgcaatatataaaaaccaaagaaaaatagtcttggttcctttcgttcaattaatatgcaagtttctgttcatcataaaagcaaaatccagaaaatacctctgaatcaacaagagatgaatccatcaaacgctttgtgacgtagtggaaaccttgccagggcagagaattttcactttgcaaaatttctccaggtttcatatatggaaattcttttgcatctacatcaatggcacagacaactggaactttctccctgccaaagctaacatcttcacaaacaataaccatctcattcttaagattccaaccaaagtgctctgaatcaagaacatagtggtattcatccatgccccatatctcatcaccaattggaggactcatcacaaaatcaacttgggtaggctgtaaagggagcaaggaattagaactagacctggacttgcaacctttagggcaaaagaattcttcttgatgccaatcaatttggatgccaacatcactacaaagctttgcagctttcacaaatatgttatcaggcaagattccatatttagctttcaatgcagcacgaaggcttgtcttacagcaaacagaacgggcaatagacagaatatcaaggttgcttgggtggggtcttgtcttttgaatctttgaaaataaagtcaatgccacgtctgagcattggaaatccagtaacctaccaagggtggtggtctcagattccacaatgtgtgatgtatccatagatagatccaagctttgagccttaaaatgtttctcaactccagaactagtcctcttcttcaatgagccggatggtcttaaacttttcttgaaggctgaataatagtgccgaccacggttaaactgatacttttcacgtcctgaagggatatcactgactgtacctgagtttgtatgagcaacttgatggtggtggccaagatctggcaaaagatcaaacatcatcccacataatctgcaggtgaacttctgtaaaccatcatccttaccaaggttatggttatcataaaggagctcatcacttgccctttctgttcttttgatagattgacccctaggtcgtcgagggacatgatccagaaggctgaaatctcgagaatgatctgaaacaatgtgctgccataaaagatctgtgttcaaaaagttgctgttgcacgatatacaacgtaagagtgtcgaatattggagatactgagcgccatgtttttcctgcacgtgcctttcgagaactcttctgttggtaaatgagtccatgcatacagcacaagaatagcctctgaaaagccaccgcacttcttttttgtgaacctctgtccagtgtaatccaagtccttgatcatcagagaactcctgagaacatattttgcacttcagaccaggtgaaggatgtgtcccatcttcacgtaacaccatcactgatccatcttggttctcagaatgcatttgattagagctatctgtaccaaagccccaaacatgtgaaagcttttctctctcactagagatcagttttaacaaaaattctccaacatcaggattttttgacacttcagctaatatctggggcatatggtcactaccaagacccgggcgttggtgagaaagattgtttctcaagaaccaataaagaaactcacatgcctgatgtaagcacagtttttctttccttgacgtgcaacacttcaaaagattgataaagacatctttagagatgagtcgactttttccatttctggcacgtttaaggaacttcggtatgtgcctctcacagtaaagtgtgtgtcgtacggcataatcctggcattcagcaatattgtcatgagagcgaattccaatgcaaatagaagcatctaagttagagttttccatggaagttgacatggggtagcagagatcagcgttctctgacacgttaactttatcactagttgtctcaacagccatggttggtgtcactttcatgtgcacagcaacctggaaattatttgcctgctctgagcctacactacaagttgcatttgaggaagacatcttctccacgcttttctgtgactcttcccacttacggccctcagacgaacttaacaaactatctgagctcattgcatctggatttgtttggaagcggtgctttttacaaaagataaaaccatgctgggctcgatgcttgcactttctaccaagattagtcatccccccacacagtggagtttcaacagtaagtgacttatcttccctagacgaatggtcagcaaaatgcatactttgatgcacacaacagtaaatatcaccatcgtttgcccacctaccacattgccttccttttgcttctatatatgcagaacactgccgagaactcttgaatgaatccaattcatgtctgacattgtgtaaagcactatttggttctccagtgtcctggacaccagaagtactggggaaggcagcagttttattctgatctcttgactctaatggtcctacagcttcatgaatgatggagatactggggaggttacttttgtttgggtcttcacttaatgtgttgaggttagcatcatcctcttgtgaaaaatgagcttctcctctgcggacttcgagtttggaatgttttatacgagcttgttgatccatacctggatcatcataacaattgtgttgttcaaagttgccagcattgccaactggatgagatgaaaagaactgtttcatgacttcctgtttccaagttttccactcggggactaattcaggctgcattggtgcattccacaattcatgaaccttgtcccaaagaatagcttgcctaagttcctgtgtggaaagggtctttagcaaggttggccaagctttaaatagtgtgagaaacagtagcacatcaagtgtaacaagggaataatcaaatagtaaagcacgtgtagtgcagatcatttccattattccatatattatttcatcagtagcagacagacacatagttagcttcaagaaagtcaaactacataacaaggtcaaatttctacaataaactgaacaacttatctctcctatttggcactggtgatccacttgctttaacaaagagtgccacaatgtccaagagacaatgctttggaacaacttcccaagtgactacaactgggtcactagcttagtaatcaaacagaccaatatccatatgatttcaagacagtggtttgaaatcttcaagttcgatgtgcacaaaaatacactttcatcttagacaagaaagacacatacccaaattaggaatctatttcatgccatctgcatactattccgtccgctaaataaagaacagggtaaaaaaggataaccccattttgtagcaaaccaaacaaatgatcccatggaaacacaaattcagctaggatcacaaaaactataaattaacacatttcaggtgaacataagccacacaagcggactgtatgatgagacaagaaagtgagctagccggtgcaaatcatgagaaaatattatgacctactgtggtcaacatttatacagcccatgcaaggattgcaaaagattattaatgtgacactcaataattaagtcaacattatctatttttacattaaaaaaaataccacaacatttcagttcatgctgaaaaagagaatggacatggcagccactttatttgagatgtgctagcttgaacttagtctcacgactaaaaactatacatgatagaaaaggaccagatcatccaaaaacatattaactactcactccgctaaccagcagaaacaactcatacaaactaaatcaaggttcttataaaaaaatggtgaaacctagacaataacagaaatccatattacctcggtaagaatttcaacggtctcggcatcatgagcattattgcacttttggctccacaagtgaaaagaattttgcagccaatgacaacttgtgtagtctggaagaatcatctgaaattaaacagctaaggtaaactattgccaagaaacaactggaagaggctattgcagaatcatacatttatcttatttctgtaatatcgctagatggcgtaaatttgatgaagcggatgatctaatgaacataatactgcgcagaaatatttgtataacatttgacctcattctcatcaataagatatacaacctcgagccataaaaccaatttcccttttttcacaatatcatgtcaaccataaacaaaattgaaatttgccaggataattatcatccagtgtatcctttgggattgagcaacctcccaaccaactgcttataacaatgatttagcttttcatattaatgctgcaaaataattcctattaggcgttgtgtcaaaatgtacgtctcaattttctggcatagttatgtacactagtatcatggtagtaacagttcatgatatgtcctacaaatagataaaataaaaaaaggtacacaaattaactttgttctatccagaatgtgcatcagtgataaaagggataaatagcagccagaaaggatatcattcataaaacagtgagcgaccaagaaatagagcatcgtaagaagaacaaaacagatataaaacttgctacaagaaaattgaaaggaggttccatgatatatctttaaggaatagagtgcttagatttacattttgaagtttgacaagcatcttcccaagatcagtataatctctacagcaagatgcttcccgagcaaactccttccaagttgtggccatccgagcattctcaactacagcctattaaacatcagaaagactgtcaagacgaagtcatcggtgctacaggaataccaatgattcatagaagaaatagcagacctctgtatgaagctcgtcactaaaatttagcatggaaatagcaagtttctgcatgatgaatcgtcgaggaatactcagatccttcactagctttcgccatttgcgatgagttccattaaccagtggcagaggatattcctcaattggacggacaagtagcatgtctacccaagaataagttcttgtacgggggaagaaaacaatgatatagctcttcctgccatgtgttggttttgcctttagagtagataaaggacagtccactctaaagcattgaattccagtttgccattttcctctccactattttcaaacaaaagggaaaaatgatagttcagagaaggatcactgaacagttgtgagaaatcagcacgcaaaggagtagaaaaggtaggaactggtgaatggctgatataagggtccatagccaatcttctgaacagctcactgatcagaaaatccccttttttctagaaataaatgatattcaagtttttatgcttatatgcaactcatatacagttatttaaattgcagaaaactggttgttgacctcagaacagtgatataaatgaatggaatgaagtaataaatagaggaaagttgaagtatttttctttcagtaataaaaatcaaagacaacaatacatcagagaacttagtccaagtcatacataaaatgcatatatgtttatgggacagagagagatcaagctacgaaaattatgtaataccaagaaatgcctcgacttggaagacaaactacctagtaggaacgacccttgaaataagaaaattacagctagatcgaatctcaagcattggacagcctttttctctaggagcaataactacaactaaacaaccctcgagtgatatcctatctcttcaaactagcacagttatacccaggtctgctaattcagctaaaatcgtgtataaaacaaatgcttgtgtattttccagaaaattttttaagtttcagaagattacaggacttggacactcaggtgttatatttagacattaaacaattgatattgacggcaactaaaactaggactgtatccttttctaatacaaagttgagtacaaacctagcgtgtatgttactccctccgtttcaggttataagacgttttgactttggtcaaagtcaaattgtttcaagtttgactaaatttatggacaaatatagtaatatttataatactaaattagtgtcatcaaatcaataattaaatatattttcataataaatttgtcttgggctgaaaatgctactacttttttctataaacttggtcaaacttaaagcagtttgatttgaccaaagtcaaaacgtcttataacctgaaacggagggagtatgtaacatcaccaagttaacaatgacccttggatcaatcaaatcatccaatccaattattaaacatctcctaatataattgatgatattgggacaaacggtgcttgggtttggacaccataacttagctttgaactaattatgttcttaacaaggttgtcaagttgtaaagccaggtcgagtcaggtggtctttcaaccgacttgctgactagttccaataagttgaagagcagtcttttagactactgccacattccttcctacttgggttgttctactgtggttcgctgctgctgatgcccttaatctatgagcatggcaataaaacagagataacagaggagcccaggaaaaagagggagcatataaggaaaagatagaaaaataaacgcacgggagaggtacagttgttgcttgtactactactagctgctgagcacgagagcaaaatagagagggaagagaacaggaaatgaaaaaaataaattaatggatgagaggagaggaccctgagtcatcacctctcgagcttatcctctgcctagcggctggcggctggctatatatgggggaggaaacctaacagctccgccatctcccttgaacttcgtaataacggtcacagatgggtcattgttgctgccttgcttcactacatcttttgcagcaaccaaatcaagacttgggctcgtggccctcaagtcattcttcctggtaaactacttgattggccatgactgagacacaacttaataacataacagtggctcttgaaaatttttaaaaaaatagatttcacaaattgaaagtgtagcaaaaattctatgttatgcctattgctactcctgagggtccaggcaatccaatctagttctttaaaaaatctagaaactttacggcacccacacattgtgttcttattaaattcacaagaaaatctatgactagatgtagcaaaaaatttatctccacggcgtatgtaaaggtctcaacaatccaatatgttaaatattcagccagattcatatagttaaaaataagcaaatcgtacctttacccaaagtgcaacagtctgatcttctgcaccaacatttcctgtattgggatgaccacttctataatgagtattgccattacaactgttgttaagaacaagctgatccatgttgttcttaggtgagacagatgtctcattctcttcctgtggagaagatattttacgtactggatcaatgctgcaagctatttctgacagatcttgaagtgtgcactgcaattctttctggactgcatgacattctaatgtatcagttccagctttattacttaccatatcagatccaacttccttgttccctttgacttgttcttcagtaatgtccttgtcttgagaaggctgagcatctccattggactggcatggcctaagtacagtcactatattggcaggtggatgcgtctcttcccgagaatgaggtgcatcctgattactaacactctgttgattgacgtcaacagacgtgctttgaggggcatcattttcagtgcttagactcaattgaaatctaacatcattgaagtatgcatcagaaccattcatctcttttgggggctcggcatgcatcttctgaggtaaatctgacaagttagcatgagacttttcagaagaaccatccaggttctcatatatgcttgttcgagaacaattgttaacttcaacaggcttgcagctaactgtctcacttgcaggatgagcatcagaaccttgccacccatgatcatcatgtgacaaggcatgtgtcatattgtaggtaataggtgttgttttctccaaatcattctgtaattggcaatctacttgcataacaggagggtccatcagcatttctttggtatgttatgatctgccaatccactatgaaataaggcaggactagcgtgagcactgaaagaacaatctcctgctggtttgaagtccataaacactagtgacttattcaacacctagaagaaaaaaaaaaggtgttgtttatagtatgtacattgtacaacagaagtgtgggacaacaaacaaaacaaactggaatagatcaaaccagacctgtaatttaaacaaaatgtcaaagacggtgcagtaattaaaagaaatattgcattccactgcaaaattcccgaatccccttgatgccatcactccacatgtcagtgaaacaagggttggctgatggcatataagagaccaagagattttccaatggaaaataaggaatttccccttatcattaaagataatatgggtaatatgaatatgtggattgcccactgtactatatatgcatcgatacatttatttggttttgtttctcatcctaatttcttaggatccataaactattaagagtttgccctgaacaaaacttgctctaccggacagtagaaggtaaagtggatagacaccataataacaaatagcactgcaattgtttacagtacgtaataaaaaaaacatattacagtaaaggtattcaggaatcaggaatacatgcaatcaaatgataatgcactaatagttagactagtacaaagatatggcacattcctctggaaagtttaacaatgagaaccatagcaccacaatatgaacttaacagaggaaacaatgcttgggtttgaactatatggcatgaaatcccagtcccctaattttcacaaaaacagatgaagcaaaatcacatcggaaatatgaggagttggttaaacgtgtaaaatcggtgcgaatacgtgggcattgttgcagggcgggtcggcagcattaactctacccaactcatcaaaaccctaacggcttgtttcaatgtgcaggcaggttctcgcggcagaggaaaaaaatacactgggaattcaagcgcccgtacgaccctcaccacagcaaccaccgcttcctcgggcgtttggtcgatgaaactaagatccctaaacgtattagtgcgcccagcgacccaaaccccccaaaacagcgcggaacgtaaccgatcctgcgagagagagagagagagagagagagagagagggagaggaggagaagcgagagatttactcattcaccctccgcggcgaggcgcccgcgtaagcagcgggggaggcggcggcgggtgcagcagtccacggacgccgttggcgggcgcaggccgaccggagcgctcgcgcaccgagggggggtcgacggtgggtggggcccagcagcgtacggcgtcgagcggggaagtcgggcggcggcggcggcggcgagaggaggtggaggtggcggtgggcggtgggcggtggcgacggaggaagaagggtttgcggcgtggcctggctcggcctgcgacgtgaggggagggagatggggggaggaggaggtgggcaggcaggcagcgtgcgcgattccccgcagtaaatgggaaatgggagagagaaaaaaaatatattgggggaattagaaattttcaccgggttcaccggcccgggccgcgaatcccacgcatatgctcctgcgagcgcaccgtgtgtcgccatgtgggccgctcggctgtttgggccggacgagacgagacggcggcggcgcggcccaacttaaacggtcgcgggcggcaagtatcccgtgatccggcctcgtttcacgcgcgggcgcccgtgcgtggcccagcttcccgcggccgcctccaccgggagtagaatgtgtgtgtccgctggtgcgcacgcgtagcggaagacggaagctaagcgctgttgctttggaacagagaggattccttcgtcaggtaaggaccaacctggtttttcagccaagatgtttgagctgatcccgttcgttcctgtctgctgttaatcagctaaagtacgatcaaagttgctcgagtgtgagatctttacctccttttgcatacaggagtggatggaattcagattaggtgcagttatacgtgtaactgcaagttaacgacggtatataattatagccgtatgttttatggttaatggttcagattcaacgctaccgtaaacctgtgatcagtgctcccatgctatagtatttcgctattattactccctctatttcacaatgtaagtcattttagcattttctaaattcatatcgatattaacaaatgtagacatatatatgaacgtgtgaaatgctagaatgacttacattgtgaaacggaggaagtacatcgctatggctagaacagtgtacaatctagactgtccgatttacattcaatggtacccgctactaccgctcagttgcaatcactacagatgatccagattcgaaattataacatgccaaccgagctttacccagtttaacggtcgtgaccaatagtatatgtgttttctattcgttgccgatgtacggtggatgacgagaaaacaaatgaagcgacgcggctgtcacggcatcgcgacaaccgaccgtgtcacgatcccagctgcgcatgcgaaactatcgcgcgccgatactactgctactgctgccggtacagcacggccacagatcatatactactactacatctctctcgccttacttaacactgtctgtctccagcaacatgtcaatagcttaatcacacccccattaaaattaaaaaaacgcactaatcgaagaattgaccagccaccacgaactctatcgtgactggagaaacgagacgttctcgaggtggttcaggtgaacccatccaataggaaaagataagctatagctcgccggcctgccggtgatgagcaagtcttgcctaccctgaaacgttctcctcctcctcctccctacaaaaatccacaatttgcgttgcggatgatgccttttgtttgtttgttaattgcaacatggcaaccttcgtttctgccgttccatcgctgtcttgccaaccaatcgtccactctggcctactgctgtgccccttcttctctccggctaacaaccgagaaacagcagagacaaaagcctcttctcctctttttaagaggaataacagatgtagagacagagatgagaaagaaaagggcaataacatatcgatgaaaagatcttgcaatcatggcaaaggtatttgttttaagtataagagctgtgctgcaaaatgaagcagcatgtcggtcaagggtttacaatctcggagagcacaaatctacaggaagccgatttttttttttaaaaaaaagagggggtactccaaaacgaaaaaaaatatatttcattttggcacttttttttacctaattaaaatattttttctaaattaacaaaaaaatgaaaaataaaaatcaagttttctgatgaaatagtttcgttgtttcgtgctaggggggggtccaaaattctcaatttcttgtaccgagattgcaaaccctgtagggattaagccacattatggacgtacttagaacaaattaatcactgatgggaatgatagtagtatgataccgagtgggttcgcattctttccttgtctgtctctctgcctgtggttcatccgttccctacttttcgttagacggaacaaaccaaccagcgatcgatcgatcgatcgagctcgaaatgcggtggtggatatatgttgccagcagatgcgacgtccaatttcaacgacaagcgttttcgcgagctcggcggtgacggcttcagctcaccaacccaacccagcaaaaccgcgaaaccaaattaacctgcaaccccaagagagaaaaacacacgtcgctcaaactgaataagaccgttatttttgttgacacatcggtcgatcgttcggttcgttggtgcccatcggattattatgcctgtcaatgtgttatgcatatgccatatcgtttaaacacattatgcaattctgtagtatcatttattgaaaattgttatgcgtacgataaaattgatacgattttattacaatcctatcttgcgtgcgtacaattggaccacgaaaatacgttgattgtaaaagattttatcgtgtgcatagcagtgctcgttatttatttgccagtagctttgaatttttttgttctatactttgcgcttaaacatagctttaagagaaaatgaccatgttacccttgtggcttagcggcggtcatttgcactaatatacaatcattaaggatgctgattagccacgaatggattaagaaacgcttaataatggaactactagtacattttcacggcccgccccagtcgagtgacagtcacgaggcacgcgacacgtaaataaatacggagctcttaattacgcttcgtcctcctcccctcccctcccccctctctctctctcctcgcggctgcaaatcgagaggaagaggaagacgagaggagaggagagcgcgtggcgtcgagaggaaaagccggagccattgagccgcaggcctcctcctcgcgcgcgagcgcggccggcatctccggctcggatcgagcttgaaggtacgcgttgttccatccgtggtccctccctttcccgcgccatttcttgatgggacacgctgtagattggagatccatccggggattggtttctttccctccaatttgacccgccatgtttcttcgggatttctttctttcgatgcgtttgtgcttcgctgatagtagtagcggtttgtttccaggagaaattggggggcttgagctgaaagatcttggtacaattctcccgcaaaatgcctggaattatcgtggatggagttgtcacagaggaggcacaaaacgaggtgaactcctcgcagaacaaggacaattcgtccgccccaagatcgccggtggcttcgaaaagcatgcacagcgaggcgctggagatgcatgtggagggttccggcgccggggagccatcgattgagcagctctacaacaatgtgtgcgagatggagagctcaagcgagggtggatccccctcgcgggagagcttcggctccgacggggaggaatcgaggatcgactcggagcttcgccaccttgttgctggggagatggaggccatgaaggtaattgaggaggaggaaggggaagggagtggtaatgccgctaatgcggtaaccgcagctgagaatgggactcccgtcaaggcgatgtcttcgaattcatcgaagaagtcgtcgaaaaaggctgcgaaatcacagcttgaatctgagtcttctgttggtcctaatggcaaggcatccaccgaggaaggtgaggccgaggtcagcaaacccggaagccgagttggccgtcgacggaaagctagtcctaatccacacaatgggactgaagatgctgggcttaataatccagaccttggtccatttcttcttaagcatgcgagagatttgattgcctccgataatcctcgtcgggcactgaaatatgctcttcgtgccaccaagtcattcgagaaatgtgctggtggaaaaccgagcttgaacttggtaatgagtttgcatgttgtggcagcaatctactgcaacttgggaaagtatgacgaggctgtacctgtactacagcgctcccttgagatccctgtaattgaagaaggtcaggagcatgctcttgcgaagttctctgggtgcatgcaattgggggacacctatgggatgctaggccagactgcgctatcactgcaatggtatgccgcagggcttgaaattcagaagcagacattgggggagcaggatccaagagttggagagacttgtcggtacttggctgaagctcatgtgcaggcattacaacttgatgaagcacaaagattgtgccagaaggctcttgatatccacagggagaatggtgagccagcctcattagaagaaacagctgataggaggctgatgggtcttatctgtgacacaaagggtgatcatgaagctgccttagagcatctggtgatggctagcatggccatggtggccaatggccaggaaactgaggtagcatcagtagattgcagcattggtgacatttatctctccttgggccggtatgatgaggccgtgttttcttatcagaaagctcttactgtattcaagactagcaaaggggagaatcatgcaacggtggcctctgtttttgtgcggcttgcggatctatacaacaagacagggaagctgagggagtcaaaatcatactgtgaaaatgcccttaaaatttatcagaaacctattccaggaacttcattggaagaaattgctaccggtttaactgatgtttcagccatttatgaaaccatgaatgagcatgagcaagcactcaagttactccagaaggccttaaaaatgtacaacaattctgccggtcaacagagcacaattgctggaattgaggctcagatgggcgtcttgcactatattttggggaactatggagaagcttatgactcattcaagagtgcgattgcaaagctccgcacttgtggtgagaaaaagacggccttctttggtgttgccctgaaccagatggggttggcatgtgttcaaagatactcgataaatgaagctgcagaactgtttgaggaagctagagctgttctggagcaagaatatggaccttatcatccagatactttaggagtgtacagcaatcttgctggaacttatgatgccatgggaaggtaagctccgtattgattcttgatcagttttttattttttacggttaatagactcttacatcggtagcaaagctgtgaatatggacatcttcctcatctcgcagtatatcttggacttcggcaaattaactgctagcttttcatctgacttttgttctgttagacatctaattatcaccagccatctagataatattttttttccaattaaaatttacaaaagcaaagggtccctggtacagtttatcttaatatcctcgatgatttatcacaatgtgaacatggaaatcaatatggtttgttctcaactatggcactgataactgctccatgtgaccattcacacagtatattggtgctctttatgccctggagacagtagcggtgtgtagactcttatgagtgccaattcttttatgtttgtcgttcgcaatttgcatcttccagcttggacatgattggtctctttgtgcagccttttgcagcttcaattgaattgagctgatattggttgttataaagtgggatcaatttaattgaagtaggaccatattaagacaatctttaattgcatgtagccagctgctctgtaaaagaagagttgcaaatactttatcctcttgctttatcctgcccatttgctttcaattgtccgtgtggaaacttcatgctactttgtatgtcatgtggattgtcagctttataatattctttataattatgatgcaagttttgacctaccaatacagctggcttcttgataagaactaacaccctagtttaattggctagatcagaattctgaagaggcatagcaatctttctgagatacttcttaaaaactactaatgagtatctaaagggaaaaaaaatgtatttcacatcagcttgtttgctcaatgcgaaaaggtttttgatttgtttcttagaataacatgttggtgtacctgctttcctatgttatccaggctggatgaggccattgagatcttggaacatgtagttgggatgcgcgaagagaagctgggcacagctaacccagacgtcgatgacgaaaagcggaggcttgcagagctactcaaggaggctggtcgggggagaagcaggaaggcaaaatccctggagaatctgctcgagaccaacccatatactgtcacgaagagaggtacagttgcagcatgaggcacacactgctttgcgaggagaagcttgatgcaagcatgacgctaaggtgtatcaaattgggctgtttttcttttttcagatttggtgagaggggtaattgaaaataggatttgttttgagaatctagaaatgtcaaatgttctgattaattgttgtaaagttgcaaagtatgattcgctaccacttgttccctgctcatggctcttcaccgtgcttgggaagtaaagcgctgcttccatgctatacgcagctgagcttttataactttatattgtagacagtgtgagactgaacagcttggttggttgatattgcagcagatatcatgcataataaattgtacaggcatattacggttcaattttgattgtaagatttctgtttgcaaaagctaccagctacgaaagtgtgagccatcaattggatgatttgatatgtgaagctgaagttggataagaggcttagacgcatatgagttggaaaaaacagtagcagtagtacccaaaagatctgtgcaaaaagttataccgctggaacatcatgagcagaaaaaaacttagtaaatacgaactgctgcttgatttcagcgaaaataagtttgaggagattcgctgagctaccagcatgatatgtttctaccgaaaatacaagcttctgaaacattaacaatgcagcctacccatcgtaatcattagttatcacttagtgctaatacttgatacgagaaacttgaagccgcttttgctcccgaaagagaattgtctagtgaccatacttctggaactcccactcgctgttgtctgcatagataaaatagaaaagtaaggcacggtgaacgagcagaggtaacaaccacaccaattaagtggcattttccagggcaaccaacctagagggcacacttgacgggtcttgagccaacggctgatgcagtggaagtggaatgcatggttgcaaactcctgacacaacaaagatagattgttcatcagtacatggatagttgacttcacagctcgatttaattcactgcgaaaatgcaatatccactaaaagcaacacaaaaagacgagaagaatccagttacacggaaagaaaacaaagttccataatactcccccaggagagaaacttcagtattataaatatattgaacatagcatttgactgtgcaagtcagtattgtttaattcaaaacaatacttgaacatataatccagagggcacacagaaggtgcaagtgtacatatccctaaacaacaacatgctgtaaacataagatcagtcaaagtagattaaactgtgggcagaagaagaacatattaacatgccgggtagccaaggaagatccacacacaagaatctcatacaaatatataaagcaattgtagctaaaagcctttgatgaaaatatacaccactaacttcaactagttccagatgcaagaattcacttccatcaattgacacagctaacatgaacactcacccaccctccccaacccacattccagtgattctctttgacaaatcataggaactaggaaacccagacatgaactgtattatcatatttgagtttcatgtgtgcatagttcaaggtataattataattgaacagtagatggttaatccagaagaaggtactcctagccagtagccattcaattatcctatcataactacatacttctttatgaaagataaattcaacatattctacaagggccatgtcacgtccaaagctaactgcgacatattatataattatagacttagataaaaaaccaagagacaaaccaatatagcaaaccatgcataattatagtacaaatttccaactatgaatataaccagtacatataaaagaatagaaaagataatcacattgcactcatttgatacatgtccagtcaaaactactccagatcacaagaacttgcaattatcagaatcactaataataacatggtattgcaaatcacatgatcagcaacaaatgatattatacacgatattaaaaatcatgctctggtaccaataaatgacatagaggcggcagataatgcaggatccattaaactacaactcaattcaccaatactccagagcatgaaaactagaagcattcctcaattccagaacgaaggattcaaaatagcgtatagcaaaacagatgttaggattttatgaaattcgagagaaaaacattcctagcagcatataaccagtcttgggaaagcacgatccccagattctgataaatcattatcaaatgagcaaaccaatgacaaacaacacaaggcgacgtgtactgagagcacagtaacaggttgacacatggattaatttgactcaatcgaactatgaaatcaaagtcaaaactaaattcagaataaacagggcaagaccggcttcagctaactgaaaccatgcaattcatggctgaatcagcacttacatctactgctgcatcggcacagaattagaattaacgggagattaagaagaagcaatgttaccccaagcgacggtgcactcctcgctggtggcgctcgcctggttcgcctggcactcgatgcctacacaacacacgcacgcgcacccgcgtcatcacaagccataccaacaagctaagaagaaaccctagaatctaaaggaacagcagatcggagcgggggcgagcggaaggccagcggcgcgcgtgctcacagaggtccatgatgtggttgcggcagatggcgcagttgtccacgacgatgtctgcacgagaagaagaagaagaagaaaaccgcgacggaatcgcatcagatcgcacacgagaaagccaacaagcgagacgcgggcgccatcggcggacgcggacgcggacgcttaccccaggcccagagggagacagcgttccacttcttgatctcgaagcgcttgcccttcttggccccggaggaggaggcgccggcgatggaggggggcacggccacggcgacgtcgcccttgtccatggcgaaccctagggtgggaggggagcgcgaggaggaggagtagattgggacgagacgagaagcgaccgcgaggagagagacgagaggtaaaatagaaaagaggaggcggcggcgcagagtctaataaaggcctcagtccaagcccttgtaggtacagtattaacgggccatcaaaagcccaaagtattaacgggccatgcttgggttcttgctgaagatacagtttttctcttaattctttttggtgcatgtgtcatgtgtgagagagtaaatttattttaaatatcacaccaaggcctatttggggaggattatttgaatcacctagtgagtactcccttcgtttcaggttataagacgttttgatttagtcaaagttaaactgctttaagttgaccaagtttgtagaaaaaagtagtaacattttcaacacaagacaaatttattatcaaaatatatttaattattgttttgctcaaactaatttagtgttataaatattactatatttatctataagcttagtcaaacttaaacaatttgtctttaaccaaagtcaaaacgtcttataacgtgaaacggagggagtagtagctagttgatgagaatatggaaaatttgtgtttcttatattctaacttctattcactcagtttcaaattacttatctcgttctagatttttcataagtcaaccatttgaatatttgaccatcaatttctacaaactcatttagcttagcattattagatttatattatattttcagattgaccatgagaaatacttttatgaattataattcacgtgttgttgaactacacggatttttataaactaatggtcaaagatatgcatatttgacttaggacaaacctaaaacacgtaatttaaaacaggggagtaatttattttttgagtgatattttgatcatactttgttaaaaatattacaaaaatataattatattgttacccgtggtagttcacaattgccaaatatcctgaggcagacgagaacgataataatcgctgattcacgtgtgaccatgtgaggttggaccaacggcgtgacgtcaaagttcagacgatagcatgacgaggtgcaaaatcaagatccaactgtacgctgacagcagagctgacttgctaaatatcactaggcattcccacacacaggtgacaaagaagacaacagcaattccagtaaaatgactatgctcttttcccacgacttgttcgacattatatcgggattactagcgtctccaaaatttattgatactgggggctttccagtatccattacagacgatattgtataactctacgctctttagtacacagtttttaagcttccaagtaacttggcccgagtatcaagactgctctgttgcttgtgctggtatatgagtttatctatcttgaaattgtaaaatctatcagatatggtccccatgagaccaatgatctgagtgaggaccgtctatagctcgcaggagaacatcggtttggtgtctggactgagtactgaagaatgaagatccgttttgagacttcttggctttctctggttcttggttgaacttggtggtgagctttttaaagcagcatgtcgctgcctgattcgcttcggttagctccggttgaggctcttgaacaccaaatagccgaaaccgccaattgtcagggcaatgagtgggcagatggacatgtccatttccaggatcccgtttctgcggactgcatttccttggcgggtcaaggccaaatgctcatgaagcaagctggtcagattgtcaagctgatgtatcacttggcgctgacctcttgatatggcattaatctgcgaaggaaacagaaagtccaccaaaataaatgtcaagattcatacagaaagatgagtcatatctagaaaaataggtagtagtcagcaatcatgtatgaagtgttctttgttttgaaatatgattttaacaggaaaaaaacaaattcatcagaacacagagttttttttttggaatatgattttgacataagtaacataaattaaatacatcgggaatataaaatcttcgagacattatacagtacaatatcttaaaaaacatgccactgaaaaaaaagctttcacagcctttctgtcagcaaataaaaatggttcaaatcacatcacaacatttttgtgaagccaaaaaatttggagcatagaagtatgtatagttagcaatctaggcccgatgcaacatgccaagatcaactgttacaactccactgttttttatggatacattatttcactgcataaactacagaagctgattttcttcctatatgattggaagataaacttaagttccatacacttccctgtttatctattttcatgtgagtctaactgactactaccatgattctattctctatctattgtttctcctctcaaacaatagtaccagtagctgatggcccactaaattttcacttcagtctaaattcacttatttgaatactgactaaattaatacagtgacttgtacaaagtttccaattctacatctaaatttcaaacaaaatctgaaaagtgtctcgaaaataatagcaaaaaaatggacccatcataaccaatctattggtgagatttcaagtttgatgaccgaatctggttctggcatcagaaattcttttgaaaaaaaatactgttggcctttctgcagatgaccaagccatagttttagtcaatgattaaggtgaaatggtttgggagaatgcaactaaacacatggctgtaacacagactagcgaagattatattatcagatgatgcaattttaccttaagtatgacttaatttcaacaaacccacaaatccaagtggaaaagtggggggacaacacctcatgtataagattataataacagtaaggcaaatacctcatccacaatgggggactccttcaaaagttggttcgatgatgacgaatgaggtatcagggtaccattgcccaaatgagaaacaaagagatttgtaggtgcagaaccattgcaagtttcatttggaagagctaaattttgctgactggtcgatgatttctttattgcaaatttacagttgagttcttcaactcgagaggtgaactcgtccatcctctcattcaacgttgaaatctgttcggatagctgagtgatagcaccctacaagcagcagcaaacaaggaggaattttgagtcagtgttatctatgtcaagtttttcacaagaaaaaaatgttttaattagtatggtagctataactaatacaagtattctagaatgaccacctgattaattgcaggaggttcaggggctcgcccacttccaaaccttctgttggtttctgtcaatttactcaatttcacaatatttttatctccatgagttgaatatgaatgagatagaccactgcacagaatccacaaggtaacatcagcgagcttgattcagtttccatggtttcaacaaagtatagcatttcacaaaaaataaattttgagcagagatgacatgaagaaaccttttcaggtgtttgtttctcttatcagcagaaacccgagaaagggcctcttttggacttgaaaccagctcatcatcaatgctgagctttgtcttgagatcttctggtaatgcctgcatgtaaacttatttgaaaccaccccaaaactaagaaatacaactagtgctctagtaataaggtgagaagtgtgtatatatataattatcaaatacataccataacatcgtttatcagtttctccagctgaatttgttcaatatatgtgcgtggaatataagagccatccagacctaacttctccgctacaaatttgacatgatttctatctcttccttgcacctaagaaaaagcaacataatattttatgcatcttgttaacaagtggatagatacaaataataataactagagtatcagtcaagatgtgcacagagaaagatcatgttgaaagagaactgcaatcaaatagcaagagtgttcttacctgtatataatttcggttaagttgctccaaccaatcaattttaacagttgccttgccatcagaaaacacacgactctttctcttcagtatagctgctatagtatatcccaatgccatcaaacctccaagaagacgaacactgacttcaaacgtaatccttggtgatatgataaaaggattatcggtcacccactccttcaaattatcaataacacaagttagtgaacacaaatttcaaaattattgcaaatacgatatgataataaggtatagcaaaggagtatatatctaagctaagtagctaactgctgtggtagagaacaccataagtcagcagacaaaattgccaaaaacacggcagttacaaagctgctagtgaatgcaaatacaattaagactcagctgatctttcccttactatgctcgttatgcaattaattttttttgttttatgagctacaggtgcaactgttgtgaaaatattctagtaggaataagatgcatatttctggaacctatgagcatggcactagggaacaactaacaaagtggatataaaataatgggccagagaggtaattcttgtaacaaaacaaccaactatatccatcacacatatgcacttatgtagccattgcaataaattgcatacctcaaacatcagattatatttcccttccctattcctcattctcaaataagattggcatgattctggatcttcgcctggaggaagcaaatatatatcataagtttcttcaatgctttctgtatgatcttcaccaagagcaactttgatgtcagtaggtgttatagttcgtggagactgcaagagtacatttccaaaagttaggccatctagataaaccacaagacaagtatttattagtattaaaattatgctattggtgaagagatcaatgatcagccatcttgccaaaacatggacactaaaaggaacataaataaggagtgcttacctttagaatgtacataggattttggaaccctgagaatgggttgaacttgttgattatttttatatgtgctgtctgcaagtctggctcaatgaaagccttatacatcggataaacctgaaaaatgccatcgttcatcttgttaaacaacacagatggatgaaaaagatactatacatacaaaatataaattgcgaaatgaatgtttggtttgtattaagatcttttgtggaaacaaaagataggggaaaggcatatatagggtcaagttcaaaaaggtgaagcaaccgtttcagatatctgatgaattatttcctcaggctcctggccagctctctgtatgtccctcaggaccctcttcaccaggtcaaaatgaacaccaccagtgacagaaacacgtaggtccaatacagatcgtaacttttcactcaatgcatagatgccttcaatgataacaatcctagagctagggacatcaactgttctgtttgccataagaaaagataacataaagacatatgaccatatatttacaatactaaaaagtgacaaactgggaattattatttaaggacaaactacctgtatccagtccggcagctcatcttgaaatcatatattggaacctgaactgatcttccctccttcagaccatgaatattttccaacagtgtgtcgtagtctgttaggcgtggatctgttcaaatgtcacaaagatcagacatcactaactcagttaagtagttagttagcaccactgccgctcccaattgaatgcagctccaagcaatcaaactcactaatacttcgattatatcataaggcacgtacaacaatcatactattatcagggcatacatatgcagatgcaagaagtaactataagataatgcattcagatgtatgcaaagtattgttctgtgcttattaaggaaatctttcaaatgtaaaggaagttctgtccaaattacgggatgataagatagtatgcgaagtgcttggaacttaggggttaccatcaaaattgccatcaactatgcgacttgcatcattgtagttatccattgatatcacagcaacaccgggcatgaaattgagcaccttctcagtaaacacagtcttcccggccccagagggtccagcaacgccaacaaaaatcatcccttcattgtgctgcaccagaagctggcaggcacggatcataacaaagaagcctttctcaaatgacaatggatcaggaaagcggacgatttcgtagcgatttgtgtccttccttttcaccaactggacctggtcccgcagaaggccattacgcctccttggcgaatcagccatggaatcacttcggtccattcaaaggctgaattcaagaaaacacagtgacttacaatcattaaccttaactatcaagaatataacaacattctaaactgaagtccagtcaccaccatagtagaacacagtaaaaacgtgtacgaatgcaacaccatctgtcgaggtagtagtagaatttcttaacgatcctacttgttcccactaaattcaatcatgggaggaaaaccagacaacaaacagggtatggatcctgcatctacaagggattggctcttccgtgtaccacatggatcgcactacacaactgaaacccatggaaccgacctaacgtggcgcggaggcggcggagtgatgactacgagaaaaaccgaacacattcagttcgattccaaccttacatgaacgccgccccggcccgcgtgctcctacaaacctgctcccctcgccgtcaccggccgtgcgcgcgagcacgccgcgcacacaggggagaaggctgcgactgatttccggaagcagtggtcgaggccgtcacactccaccgcgccccgcgaggaagcgaggcttcctccgccgccgcgcgagagagagagagcgagagcagaggcgcccccgccaatgctaaaaccgcacacgaatcatccactagcaactcaactctcaaacagattaacaaaaccacctcccaaccaaccaaacccccccgcgcgagtaatctatatgcaacagggcgcggcagaattgtacggaatcgcagcagattaatcagggggaggaatcgcgaaaaaggaaaaaaaaaacccagtagtcagccataccgagatccccggaggaggaagcgtctggagactgcgccgccgccgccgcgcgcggaggagtgggggctgcttcggcggcgcttcgccgcggcgcgttctggggagaaggcggcgcgcgtgggggtgaggggacgggagggttgagccgaggaggagtagtagtagcctagtaggaagaaacggagaagagggctctctctggagatggagagggcggcgtcgccgtcgatccaaaaagcgctggagatcagtggaaactaggagatgaatcaaggttaaaacggtggggccatcaccatcggcctccctctcccggttttatataggactactactgctactcctacaagctttgatcatgtacgccaaatgcagggggtggcagctgtagtattttgcacgtatttctatgcgtattttgaacgcagagtttggctaaaaaggtagtcctcggggagtttggctgaaaacgtactccagtttaaccgtgacatgtgttaggtataatatagaggtatcttttctcgtattttgtatttgcacgaatcgtgtaaagttttatcgcattggtagaatatgactgtgtatattggacacggggtttggttaaaaagcatgtaacacgacatatctaggcgtaacaaaatgtctctttgcgtatttttcatgtacgaattatgtaaaaatattgtcacaaaaatagatcggactaacaattttatattgtgtatatatactaaaagtagaatttggtttaagagtagctaacatgtcatacagtgggcgtaatagaaagcctcttttgcatgcttttgtatgtatgaattgtatatagtcttgtcacataggtgaattagacttaacattttctgtgatacatgagatcatgttcatgcatattaaggtaataaactatcatgtagactccgtaagatatattggccaaaaatgacgagtcatgtaccataaattatagtcaaattaatatgttgtctcaacgtttgggtttttgctaagaaaagtgaagagcgtacgaagaacggatataaatcataagagtcatcgcctgctcactagacatgcattacgtcattgtggattttaaggaaaaggtaattaggcatgtgcacatttgttgaacaaataaagataatcttctaatacacaaaagctataaaaagaagtacatctaaattgaaagatatgataattaaatacatgagaccttaaaaaagcatcaatcaaagaacagcccgaatagacgatgcgcaaaggttttgcgtgttcggggaaaaaagaaagaacaccccaccaaagagaagacaataggttccaaagtctacctcaactcttctctcatctgatgtaacatggttatctacacatttttccccttagcagtcctttatgcatcttttgttttcaattaaaagtaattcatgaatcacatgtttaacattgatattgtgtttatcatttttatactacaacaataacacattcacatcatacattctagaatgttataaaaaaatctgagccaaaacaaaacaacatccaatattttagtcaaattgtcaagagttataaaacaagttaaatgtcaaactggaaaaaggaaaagagaaaaaagatatcttgggctctcaattttagt

SEQ ID NO: 67532 - DNA, 56063 bp, Oryza sativa
cttaaatgatctctcaataggcctatcgatgccctttaatgtcattacaaaatctgacagatcaacacatacatgaccaaatctaaggttgccttcaccgtgaactatctgaaacatgaccttacttgacattgtgcctgatgaaaaactaactaggttaactaagttcatatcatactaaccagatctaacgccgcattcatcaatacatactacgccctatctcttcaaaaaacatactacgccttaagttaaagaccctacacataagttgtttgccctatgtctcaaattctaaaaatagggtgtgtgtgctccagatctactaaagtatatggtaataaaactaaaatgcaaaaaaaacctggaaacacatttcgaaggaatatattacctgtgatagagtcaacaaaccagcagggcttcgctgctccccttctcctcccccctcacccctccctctttctcttttttcggattttgagcgaatagaatgaaaaatcagagagggggaaggggttttatacttggaggggctaaaatcgccctccctaagggcggcaagggggccgcttgcaaaatgccaggctgcctcgccgcccttttgcaagggcctccgcacagtgttaaaccgccctccctaagggtggcaagggggccgcctgtaaaaaaagccaggccgccctcgccacccttttgcaggcggcctccgcacagtgttaaaccgccctccctaagggcgcaagggggccgcctgcaaaatggcaggcccttttgctgtccgttacttatgaggcaacagccatctgccatgtcattaaaatcgccctcccaaagggcgctgggcgactagttttgtaaatttttgaaacacaaaattagttttgtaaatattttaataaaaaattaaaaataaaaaaaattgtttcaagtctaactggcttcgccacatgctggtgaagggactttgcttcgccgcttggtagatgcttcgccgcctggtattcaccttcaccactggcaggtgcttcgccctttggtactttgcctcacaacttattgattgttttggaaggttcggttgaaggcacttgtgatatgcctataacacatataaagtttaaatctaccatggatttgagatgtggagttgtgccaaatagtaccacatacacttttcccgttgtctcttcctctcacgctgcaatgcgctcacgacacagcacccctacctagtacctttctcaaatgtcagcgagtctctccctaacacaatatgatacggagtcaacaatctttaaccataccgttattacctctagtcaacagtatatgattcaaacaagccacaaggagaaacaatatcgtaagacaatgtgagtttttaaactaagaatttgagaaattattgatggtagaaatttcaaaagtatagttaaatctagtcctaaacgtcaaatattttagaagcatacatactgttgcctaatgtgacatgaagttacgcattaacatatgacatgaagttaagcattaacatactgttgcctaatgtgacatgaagttacgcattaacatatgaaggtgatatcgtatatcataaattgctacaatgatatagttatcgcctacaaacttgctatgtaaaaactcatttctttaatactatcaataagaatctcttgatttttcaaaagagaaaatttatctcatctctgacatttggcgaagagtgtctcatcattttgttagttggcttaggaagaggatcctctaacttacttccctctgactttgagtcactgagggaagtaagttagaggatctcaatccgttgggttatcaaccatgcacaaccatgatctaaattttaaaaacttaattcaagtttattttctgttttttttcaccataattttttccatcatttaattttaagtccctaaaaatatagttataaaagtttactcataattaatacttttttattgactcatttattattttcatggtttatcattcgtagagtaaacgaccgaaagtgagaagcatacgacacacaagatttatccatgtaacaaaagagtttatcatttatttgatcgatgattctatgcccttgtttagtcctcaactttttttttcaaacttccaacttttccatcacatcaaaacttttgtttagttcccaacttttttttcaaacttccaacttttccatcacatcaaaacttttctacacatataaacttctaacttttccgttatatcgttccaatttcaatcaaactttcaattttaatgtgaagtaaacacaccctatatatcaatgtgttggattaaagctggacgaaggattgaattgtgaaatatacaaaacaaacaacttagctgcagtcaagagtgtgggggtaaaatcgagagaagccaaatttggaagaggaggaatcatcaaaggagtgtccatctcctttgcaagaagcagtgatgtgatgatggtgaaatggaagaagttggcgtttgggaaaaaaggtcgctttcgaggtcgagcagagaaaaaagggaggcctttgcgaggcgaggagagcgagacccctgtgatcccaattaaccacccgccaccgccacgccgccggcgaccccctcctcggcgagatcgagatcgagatgccgcccacgccgccgcctgagctggacctcctcgacaccgagccggagttcgccgaggttgaccccaccgcccgctacggaagggtaataatgccttcttcttcttcttcttcttcttcttcttcttcttcttcctcgattcgcttctcctcccatcctttcgactcattcggtgatgcatgccgcctcttgcagtacacggaggtcctcggcaagggcgccttcaagacggtgtatccttcttcccacgctcgatttctgggctttgacgtgcgattccgtatggttcccgggccgttgtgctgcgtctaagattcgattttggtgcagctcatggtgtttgtttcggttctggatgcatttttttcttggggaggataaataatcttcagagctttttgatgcgctgaattcacattccttcgactttttttacctctcctcttttgggatttgaatactagtattttgttttgttgatttcaatgtgtgtttggcattgcctgctatgattacttgaatcaacattgccaatttgtcatgtcaagctcccattacctctttctagactgaatggatctctttcatttctctcttcttatcgggtgcatttgattggttggctagtgttccaatcaatttacatcctcctatgatctatctcacatttgttctaattcaacaactgatttgagaaatgcacagggaagctgctgtgaatctttggttggttgttttgtcatagtgtgttttagtatgtcactcagaactgtccacgtccattaaggcattaactaccgtcaggattccaactgctcttatatgtaaaactaaactatgttgctactttacactatatatgcagaagggtaatcttcatgatgactaccagcttgatagaataatttcatattatcatcatgtatttgtagtgttatcaaggttatgtacttatgtcgttttcatgtgcacagttcatttacttatgaatgtcaaacctgatacgatagcaaaacaaacttcttcctaggtgtttgcagtattagttcttttttttttaaaagatgtttgcagtatgctcaaaacaaagcatgtatctttgtgaacttctcctgttattttctccaatttcgacatggacttgagatccttaattcaaattttactggcatagctataaggcttttgatcaactggaaggtctggaagttgcttggaaccagatcaaagtgggtgatatacttcggaataatgatgacttggagagacttagatcagaagtccggttgctgaagaccctcaagcataagaatataatcaagttctacaattcttggctcgacaagaaaaacaacaacataaatttcatcacagaagtcttcacatcagggacactgcgccagtttgttctcttgctcccatctgattataactatgctctttgaataatatgaacaaactgcactctgtcgctgacacgtcttatttaacattagttagctgtgtatgtcagtattaagtcaaagaaaatgatacattatcaatgaaagtttgtactggttctcaagttcactcttcgggtcctagcatggcttcaataaccaaaacaggcaaattttgtagagccaaccggcatgctagacacatgcaggtctataggatgcccaaattttctcactgagaattttcctatttctctgtcattgtttaggtaccgtattaagcacaagaaggtagatgttagagcattaaagaaatggtcaaggcaaatcttgagtggccttgtctacctccacagtcatgatccaccagtaattcatagagatcttaaatgtgacaacatatttgtgaacggaaaccagggtgaagtaaagattggagaccttggattagcaaccatcctagataatgcacgctcagctcacagtatcattggtatgcattttattttctttttattttactaggaattgaatttatttttcatataacctctgttttcttgtaggcacaccggaatttatggctccagaactctatgatgaagaatacaatgagcttgtagacatctatgcatttgggatgtgtttattggagcttgttacatttgagtacccatattgtgaatgttccaatgcagcgcagatatacaagaaagtatctgatgttagtctacttatcctctccattgcttttaccatttcttttctgaaaattggatttgattaggtaatgatcctgtaggcttatattgaaggtgtattttatatatatttcttttatcaaaaaggtttattcattgcttaccctataccatcctggtgtaggcagaagatgaatttccattttgagaattaaaagcatggtttaaagacagtatctaggattctttttctcaacgaggattgtgttgaaatcatggtttattgccatacaaattgcagaagtagcttcagggtttttcaggtttttattgtgtaccagaagttgacttaactgtaggttttaattgtattactttgggctgtcatagtgggtccattgataaattacaccatcatatgggtggtgtttgaatagtttttctttgtgacagttactaccttggtcacagtctcacagatacaaattaactataactttcagtagctattccttggaacaccattgtactaaatccattggcaacttaaagtttttgatgaaattactttgttttgtatgtgtcgcatatgcccaaggcaattgatttcctatttgatcaatcatcattgtagaaaatcatgttacattctttttttaaaacttgaatcatgttacaccctattactgtctcaatctcttgatgctggtacaacagggtgaaaagcctagttctctggctaagattgaagatcctgaggttagattttttatcgagaagtgcatcgctaaagcttcacaaagactatcagcacaagagctattgatggacccatttctccgagatgatggtgaaaaaatattctatccattgcagtcaaatacgaaggcatcaggtaatgactgaattggcaacactataaaattgttcccttccccatctgaccttagataaacatggcagatggtgctggcagttcaaactcaagcatgggttacaaatatgacagagatgcatcatctatggcaattcgggagcacacaggtagaagttcaatgacgtgacagtgatgtgaacactattgcattgttctgaagcttctctcctttttacatatcaatcttatgatgaaatgcaggtagttttgcagaagaacacccaagtgataggtacatacacagcaccatggatccacaagcagccgctggtcgaataattacagtcgagagtcagatgaaagatctgaatacgatatttttgaaactgagaattgctgattcaacaggttttttttattgtggattcccattttacttctcattatgttgttcggtgtttgtcctctattacacttttttgaaatgcaatatgcaggtcatgctcaaaacatccatttcccatttgacattgaagcagacacttccattagtgttgcaactgagatggtcgtgcagctagatctcactgaccaggatgttacagcgattgcagaaatgatagatgcagaaatacgggctcatattcctgattgggcattagaagaatcggttgaaaaccaaggagatgaaagagctcattctgagaccgacagttcagaagcagatgatgaaacttctgagttgcgtaatgagcctaatgctacacataatggttttgtccaagaacaccttccctccggacataagtattggtcggactcgcccagaagaaacattgaaatgtctcactccgcagtcgaaccacatattggtggtaatatgcctaatgggatattgaagaagaatgacactgatgacacagtcagcaatcttggcacttctgtggacttgccaaacccatctatgattgacaggaaatctggagtagcttctgtcagcaccagtcctcagtcttttgatgatgagcatattgaagcagatgttagcgagaggttagtgaatttgctagctcagcagcaagaggagctcaacgtgctgcgaaggaagcacaaggctgacatagaagtcatcttgaaaggtgtgcctgaagagcatcgcgaagaaaccttaactaggtgccggctgaaggcagatgagagaaacagatcagacaaaccttagctgcaacacattatcttcaccgtgtgatttttttgtaccggtgccatggagctgtttagaactattgttgtgcaaaaggtggtctcagctgttcactgttcttttttttttcatggaatggaggagctgcaagtgtttgtggaatctgtgaccaagcggtgcaatacatatacgatactgatgtagctgtctggatttttgtttttgttttttgtttcttgaaggcaagacaaaaggtttctgctcaccaaacaaaatctgcagataccattgtgttactgtattcctgaattgttcatgagaagtgcacctccttgtttttctccctctctttttttccttgtaatttgatgatttttggaactaagaattaatgttaatgatgtaatacatcagtgtttgagctgtttcatactactacttgcaatgaaaaaacataagttccaattacttccattatgtttgtgccacatgcttgcccaagtccatagagctgtactatgcactgatatctatgattgtttgtacacatacctgcatttcttattgcaagtgtgccatgcatggaggatggatggagctgtggaagtctccactccatctccagcttcatccactgatgagcagcagatctgaagtggccaatggcataaacaacaaacaatatatatgtgcaacacatgctccagtagcatctctcacatgccccagatttgtgtgtccccttgcatcacatttgctgctgctcttttgtgtgcatctatctatatctatcccattttgtgtgcatctgaatctgtgtacctgaaaacctgaggctccccaacccagggaaggtttggggatcctagctgctgcacacagaatttggatctgtgttgatgtacaaaaagtggcatgagccatccctccgatgcaatattttgggatctattgtatatcaatgaatgatgatcagttcctccatacaaggcagggagatgtggaaacttgtggaccatgaaagctgttcatatatattttttgctcatctgtctctctccatgatatttggacatgtagtgtgtacatcacatatactattgatcctgttacatgttggtgtcaaagggctatagctacatcaattcatggtagcctggctttcaaatatgcataattggctaattgcatttatatttaggcatcatctgatcaacgtaatgttatccatttcaggatcatgtgtatggcaattagaattagttcagtccatgatagcatatggatccagtgcatcaaactgagaaacatgtccaagtgcagttgaaagcaaaatgacaacaccccaatccatgcacgtcgctcttaatcagtagtctactgtttcatttttcacacagatagaaacccaaaccaattaaggagtaaaaggcacatcatcaagaacccaataaggcaataaccaaaaccacatctttgtgcagaaagaccaggtttttacccaaatacacatgcaacttgggttctatatataaaaactatactccatgaatgaatgaatccattcatggtactactacagttgctaacaaggaaaatactagctagtatagtacccaagttgcaacttgcaagcaagtccaggccaagccatgaacaaatactctatctattttttaatatacgacgttattgatttttgacgtgacgtttaaccatccattttttttaattatataaatgccatttatttaattgtgacttgttttatcatcaaagtaattataatactaacttatacttttacatattttatactaacatttttaataaaaacaattagtcaaaacttatgaaaaaaatcaacaacatcatacatcaaaagacgcaagtagtacaagctagcatgtcaatttgagtgaatgaagagataagcaatactaataattatatttatatgcataatctctctgtctcggtcattgctagctcaagtcgattgttcttgacaagttgagagctcatctcatcacccaccctatcattgtttcccatcaacctctgcaatataatgcaaccacctctctctctctctctctcttctccgtgcattggagtatatatccccctctcctctccccgccgcccccccccctctctctctcctctctcttcttcgcctccgatcatctaagctcatcgtcgtcaccagctagcgcatgacgtcatcctcgtcgtcgtcgtcgttgctccttttgtagtacgtagccatcgatcgatcacagctagctagccatgcaggaccacgtcgtcgtgcagcagaggagcggcgaccagccggcgccgtcgtgcgacatcgccgccgacgagatcccggtcaacggccacaagccggggagggccgtcacggcgtcggtctaccgcgccaagatcgccggccactcgcgcgtcctcaccgtgtcgtggtcgcgggacatgctgtcgcactccttcgccgtgtccgtcaccggcgtcgacggcgcctccgcggagtgcagggtggacctccgcccctggcagttctggcggcgcgcgggttcacgccgcgtcgagctcgccggcacggcgccggccacggtgcgcgtcatgtgggacctccgccgcgcgcggttcggcgcggggctccccgagccgaggtcgggctactacgtcgccgtggaggccgcgggcgaggtggtgctggtggtcggcgacatgcggaagtacgcgctccggcgcgcgtcgccgcgcgcggcgcccgcggcgtgcgacgccgtccccgtggcgcggcgggagcacgtgttcgggaagcggcggttcgcggccaaggcgcggttccacgaccagggcaccgtgcaagacatcgcgatcgagttcgacggcgtcggcgagggcgacaacgcgaacatgaagatgacgatcgcgatcgacggctagaagccggtgcaggtaaagcacctgcaatgcaagttcaaaggcaaccagtccgtcaccttcagccgagcaaaggtggagatctactgggacgtccatgactggctcttcagcgccggcatgcgccccgccctattcatcttccgccccatcgtcctctccagcgcctgggcgcccgccgccgccatgctcctagacggctcgccgccgccgccgccggccaccggcttctgtctctacctctacgcctggaagctcgactgatccattattgagctagctagcttctttcattggcggctggctctgataccatgttgattagatcggggattcttgatcgaaacgaaaatgcgaagttgtgagccaaaggggaggaggagtaagaatttttttcgattttgtataatttttttgaggaaggaaggaaacatatataattggatataattaattaattcttctaattaagagcccttgcatatacatacattattgctccattctcttgatcagctcaatgacaataacaagagacatgataaaatagtaatgccattgccaagaggagagcaacctagtgatctcctgttgattcatttgagatctcttgtagtagatcacagtactgggctactgtctagtcaaaactctgtttcacctctctctgatcagttagttcctgccagacaagaagttgatgttttagttatgagataaccacaccacatattcagtgatcagtaatgtacatgctagctgtgcgtataacactttataactaagctgtcttacagttaattgcatatgcaagagagagagagaaatcaaggtttgcattgcaaatgtgcaatgtgtttgttgggtgggcagcacatgggatgatgagggagagtgggttccagtgatgagcagcagcagctgtggactgactcatcagactgatgactactgatccaagaaaaaatatatatattggccaccgcaaaaggtgacagattggatccaccatcctaatcttcttcttcttggcccctcccaattgattaattcttccctataatctgccaaatattcacattattaatccagggtatcctaagtgatcgattgatgcctctcacctcttagttcctgatgatgatcaccttctgaatgtggagatctctatgcatattatccttaattaaacacagtttatgcataatttgtttacgaatggtaaaggagtttcatagaaaaaaaaagagatttttattggattctaatattaaaattcctgtttgctcacctgacatgtgggctctaccgaaaatacctactgtactgtagtttagttgcgcaaaatgaaaagtttgaatatataataattccacatgagattgtacctagacagtttgtcatgagaaattgatttgcaaggttgtatcctatttattatcttacatatgagacgtgtgtgtgttggtgagatgccaaaaggctgtaaagattccatcaagggaaaacaatggaggaaaatggggataaacaaactacatccaatttgttcccttgctagcagcttgcatctgttggaagatatagctggtgccaatcaacactttgattgatagaattaacaagattatattctgattgctgccatttgtctccaaggcatttgttcaatccccattagttaatatacaacaaaaggatatcattagtccactggtttaatgtagacaagaggaaatgttaatctttatccttccatttctgtttccagagcagtgactgtttgactgacctagagggtgagttcaatttgtatttttaatttgcagatcaacatccaactaaatctatgtcttgttcaggaatgtgacttgataggagggtacaaattgtatctaaactcctaaatgtacatttataaaatgaaaatattcacaatagctacatgtaacaaatcaaatggaaacagcacctaatctgaaccatcccctttgttttgaacctgcaaaacagttttctgacactccactggactcctgcatttgtttgatcccttttcctctgcacaagctagtttggtcaaaccagagctggttgcctgtttagtaaggttcggcctctgtaatcacaattgacttgtacaaaaaaagctactaagataattaaataattacttactgttactattgtctttctcaagaaagtattctatggagaaactactgacttgtagcagaatgggatcgagcaaaatcaacacacattgcagccgaatgtattagaagaaaaaaaagagaagaagctaattaagaatcaaagacaaatgtagtagtagctaagaaagctatgcttgtgatccaagatattattgtagctagctgcaagatcttaaatttggtgtatgtttgtggactaagtaagcagctagtactactaaaatggtgggtagctaagctagctatagcttggaattgtgtgaaactgatttatgggctagcatgcagctggagtactaatttagtttagagtccatgcgtctgtgttttgttgtgtgcccgggatcagcggacaggggtcttgcatttgaggtggcctgaagaactgaaatgtttttaatccaacaacccatttgcacatgcatttgctagctggtttgcaattgctacatgttcatcatatcaattgaatttgataacaagctcacaggtatgactgaatgcattgtagtgatgtagcagccatgtatgacaacaagctcacaggtatgactgaatgattcaacatgaaattaattattgaatttaaagaaaccttttctttcgttacaatacattctctgaatgactatgcatacatatggccatgcatgtatatcgatagatcttgcgtaggcacattagcaatttgacatgtgtggtttcaactatctccagctccaaatgctcaagtttacgcaaccaacgataactgaataaatacagcttgtgtagcttgtagcttatgcaatctagcatgcttgttgccattcaaatggaattaggtcgtcgatgaaatgcagccagacttcagttttaatctttccccttgttctagtactttaaatattaattcatatgtggctgatacagtgatatggaggaggtattaatttgatgataaaaaaaagaaaagaaaagaaagatgtggaagtgaagaactgaagtaactgaagaagggagaactgaggtagctctacatgtgcttttttcttgggatgcctttgtataaacaaagcaaaatgaaatgatccagttattggttatggggtggaccatgagtgacacgtcgccctgcctccccttttgcaagctttcagcagaaagtgtccattttttgttggccatcacccatctttctttaattcttttttacttgccattgtcaatccacagcaggcaggtaggcaccaccatatgcattttttttgttatttttttcttctcaaaaaaataaatgaatttgagattgggtagcattgagttatgtcgttcgagaaagatactactggtcatttcgtgtgccaaatttttttttaaaatacacggacacacatttaaagtattaaacgtagactaataacaaaacaaattacatattctgtctgtaaactgcgagacgaatttattaagctaattaatccgtcattagcaaatgtttactgtagcatcacattgtcaaatcatggcgtaattaggctcaaaagatccgtctcgcatttacatgcaaactgtgcaaatggggaatcgctagatccggatccagcaagaaggagtctggatctagcgtctccactcttcatcaggtcgactcctgcctccgtgagtccctacaatactgtgcatggcgagagggagaggaaaaaaaaggtggctcatggagtgtaactagagggtgcggttgcgcgtgcaaagacggagaggaggaacgatggtggctcgtgaagaaagagcggtggtgacggtgcgtggagtaacagttggtggttgttggcagtatgaggagtttgttgtcgacacaaatcgctaaccaaatttgttactccctccattccaaattgatctatatatttcataggtacaccaagaccaataaatactaataactctctcatactatatttactctagcaacaaactcaatgcatgcataatccccactatttcctagccaatagtaaatcaagatattacatgtaggttataaatacttgtctgcatagatgcatgcatcaatgtccatttactccaatacataaataacgaatagacttaataaatgaacacaaatatatagatcatttaggaataacctcaaaaaaactataggtagatcaatttgaaatggagggagtaatatttagaatgtgggccactagtcattataaagcaacagctagtcttaaagtagtaaaatattgagataaaggtgagagtacttgtatagggcttttaactttttgctatttttaaaatatggtaattaaaaatttactactcacagtccatgatacgtgagtcctcatgtgtatatgacatgtgggacctaatagcaaattcttaattcccaaccataatgtcttccccttccctttgtgtggcgtaaaagaaagaagaaaatctcccgtctctttgtctcctccgctccttgcgccgccgccaagacacaggggaggggcggcgatctccatttggcgaggagagcagagcaggggaggggaggggaggggatcctggtgagcctctttctttctttctgattcatctctctctcccccatcgggactggaatttgcttgcgttcgttcgttcgttaaccctagcttctcttcccttaatttcagagccttaaccttaatacaagtaatagtttgtttgttccccgaaaagtcccaagttggatccgcccctgattactccagtgatctggcacacattctatttgcccaaaagatttataacttccctagctaccaataagaaaccctgttcagtttgtgttacaaggagcaaacttgtgagtgtttgtttggctcattgttcttgccaaactcccttttcccgctttttagtaaccccatcacattattacgatttttacaatacaactgtgctagttgggtacattgccagttttgttgctactccactgatatggtttttctgtgtgccaaccaggtcatattttactgcccagagcacagaaaataaaagatggttaatgcaatcaagggattgttcatctcctggtaattaagctcctaacacaggttaattcgatcgatttttgtttcctttgcataagcagcttgcaatcccttctgcagtgatgtgccaatggcacagttcatcgaatgcttcaatgcccgcatcagacaagttcatcttgcacatgcttgatccaacgcacatgttcgtccagcctcacgtggcggatatgatcagaagtaagatatcagagttcagggaccagaacagctacgagaaaccatcatgaactatcaaggatcatcctgtcctcagactcccatataaacataccaccgtttgttgttaagcctgtaatgtggagtagtgataagttctgagcatcacatctcactcatgataatcaagaatgattgacattcggtatcagaatgccacttttagagtgatagataatgcaactgtgagattgtaatggaataactgtattttaatatcagaaacaagtcgagttgtgatggtggaattcggccgaataaatcttcctgactgactgtctgtctgtccatccagttcttgtggaattttcagctgatattaaatcttgatgtccttttctcttctctctcgacattatattatatcatctgaactccgaaggatgggattttgagcataattggagaagagagtctgatggcaatgctggtctgttggcagctgagaaatgcccaggggtcttccggctagctccacaaggtggtgggctagacgacctgggttcaaagcctcacccctcctaattatttgatattaggtccttccctaatattctagtttttttggtctgttggcagctgaatgcctgaatttcttcaattcgccggagcagattgggggggaaggcgacggttattgggccgggatcaaaggcggcccatattacgtggagctgaacggggattgcggcccatattaattagttgggccaaaagggggatatagattcctcgcggcccaacaatgggatggggggtcacgtgcggcccatattagttgcattaagttctgcgtacaattaacatactatttccccagtttcaaaaaaaaaaaaactatttcccctcttctcctgcctactatttccattgtctgtcggaatatttttattagtgacgaatggtaaaagataggagtatatggcatttcacgctcagttagcattcacattgttgatgtacagttgtacactagtaatttcaagtgaaaattcagaagaaagaaaaggactctctgttttttactagtaaattgtatatcaaccttaacagtgagcatacaggtcgtgaacaagctcaaaacaagaacatatttgcattgctccaattcttcagccagcgagtttatattgacttttgcatcttgtgcagaagaaaaatagtatgtcagagaatgatgtatgcacgcagatgacatggtatgatgaacttgatgcccctgttttactccaagtagaaaccatggtccaacagacaacatcctctttacgaaagagatggcattaacttaacaatggcacagagatagaaatcggtcctcactgtctactatcttcagcagatgcaggaaccactatcttgaaaagcacttactgatgcagatcgttcatccatcaggttgcagttggttccatgtacaatctttctttagttgagacttcgcatgcttgcatccattctcgattgctttctttcagccatgttgatgcgcactcagatagatctatctatctatcttctctcaagttgcagctatgtaaccaagaaaagaaaagaaaagaaagccatcttttctgcagctcgatctgcacccagcattcatgcttgaaagcaaagtctcggcctgacattcagagcaaagcttaaagccttggcatgattcggcaaacactcaaactgttctcactttcggagcctttgcttccaagcaaattaaattgcccggatcaatggctacaaataccccatgcattgcatgcatcctctcttcaattcagaaacagtttctttcgtcttcagttaaaaaaagaagaaggagaagaggaaaaattcagacagagatcgacatggagacgaaggtgaccgtgggcgtcgtcctcctgctgctgtgcctgtgcggcggcgccgcgtgcgccgccggccgcagcggcggcgagttctccattgtcgggtactcggaggaggacctggcgtcgcacgaccggctgatcgagctgttcgagaagtgggtggcaaagtaccggaaggcgtacgcgagcttcgaggagaaggtgaggaggttcgaggtgttcaaggacaacctcaaccacatcgacgacatcaacaagaaggtcaccagctactggctggggctcaacgagttcgccgacctcacccacgacgagttcaaggcgacctacctcggcctcacgccgccgccgacgaggtcgaacagcaagcactactcgtcggaggagttcaggtacgggaagatgagcaacggcgaggtgccgaaggagatggactggaggaagaagaacgcggtgacggaggtgaagaaccaggggcagtgcggcagctgctgggcgttctcgacggtggcggcggtggaggggatcaacgcgatcgtgacggggaacctgacgtcgctgtcggagcaggagctgatcgactgcagcacggacgggaacaacgggtgcaatggcggcctcatggactacgccttctcctacatcgcctccaccggcgggctgcgcacggaggaggcgtacccgtacgccatggaggagggcgactgcgacgaggggaagggcgcggcggtggtgaccatctccgggtacgaggacgtgccggccaacgacgagcaggcgctggtgaaggcgttggcgcatcagcctgtcagcgtcgccattgaagcatccggtcgccacttccagttctacagcggggtcagtattagtcctggcttagttctccaacacttttttccaaaaacatctcatcgaatctttatacacatacatagaacattaaatatagattaaaaaactaattgcacagttaagggaaaatcgtgagatgaatcttttgagcctaattaatccgtcataggctcaaaagattcgtctcgcggttttcaggcgagttatgaaattagttttttcatttgtatccaaaaaccctttccgacatccggtcaaatatccgatgcgacaccaaaaattttctttttgcaaactaaacatgcccttagtatatattattcctatcttactctctctctctctctgtaataaatatatttaaaacgtttaacataagtaaatattctgtcaaaaatttaaaattctaactatcaattttatattaaagtaaattcccatttaacaatgcctaaaatatgttatgaacatagaaaagaaaacataccaagccgcacgaggaacatgacgaacaaacaatcacatgagctgtctaaatccgcttcgttcgctatgggcatcttgaattttgcatttacaaaatacaataagtttataatattatggtagtacatttgaacacaaatgtgcgtttaccgtttgttttgtctatcacactaagcatttggaaaactgttaatgaccagaattttaaactcagactaaattttgttataaacgtcaaataattatgtttaggcggacttcttttttactatttatcatataaaaaaatatttatagcatctttagaaccacatatttgtataccattgtatgagccaaatggatgatgagcaagtgatatttattagtagaattatatgatgatcatggatggtgatatataaatgcagggtgtgtttgatggtccatgcggtgagcaactggatcacggtgtgacggccgttggatatggtacaagcaagggccaagattacatcatcgtgaagaactcatggggcccacattggggcgagaaggggtacatccgcatgaagaggggcactggcaagggtgaaggtctatgtggcatcaacaagatggcctcttaccccaccaaggacaactaaactcctactactaaataactcaattgaatcaacacatgaggatcatacatatgatggtccttcaaagtttctctcttctcctcttgttttattagcctttaattccactgttttttcttctttccaaagatttggaggagagagagagagagagagagagagagagagagagagaagcacaagctgtttgtttgtattcgattttcttttgcgcgctttgaaatcatcgatgaaataataaatgtcagaagcttctttttaagatactgtctgttccaaagtcattcataagggtgcttgtttggtcaagttttgtgtgcatttgatttttgctcctgatggtttggttttgtatgcaataacgactgaaatgtgtaggacttagtccaagtcacttagaggtacataagtacgaaaactgaaaacacatgggagacaatataggatcacgcgggagaaaaatgtcatgaaatcgacattttgtacaaagatgcgtgtaaatcttttacgtatttctaaacaatgaaatcgacattttgtaatttgctgcatacaagctatactcttactccattcgttaaaaaaaaaaagttcaattatgtgttcagattcatgtctaaaattaaatcttattttgacggaggaagtagagtcagcatcttgttttgaagacttggtgtcagcatctgagcccatcatggtcaataatccatgaaaaaaaatgcaagaattattggaggacaagtgcccatgaatgcaagtagagacactgtagcacactgcacgcactcaacttatcaattagtagtactgtttcaacatttttcatgtttaggccaagtgtgaatcattttaacttgttcatattaagggtaaaggtgataccgtgaaccgacgcccacggtcgtccacgcgcgggcgaccaggggcgaaccctactcctcggccgccgccaccctccccttctttcccccacctcaccgccgccggagcgcgccgctggaaactgcgcggctcgccgggatggcggcggcggggctaaaacccggcggtggcccgtctccaacgcgaggagatggcgcggcgtgccgggaaaccgcgcggtggcgccgcgcgtggctgggagccggtgccgccgccgccggtcccgactccacgcggttggatccggcccaccgccgttggatctggcggccgacaaggatggcggcccgggcgttggcagtggccggccgtcgggagacgtgaggaggcggcacggcgtgcagggcaacccggaatgtcggcggttggtcggcgcgggcacgcgcttgcgaatgccggggagccggcggtggcggcaacttccccgaccagatccgggctggctccggccggatctggcggggcgcccggagaccggcgacaggcaggggcggcgtcgcggtgggcgggcgtcggtttcgcggctggcaacggcggctcgctcgcgccgagctcgcgttgtcggcgtcggcgtccgtccgcggcggcgcgtgacgacggatgttgcggcggcgcggacgtcaccggcttgcgaggggcagtgtcgcggtgcgggtgatggagccagggcagccggttgcgcggggtggctgcgtgtggtggcgttgcacggctcgggtgggctccggtgagctcggcggctgcgcgacgtcgcctacgtgagctccggcggggttgcttgctggcggtgagcctcctgctcggtagggggtttcttctgccggtggcgagtctcgtgctcatgtgcggcgatgtgcggatgtggagttggtatggctgcttgtgagacgtcttggactaatctatggtcatcgatgtgggggtgcttgtgtgggtgatgtgaagatgctagtgaaagccttgccgtgcctttggccagttcgacgaccacggcgcccgcgggcgccgtttccctttttggaggcgttgtcatggcgttctttcatatccccgcaatctccaggtgtaaacctagttccgaattcggacaagcggcggcggcactacgcgtcgtgtcctccttgggggcgtcgcttcggagaagttccaacgcatcgacgactattgatagtctttttcggttcaaaagctttcataccttagttcggcgaggccttcgccttcttgggtccgtttctttcttgtggtcggtgacaagctcttcggttgtttttgctgatgaagtcgaagctgctcgctgatagggtgcggcgatgcttggcaacgatgacatgttgcagtatcttccaaggagttctggtgttggctgtgtgaaggaagtggctcctcggtggcttcgctgatgtccattgttggaggtcggagctgcttttcgctttggcaaccttcgtgccttcaatgtcgctgcggttgtgaagtcggcgctgctgggtcgcttgggcggctagctcggcaacgataacacgtcttctacgatttgggagctgttgtgtcgcttttgtgtttagcctagcagcgacgtcttgcgtttgggctccgctgtcgttgttagatctgtagcggtgggttttagccggttttcctttaattaaccgtgcaattgtacggtttttgggtccggtttttcttataaactgggtcaattctcttcttctaattagaaacgtggaacaaagttccgtcctaggtttcaaaaaaaaatattaagggtaaaagccatgtgaaatgttagaaatattagctgaaaacgtcgaccatatactcctaattgactgaggcagtagaggctagacataaacaatttgcagaggttggtttgcctttgaccacagcactcaaatccgggggcgccaccgggaaaataaaattcagccacaaatttcttctaatttttattttgaaattgtttcagttatcctctccctgtcaagattgtccagctaaccttccaaattatgatctactcactccagaagcttctgttgtcctgttaactgatagcatcttctcttctaatgttctgtggactgtgtttaatttagcactagcatttaatttggggcctacttgaatatcattatattatattgctaaaatttgatggtttgccatttaatttgtttgtaagttcactgaatcatgtgtaatctagatagtactaagttagtggtaggtgtgttagctccctccaactgaagaagatgagacatgcaaagcaccctgcgtcatgtacaacccacaaagttctaattaacgttcttaactatatataaaatatcataacaataactccttaatgtgaaaggtaaatagcctctttgagtaatccacatgaagatgtggatctgaaagacaaatgaggatgtagatctgaaaacaattgtaaataaattcataggataagaaaaagacaatgcttgatttgatactgctatggtcactagtcataagagaaaatgacttcaaagttggaatatgttttggattgtcaataggtgcttcaattggactctcagctgagccaccaaccttacaacttttgagcggctaacataatattcctttctccaaataagcaagaataaaaaccagagttcaaatacaattagaaaagattaacatttacttgctcggttttacgattccaaaaagaaaaaaaattctactatgttttctcgcatggttattacgacaacgtctaccacatcatgcatgcttttttttcattaacggtttgggtgggacaaatatactccttccgtcctcaaatataagagattttgatattttccttgtactgtttcaccattcgtcttatttaaaattttttaaaattattatttattttatttgtgacttactttattatccaaaatacttaaaccacaacttttcgttttatatttgtacaatttttttagaataagatgagtggtcaaacgttataagaaaatagtgaatattccttatattaggggacggagctagtagcatatattcgattaaggattttaagcagtgacagtgattatagaccaatccctttggaattatgataatagaaattgaattgaaaagggaaaaggtgaaggaaaagaggtgtgggtttagccgtttattgaaaggtgagatgggggtaggtaagctaatataagctctccactcctacaccaacacaacacaaactccgatcttgtttctctctctctctctcccttgtttcagtggctcagaaattttcctcttttcttattattgctttcctttatttaaggaaggagttgggctctctctctttctctgagtctgaatccccacgagacgagaaacctagcaaaaatctcgtctttcgccgcgctctccctcctctgattcctgctgttcttgatcttggatctcaattcccaaccaagaacacacagacagagaaaggaaggagaagaagatgtcgaacgacaacaagaaggtgtataccctggaggaggtcgccaagcacaactccaaggacgactgctggctcatcatcggcggaaaggtctcatcttttgtttttcttttcttttcacgcttttacttacttgtactattcgatttcatgtttcgattcgtttcgttggttcttggttccctatcctccaacaacgtcctgagacctcgatctggtcggagtccacgaccagatcttggccgcggcgcagatctggccctccagccgccggcgtggggaccttgccagatctggtcttctccgacggtggccaacttctcttgtcccttggttgcagccaccaaacctcttcctcccctcctcgatccaaccttggtcttgttcatcgactggccactaaaccccaaataagcgagatagaatttggattcgtttcgttggttattgtttctctgatgctgtgatggtggctagatcatggcagatctgcccagtaaagtcgaattttgtttgattccaccgcacctcctgaggaatcggtccaatcctgtgaattcttctcttctttcctgctgattggattgtctacatgggctttacctggaaacaggggtgagtgctagcagattcaaacatcatggactgactgctcctaaacaagttccatatgaaaacctgttctacatgctttttttcttttactcttcactcgttgtcagtcaaacactgcaaaatttgtccctgcgcctattctgcaagagcttcttgttagtacaactgaagaatcaatcctctgttccaacttggcatctggacagaataatgaatgtttcataggaaaggctcagctcaactaagtaaatcatgttgattggccttaaaacacacttcattaagagtctgttttttttatattggacatgataagaataatatggctgttttttattattaatgttttttcttggtaacagtgcttctattgatgaacctaccctgtttacctgatctcaccagtgttctgcaatactatccaggtatacaatgtgtcgaaattccttgaggaccatccaggaggtgatgatgtcttgctatcttcaactggtacgccttctcaattctcatgttctggccttctgagtagtgaccactactgatgaattaactgagtttgcaatggatggtttagcttacactttgaaatatacatggaccttctgcaggcaaggacgcgactgacgattttgaggatgtcgggcacagcacgactgctcgtgcgatgatggatgagtattacgttggcgacatcgacacatccacaatacccgcgaggacgaagtacgttcccccaaagcaaccacactacaaccaggacaagaccccggagttcatcatcaagatcctccagttcttggttcccctcgccatattgggcctggctgttgcaattaggatctacaccaagtcggagtccgcttagtgctgttctcttagtgttataagagtggaaggtaccgaataagttagcaagagttttgtgtgattcataccagtgtaacatgtcatgaattcgtcgaatgttctgaagatgctgtgggttttgtggtcctgggatgtccacttcggtaaagatcgataagattcaaagtactcgttaatcgttatacattctgatgatggatctgctcattgttattaattgttagaaacctatacatacacaaggtggtgattttattggcgggtgtttctattgaatttctgtttgttaggaatgcagatttaacaggtgttgcatttgcttgttttttgtgtcgctagcttttctataactgatcgataatgtggcttgtgtagtggatgtttactccctccgtcccataaaaaaccaatcgatgttggctaggctagtttgtttgggacgattcattgtactagaatgttggctagactggtttgtttgggacggatggagtacgtaatggctagactatccatccgtaatactggctagactagataatatagtggagtttcaccagatgaagaggggaaacctaaccaagtcaagactcaagactggctgagttgttaaccatatagtcacgccacatgaattgattttgccacaacagagattacatgtccagctttatacgtaaccatttccattatctataaaaaaatatccagctttatcagaccaagtaaccttcacaagcatatttggagtaataaaacaatggtttccgtaacacagccagttggaactacatatcatcctgattaacaacggtcaacagaagtttctccttacattggacagccatgacacgtcgagataactggacatcaccattgtcatccatcacacagcatgttattgtgctatcaagaagaactactccatcttggatgttggtggtgcaggctgcgatttctccactgaaacatccctcgacagccttgatttcaacagtagcctccactgcctctttaaccactgcatatctcaactccacggtgcctaaatccaacttactcttgtcaaaatatatcccataacaggagatgttatgctaatcatattagagacaatttcagtctctcgaactttgctatccagtatgtgagttgaataaagagttcatgattttttttttaaaaaaaaacctaaaccctaaacttaaaaaaaaaaaacctccacagtgcccagcttaccaacaaaagtgttgttttttcaccttaatttcgacaatttatattactctgaatgccatcaatcataagcaatcctttgctgtgcccttttctcttccctcttaatcggtcatccttaatactgagatcaacctcaaaatacacagcgtcttgtaccaagagtcctcgagttggtccagtcatgaatcgtcctgtgaatcaagtaacatgcatgataatgttgtgttactttgaatgcaactgtaataataaatataacaacaatttcaagtagaaacgtcatataaattataaaagctatcaccgaagatgatacaagcatgcgtgtgttcgcatatgctgattcccaacccggcggaacagtaacacggaaaacggaacagtccattagcacgtgattaattaagtatttgctattttttttacaaaaatggattaatatgattttttaagcaacttttgtgtagaaacttttttttttaaaaaatacaccgtttaatagtttaaaaagcgtgcacgcgaaaaacgaaggagatgggttgggaaaaagaggtgccgaactcacccctaggtctacatctacatcttactaatgccacgacatggtcaacggctgacatgtagaactctaacttgtttaccatataacttttcgacaccgacctcaacatcctctccaacctcccttgccggccgccggctgcgcccaacggccccagctcctcccccaccgccgccacccagttcttccctatcgcccgccggccgcaccaagctcctcccccgccggccgagcccgctacatcgtgcccagcctctccatcacgcccatcgcccgtggaaaggggaggggaaaggggaggagagagaagtagaaagaacatgctgatatgtgggacccacataggtcccatgctaagtcagctgccacgtaggataaaaccggatgcaatactgccctaggagctattgtgaccggttttgattagttaagagacgtcggatatctggttttacggtttgagaacatttttataactcgatgacgagttcaggacctgcggtgtactttttccgactttagaagggaacaagaaaaacaatttgggttacgtgatgggagataaagagaaatgaggttaaaatatttagtgtaaatttcacaaaatctactacagattttaagatattatatcacagaactataaatgtagcgctaattttataaaaaaaaactatggattttagaccaagtatcatacaactacaaatttaatatttaggttatcataaacctatgtattttagagtttaaatctctaacactaccgttatattgaagctatgaacattatacttttatgattaaattagcactaaacatgttgtgataaatttattagttaatctgtagttttgtgaaactccatcttaaatagtagttccacgataaatttgatgctgaatttgtaattttgtgattcaacattttaaatctgctgtttgttttagtttgaacaaaatatttttagttctgtgaaatttactcaaatatttattatttacaccaaccaaatattttacagatcatttaattaactattatactaccagtacttattattctaaggttgaccaaacaactttcacacgcatcttgcaaagaccacagctaatctcctcctcatcagagcctctagtgaatggactcaactccaaactgcaacccgagaagacattgtcattctgagcatgaatattcagtatcaacatttcattcactgatactaccacgacacgtcgcagtagttgaataactctgtcgtcaccaactgtggttgaacaaccaacaacatcgctgtcatacaacaatacagcatgatttgggacatttgttgtgcaagcagtaattttcccatgaaaaacttgagcatctgacaggatcttgatctcaactgtaccttccagtgctttcttaacacagttaaatacaagttccacctcactgagcctactctccaaggtttcactcacaatcttaggctgagactcaataaaatagatcttcatatcaacaagtcctttactaaattccctgtctatgcactcttcatcttccctgatcttcagatttatctcaaaaaatatttcaccccaaaaaacaattcctctacttgggcccgtcagaattagatcttcattctacaaggggattacacaacgtcagcaatgtcacgctaattttacgtacaaaagcagatgccagttattcatagaatataatcctgttactatattgaccaccttaacatctagactcagatcaggaactttcttcagattaaattgaattgctatggctgagctcatcaaatgcagtaatttggctgcaacaattataatataatgacaagactaatgaaattatgataccaaaacatgacttataatgatgatatccacaaaaatgtagtagtcacacaagacatgaatatagacaacttaaatatgataacgtcataatcatatctagctttagagtgctttcaaccatacaggactgtaaagaaataagttcgatcatcaaataaaatagggagaaatttgtagtgctaagacatattctatgaaatacctctgaccgaataacttggcaattgtccctattgcgcgggaagatggtgatgcaattaaaatctaatatgtctctgactatcacagtcccatacaaattgataggatagccaacatctgaggacaatatcttcacagagagtacatttaaggagctagtgaattgatggtcctctttgatgatggaatctgcaaagcgcattggaccatgttgtgctgagagaaatgaaaatatagtaagtatgcgcaaggggaagaatagtacgttaacggaagcaagtactgaaatttactgataatgcacaaaaatgagagaagtttgcaaaggctccaagtgtgggttcggtcaaaacagtaggtttctatatactcctttaaaagacctcaatgggggtggtggagaatctgccaccatcacctatccactgatgtaggttcatgctgtcagtgtaaccacggttgtgcttgaaattcacatgagtgaatccatcatctaccactctacatcaaaaggtgagccatatgaaccagcatcatccattcacatcgaattccaaagaaaatatgttttttttcaattaacattggaaaaagtaatgacataatttatttttaatttcgttgcaatgcagggcatttagctagtagtatttaattttgttaagcctttgtaaaatttaatcacaagatgcagaaaactgatgaaacaatcatcacaaaacaaaggaaaacagaataataataagagtaaatttcactttgggccagttttaatagccaaagtttcactatggaccaggcctaggcccatatttttacataacaccaggtaatatgaccttccattgcactttggaccaggctgcattgatttgggccgccacgtcgtcttcagcccaatccacgtgagcagcagctggtggactcagttcacggaagaatcatacggagcagccgagacacgacgcgtataaaactagcgccagcctcatccgctcgagagaaaactagcgcagcagaaaggctgggcgccccaccgccgccgcagctgccaccgccacgagccccgccgccgtcgtcgccgcggccgtcgcgtccgccaccatcgccatcgccgccgtcgtcgtcgcgtccgccaccatcgccgtctttgccgcggccgccaccgtctccatcaccaccgccgaggggactacacaagctcgcacgatgggagcactactcagcagccaccaggtgatccaatttaccacccttgatccatctctaatgtcaactttagtgattcccggtgaattgacacctcaagcaggttacagtagcagtggaatcgagcaactcgaattggtcgaatcgaggggtgaatgttgaatcgccgataatctcgtgtgcatcaagcatgtccttgtctgtttcgtgtacagacaatgtgccaatcgattctatgattaggaagatgcaggatacaagggtaagttagggttagggatttaattgggggttgtttaattaggataaacttgagtacgttttggttgaaatagattgatttgtgtgtatttggacggctaagcaatggaattttgtccatattgagtgcaggagtatgaagtcgaccagttgccaaagtacaaacatgaccccaattatcatggcaaagaacatgatacagatttaagatgcttgtgtcaaagaaggccagcccgtcgagttgcgagttcaagagttaacacagagagacgatttctaggctgcccccaaaaggtagtactgtgccattcgaagcatgtgcctttattttccatagcttgtcatattgacgcaaaagtcaattaatgcatatcatagaggaagctttcagtaatgtccttcatttatctattatttgaacaaaacaggtgaaataatctttacttatgccaaaatgttgatccatttgtactttatttaagtcatctacctagatatctaaatattgtgtgcaaaactgattttatcagcatgtgttttatgcagtgggttaagtgccattttgttaaatgggtggatcctgaataggatgagctggccgcaaaaacaattttatcacttagtgagagaaacattgtgcttgagaagtcgctcgatgatgtgaacaaaagctggatgtctttgtacgcgaggaagctgtgcgaggatgacatctggagacgcaagttagccgatgcaaggatcaatcatgtcgatgacctagataagatcaagtcaattggtgatgacctagtcaagatcaagttaattggtcttgttgtgatggtgaccctttttgtaagtgctgttgctaagttgtttgtgactctgtagtctgaaggacatcacgtagagtagttgtttgtgatatggtcctttggtaatgtggttcttttatagtacgatcagtatgctggtgaacttttagtttgtaagtatgaagggatggtgaccttgtagtttgtaagtatcaaggacatcccatggccagttgtgatctgatcgttttggtaatgtgttcttttgtagcccagccttgatagataggagctgcttggaaatgtaatgataatactatggtcaggatattattatctcttgaatataatgtgaacagtatgaagttgactgtgttgtcctcagactaaaccatctttttttttagaacttaacaactttattaagctagaagcaaagtacatggtttaggtaacatctccaaagggattggagaataacatctccattgtaggacaagacgttgaaattttctgaagattatgatctacatgagttactgacagaaggtgagacaaaatgtcttgaatagctgaaaaggaactgattgatccatagtcaaaattaagatctgaaagaaaccaggttagtttggcaaattgacattgaaagaacagatggatatcattctctggtagactacaattggagcatttattctcaatccctgtaatacgaaagttaagagcagctgcagttactgaaccgtgaaggaaaaaaaatcaaccactgagaacctttaatatatgagcaacttaacatgtacacaatagtagcatccaaatttgtaggtgcaagggtgtgcctctaatggtttagatgacacagggagtactcaaattgacatcaaggattcatgactaaagctatataactacaagtccacaaaagtgtactgcattacagatgttgagcaaaatagaaggagcaaacccgcatgaagcactccatcctattttaacagtttaaggttgacaatacaatatagcagagtactattacaatatattagaagtctatagttatataactactaggattttagtttatcattgtaactataaaccaaaaggcctatacaagtactacagcctgcactatcttatgtactccaaaacaaaggccactttctttgctcctagacttctgttgagacaaaataaattgcgacatcactgtgttgagaaccaggtgttcaatctgcctctgcccctccctcttgcacttggtcggccccttgcactacccctaccaccaatcatgccaagagaaggagcctcgtttgagttttcatgggacgaagatgcaaccccacgttttcttgcctatacaacagaaaagattagttgtttatataaaaattggccgtaaaattgataaagtcaaactaaccttaatgtttgagcatgtgtgtccatcccttctacagtttgagcatgtacttgtagtcttcctcgctggtccttgcaccctaggaccctcatctggtcctctacgtcgacttttctttggccttccaacatgtttgtcaaactttggtggatcaatataaggtgaatctgtttttgtccatctatgctcatcagggactggatagataactgcagtatatgttctcatataagcatccttcctaaaataatcagcgacataatcttcaggtgtatgccctgccttgtataaagcacaaacatcatgtttgcaaggaattcctgttagttgccatttgtgacatgcacatgtccttgcacttatgtccactgcgaaagatctatctaagcaatgaacttcccaagtagttaagttagactgataacaccagcaatatcttgcatgattcttctccatctctagttttcctgccacaattggtgtaatctcccactgtgcagcatcccctccttgcctctttaaagataaccttaccattacttttctccttatgtgttcgaccatagtgacaatgggtttgtcccttgcatctagaatatatttattgaacacctcactcaaattattgacaactaggtctgactttgctttaggtgagaaagcatgcctactgaagtgttccttgccaattgcaataagccattcccaagctttcaagttcaatttttttaagtcttccatagctttatcatagtcccacacggttgtggcataaattgcagcatcaacaaaacccttgtatttctcacctctccaacctttgttgcccatattttgcaacaaatgcattttacaatatctatgctcgctgtcaggaaaaacaattgggattgcattcataagaccctacaaagtaataagatcatttttattgaaagaatatcattacttaacgagaaatgattttaatctagacatgtaatgtaccttctgcctatctgacatgaaggtccaaccaccatgttcttctccagatccaattgcacacttcaacatttctaagaaccatgtccagttgtctgtgtcctcttttccgacaactgcaaatgcaattgggaacatgttgttattctcatcccttgctgaagctgccaacacctgtgcaccatttgttagcttcacaaaacaaccatcaatacctgaaatttacagtcatatatatattagtacagaaagacatcatacaaaggtaggtcatcaattacttacaaatactattaactcacttatgaaaggcctgcaaccatttataaagccttctttctgagcactgaaacatatgaatagtccactaaatcttggtgctaatcctaaaacatctctattgatggttgtcaccactgctgtagtgcctgggttggtatcaattaatgtttgcaaatagtctctaatcctcttgtattgcttttctttattgcccaggaccttctctgtagcctttctccttgctctataagccttactttttgatatgtatgtgcctgtttccctcagacatctggccataaaagcttcaaccttccaatttggatcactccaaaagtcatcctcatatctttcgcttagccatgtgctgtcaactcgggtgcagtttctatgacttggacatgtgtggggagcaatcatctctctaaccatgaaggttttctcgctcccaacttgtgatgctctaatgaagaaatcacacttaaccttatcttgactacacttcacttttatcctatcagctttattcctggtgtacttataatccctcccttttacaatgtggtacgacttcaaagcctttctaaattgtcctgcgtcggtgaaacacatgcccttgcacaattggcttgtgtccatcatattgctctcgtcaaaataaatcctctgaacttgaattccttttcctctcctccttttccctggtggtggtttgttctcttcgtctgtctcacattcaagtgtgctcaatccaccatcctcactaggtggatcagacagctcacatgacatatcgtctatgtctgcaacacccaaatctacatcagcgtcctcaggggtatacaaatcatcaatatcagtgtcaccttcacaatgggtcattggatcttccctctgcctcttcatctcatttagtttctcaacataatcgaccttttcttgttcatgatccgtgtcaccacttgaaatgctatgttggtcgtctgccacgcctatcagttcagggttgtaatcaatgttatcttcctgctgagatgaccctgcaatgacctcaacattatcaatttttagaggagaaaagggtgttctctgtattgccttgaacaagtgtaaatcagccatcttgctcttgtcattctccatgatcatgtccttcacatgtgtttcaccttcaatcttggtcaaagtgccacaatagtatgtatcgctacttgtgaaaaataactcatcacttgcttcataaccctctgtttccaatagcctgatcaagttggagtagcatatattatttctctctatctttttctccaaaatatcagtgtttggtccacgatcatgtttgaaaaccctgagtgtccaatactcaccagccatcctatatcagcaacatatgtatatatataaatgttatttgcaataattgtttaaataaatcataggagaagctaacatatataatacaacttcatttaaaccaatataacatcggaaactatgttataggaaaaaatgtttaaatgattagttattttaatttataagtagtttactagccaattaagataccagtcacttaagttgttttattttgtaggtaagtaccactaaagacaagaagtcaatgcaaggggaaattgtcccaagtacaatctttgctatgttgtggcaataattcagtgtacaaggcctcatctcatctctccatcaggtatatgcacatataccttccctcctttgtttgttttcagtggcaaaactgacagctacatcttactacatagttggttgcaaccttacttgtgcaaatgcacacacattcagaaactaaactaattcattcagtacacaattgcagaacctctgttattagtgcatctatatagtgtgtgcaatttatgtaataatcctaattagtattgcatcgcatacaaagtgcactgattgaactttgaaagatgctccttctgggaccaacacacaggagagaagaagattaaagtagattacctttacaatccgtgcaagaatcaagaatgatggagccactgctgcttgatggctacaacagatgaccaaatcctgattagaggagagcagccgagcggccacagcacactgagcagcgctggcgaaatcctgattaggccgaccaaatccaaatcagggcagtactgcagcctgggggagggagggctgccgtatgctgagtgggtggcgacgctgccggcggtgcggcgctggaaccctcgctgcgtcggtggcgcggcgctggaaccctcgcggcttcagcttcgcgccctaccgcgtgacttcccgcgcggttcctttcgccataaccagagtttttcaggccatctgttttacagagttttccacgcatcgtgtctcggcggctccgcataattcttccgtgaatcgagtccaccacccgctgctcatgtggattgggttgaagacgacgtggcggcccaaatcagtgtaacccggtccaaagtgcaatggaaggtaatattacccggtgttatgtgaaaacatgggcctaggcctggtccatattgaaactttggctattaaacctggcccaaagtgaaatttactctaataataataatacttcagatgtcacgcacatttactgtatatcgctatgggtgaaatattggatatagttaagttcagttcataactatgcttttttttgtgtgtgcttattttctaggtgacgtatattttgcccctatcaactatagccaagtcgaaatcaacccttcactatgaaatcagatattctacaaccctcagctaactgcaatcccacctgtttaatggtgattttcatgatttcgacaaataagtgctaatccgatgtaccttgtacctcatgctaatctggtcgagcaaactcactctctttgtcgaggtcgaaggtggtgaggtcgaggaaccatgcgcgggtgtagaagctggttcctgtcttgggatcatactcgaacaacttggacgacaattcttttctcctcgcccacctctccttcgcctccgtcgacgtcatttgcctctcccgctggggctttaggctttcctcccgccgcttctgcttcgccgcttccacctccgcctcctcctcctccatgaaaaacggaagatcaaagccttcctcctccacctgctgctgctcaggcttcgccatggagattccttcgcggacaccctaatccataaataaaattaaaattgaaaccctaatccataaaattgaaacagatcggactgaaccaggttggaagctagaaagggcaaaatcctcctacctcctcttctccgccgccgccgccgcactcgccctcgtggagaagagggaggttggattgggcttttagttttaggattgggaggtagaggtaaaatggcctttacgaaccaggcccaatttatcgtttccgtaaggaataagttcactttggctcccttaaaaagtctaatatgtgaacctgaaccgcaaccctatcttgacccctactctgttaaaaccagtggttttggagagcagtttcactgacgtgcgtctacgtgaaagtgttgacctgatctgccattgacgtggcgcataggtggcatttgaattgaaaacatacacgtgggacccattcgtcattcacacgaaagaaaatatatatatggggcccactgacatgtggggccaacatgtcaatctatcccgtctttctcctccctctctcttccttatctcactcccccttcggtgagcaggggccagtgatggcggcgcgggggccggagtggcggcggcggagacatgggacctacgcgttggcccgcctaacgagtgcgaggccagcaccttcgcctcctccgaccaaatccaccgacgagcccacctgttacgtatgtcgccgccttatcctcctccttcggttggctcatcccctcctgtgagccgcggcaacggagacagcagtgcggtgctggcctggatgtgagccgccagcccgccaatgccgctattatcgattggggtggggacaagattgggaatcagcgggaagagatggaggggtggtgagagagagaggcggtggcgggacggagctcggtgccggagctcgagggtggtggggacgatggtgacgggagcaaataatctcacggacacggatatgggtaggcactacccgtgcccgtcgcgcccgattgccatccctagggacagcggtgacgggagcaggctggggcacctactgctcaccaaggcggcgtcggcgtcaacctctccgcgacatcgctgtctcaggctcctctctcatcgaccgaagtggggcggagcggcgaacaaggaggatgccgcctcctgctccgggctctccttcctcctcccaactcaccagccacgaagcttgccgcccgcggcctcctcaacgccgctcccccatcatcatcccgctggtgccacagcaggatggcgcaactccgcgctcgtgtaatatgtttatcaaggaaataaaaattcctagatttctcaaatatagatatcagaaataccatcgccaattaccgtcacttgattcatttttattccaactcgtagatacttaaaaagtactccctcggtcccataatttaagggattttgagtttttgcttgcactgtttgaccactcgtcttattcaaaaaaatttggaattattatttatttttttgtgacttactttattattcaaagtactttaagcacaacttttcatttttttttaatatttgcacaaattttttaaataagacgagtggtcaaacaatacaaacaaaaactcaaaatcccttatattatgggacatataatatttatgagggctgctatataccggtataccgttcggacagtataggcctacaagcagtttagccggacgattccttccgttcaattagtatgtcatgtgtattgtcatcgtgtctcaaaaggtgtgtcgtgtcaccccatcaacccatcatttgtcattttgtccacgcgcatacgcaaaaaaatttttcatgtgatagctaagctagttcggtatagcaagtagtagcctacctagctaccaggtgtcaaatctgatactaggtaggtatcacatctgataccgtcggatgagcatcaagtctattatcaggtatcatgtctggtaccgagtgggtgccatgcctcataacaggcatcgtgtgtgataccggttggtatcaagtaccagataaccggatggccaggtatcatatttgatacatggtgggtatcggtcttgataaacgatacctgctggttatcaatcccagtatcatagctgctatataccggaattccattcaaaaacgatatgataccggttagtatcatgcgtttttgccacatatcaggtgatacttacgaggtatcagatgatgcctatcaggtatcaagcgattcttaccacgtggtgagtgatgcttgcgatgtatcaggtcctgatacctagccggtatcgggtgatagctatcaggtatcatgcgattctaccacgtatcaggtgatacttgtgacgtatcagatgatacctatcaggtatcatgcgattcttaccacatggtgggtgatgcttgcgatgtatcaggtcctgatacctatcaggtatcatgcgattctaccacgtatcaggtgatacttgcgaagtattagatgatacctcatgcgattcttaccacgtggtgggtgatgcttgcgatgtatcaggtcctgatacctaaccggtatcgagtgatacctatcaggtatcgagatgatacttatcaggtatcatacgattcttacaacatagaagaggtatcatgcaattcttacacgtagaagataattctaccacactccatagccaaccatgaccaggtcaacaagctctttgcaccccgtcttgtctctttgctcccctgaagcagcagatagataggatgaaggcccggactcgcagcgggatcgacggccggcgacgaaggcggcgactggagagggctcgcgacggagttggggcgctggcgaagggtgcatcggccggccacgcagatggagctggaggtgagtgttaacagcggccccgtggatggtgggcggcggtgctggagctgcaggcagcaatccgacgaccacgtcactgtcggccgcatcctccgccgtcgctccccacgccgggctcgtcgccgcggccacgtcctccgccgtccgtgcctaacgccatgctgaagctcgtcaccggagtccgcgatgccgggggctcatgggggcggccgcgtcggagctcatcgccagcgaccgcgtcctccgtcatgcacacccatgccacgcggctcgtcgccgcggccacgtcctccgccgcccgtgcctcacaccacgctgaagctcgttgccggtgtccgtgatgccgggggctcgtcgggggcggtcgcgtcggagctcatcgctggcgaccgcgtcctccgtcatccacacccatgccacgccggagctcatcgttgacttagttgcagcagcacgcgtgagagagatgttgtagaaagaatagctaggtagaagaagagtggattggttggtgtatatgctatcccgtcgggacggtataccggtatttagcatttccgaatatttatatatacattctgaataaataaattataatatcacgccaaccattttctagttggggggatccaaagtgaacttattccttctcctgtgctagaattgggtctacttcgtgaagggctcaacccatctacagcccatacatccagcctctccctctcgtttcctctctggatcggtcgatctccacggtggagatggtgagggcttcggcggcggcggaggaggagaggaggtgggaggctcttgctatttgccaccatggcggacgtgtttgatcttccattgttcgtggaggacgacgacgaggatgcggcagcggcggcgaagcagaggcggcgggaggagagccagaagccccggcggccgcggcctcgggagccgtggtttctggacacgccggagatgagggagaagtcggcgaggcatagtgctttggcggccaagtattgggagcacgaccccaagatgggaatcagctactacacccgcgccgttttctgcaacctcaccaccttcgaccttgacaaggagagtatgtactctacacctcaactagtatgttgttattatcatcgcatcacactgcaagattactgggatgatgttgttcctataattattcgaattgtatctatctatctattatattattaaaacagttttgaaaggagacaccacgttcgctctgtggaggctagaaattcccacattaatcgtagaaaaagaaaaatatttaaaccgttagatcatagtagatctagattacaacggttgagattgattgtatatatatgtaagtcctattcagattttagaaagatatagcacgaacaatataaatcatgtttggactcctgttcatagtcggattcccagccggacaaagcagaaaggttcttttgagctgattacaacaagctcttaatgactagcacatgctaattttaaaaatatacttgcaagttatatgggttctcttttgctttcaagtttctaatcttaaattctaccaagcaccttttagatattcaaacaaataagaactaagatgtacacgacaaattaaatttctacagacaaatcatccctgcatttttatatgagcatcattaaaaaaatactcccttcgtttcatatgataaatcattttgactttggtcaaaatcaaactgcttaaagtttgaccaagtttgtagaaataataataacattttcaaccaaagacaaatatattatgaaaatatactcaattatcaatttaatgaaactaatttggtgttttaaatattattatatttgtctacaaacatagtaaaacttaaattagtttgactttgaccaaagtcacaacaacctataagctgaaacggaggaagtacattattaagataagtttaaaattagacatcacgttcgccctataggtctataaattattttcacgaaaataagagagaaatacaaagtctacatcattagattataatagatctagactgtaagagttgagatttaatcgaaatatgtgtaaaggcttgactatgtatttatgaaagagcgtggaaatagaatttgacgtgtgctctacgcaataccctttgaaatcaaaatcagattagcaaacttaatttactgacacgagacaatcacgtcctgtacgcataaataaattagaaattgtatatacgcacaattgacacgtcatgtacaaaatcatgtgcatggaaggcaaaccagctggacagccaaactccttcaaccatattcaagttttgcactatcccgtgatctctagagagtagagacattatgttttcttctttaaattttcttagtaacgagcttccctaatagttttctctatatttaggatccatatggcaaagttcttactctgaggatggggcagagctgaaaagcggtaaaaattaccatattaatagtaaaagagtgaaatatttacaggatctagattttaatatgatgcatattgatcgatatagttttatacagataaattatatctatctattatattattaaaacagttttaaaagaagacatcacgttcgctgtagggctagaaatttccacattaatcaaaaaaaagaaaaatagagtccatgtagaaatacaattcagaaatatctaaaattcggaattaaaaataatcaacattgatataataaccaaatacaagattaattaaaatttgaaataaaaaataaaataaaatccaaaattaaaaaaaagaaaataagatttcaagtggaaatacaacttaaaaataacttcggaattaaaataagaaatattaaaagaatagtccatagagaacacaatacgagattaattaaaatttagaataaaaaaataaaataaaatccgaaattagaaaaataaaaataagagttcaactaggaatacaatttataaataacttaaattcgtaataaaaaaataaagactattgaaagaggagacaatgtagaacacatgaagagattaattaaaattccgaataaaaataaaagaaattccgaaaatagaaaaataattataagatttcacgtaggaatatgatttataaaaaaatattggaatgaaaagtatgaaattttcaaacaaaaatttcatctagaacacggatgacaaatgacaataaatattagagaagcaacatatctgtaaatgagtagagttgagatggttgatgggacatccaaaaactattaacaaaaccccaaatacaatcccaataatgattaaaaggagagatgacagatatgtcgttaagcaatacagtcacagtggttggcaagacttctaaaaagtaaaaagtaaacctcaataataattatgtttgattaaatctcaatgacattaaagatgggaggtagcgagcgagccgtagatgtgtccagtagcaaaaccgttgatggtttggtgggacttctagaaagtaaaaaatgaacccaaatgataattatgtttgatttttaaaatatcagtgaggaagcagccgagccgtacatgactatagtggcgcgtttgacgagacttctaaaaattataaaaatgaaacccaacgaggcaataaactctaaaaactataaggtccaatttttaaaggttcgggacttctaaaaagtaataaaaataaaccccaacgataatcatgttcgattttaaaatctgaatgacaataaagaggggaggcagcgggtgagctgtagaagagtacaggcagtgggcgagccgtagaagagtacagtggcaaagccgttaacggtttggcgagacttttagaaaataaaaaatgaaccctaacaataattatgttcaatttttaaaatcgcaatgacaataaagagaggaggcagcaggtgggctatagaggagtatagtggcagcatttgacgagacttctaaaaattataaaaataaaacccatcgagacaataaactataaaaactataaggtccattttaaaaggtttgatacttctaaaaattaaaaataaataaaccccaatgttaatcatgttcgattttaaaatctcattgataataaagagaggaggtagcgggtgagccgcagaagagtacaatggcaagccactctgtttggcgggacttctagaaagtaaaaaatgatcccaaataataattatgtttgattattaaaatcccaatgacaaaaaagagatgggacaacggacggatcgtagaggagtatagtggcagcgtttgatgggacttctaaaaattataaaatcgaaacccaataagacaataaactctagaaatcataagatccaattttcaaaggttccaagcagaatgaatagaaacaatggtagattgagccaacaaaaaaataatggatgacttttaaaaactataaaatttaaaacacggggatgataaggtttggtccttcaaaatcttaatataacgagatgactatttaataaattttaagtaaaatcatattaaaagtagataaatttatatagatgctagccgcgcaattgcgcgggccacccagctagttgtaataataataaaggtagtatgtggccgtctactaatctctagccatatatattccataaagcaatgcctactacgcaggatcaaattgttgacacctctcaaccaggaaatccgattgaactcacacacagcgaatggcaggtcaataattttcaactacatatggacaggaaacaacgcaataagcaccagaaaaaaattaatacagttcattaaatgataaacattttgttcacattctatcaaaaatagattagacaaatatattcttaccattccaaccctaccatggtccatgtatctgcttgggagctgttgttagtgaagaaaactgtttccttaagattcactatctaggtgggatcctcactaactggggaaaattgattattcctttcttcacatgatcattcccccctccttatgttgcaattgatcacttgaaggcagttgactatttgccacttctggtatgaaatggtcgtctgtcccaattccttcctcacctcccatgcagcatcaaactgcgatggtgactgagaagaaggaatttggttcggtggcacaatttcaccatcttgcccttgatagtcagtgttaggaccaccagctgccatgggccaatccacatgctcattgctaggggccttgtttctgcagtgattgtgaattagcggtgagttgtatttcttcttggagaccttgcactggagggcctagacgctggccatgagctctagatgcgggtgtagaggcataaaatgtttgactgcttaatccagggtggagggtgaggagggaaatcacggtgctgttgtctgcccacgcatgctacgtctaggaacgctatgtcagggatgaagtggaataccaggcggagatgttctagtttgcctcaggtcaaagtcaaacacagataagctgttatatatatgatgaattagacagctcatactggctttgctaagataagcagggattggcaatccaatcataccccttggtggtaaaataccagaatttaacttgcatgcagtatgctattgaagctcatagatctatttgagcaaacggacaggtgcatggtaggaactttctcaaccatggtagattaaaaatggctgaaatactgtcccaactgcaataatttgattcctgaaacagctaaaataattttaacaacagctcaaaacaaaggataaactctatttaccctatgcagacctatgtcctctagagacttttgtactccagagacattatctcgtgtatacttcagttaaattcttccctgttgcaaactaactacattttcatttttctcagcgcaatatggtccaatgcgctttacagattcaattatcagagaagaccacaggttgactggctcgttaaatgtactttcgctgaaggtgaaatcgtcagatgttggttaccctatcaatctatatgggactgtgatagtcagagatggattagattttaactgcaacttcatcttccggcgcaataggaacaattgccaagttatccagtcagaggtgtttcaaagaatatctcttaacacttccaattttccctatttcacatgatacattgaactaatttctttacagttctgtacagttaaggcatactgaagctagctacttttatgctgtctatatgcatccaccgtacccctagtttcatatgaaataccaatacttatttctttttcgtggatttgaatattaagtaacattattgtattatactttcgttagtcatgtcatttaaataataacaatattatattctatggataattctataatttatttttatataaagcattagtatgacatattgctaatgtcttatgtaatttttcttgcagaatgaaaatataattctcacgggcccaactagaggaattgttttccatgatatcttttttgagataaatttgaagattaaggaatatgaagagtgcaatgacaaggaatttagtaaagggttgcttgagatgaagtttcacactcgtaagtctaagattgtgagtgaaacctttgagagtaggctcagtgaggtggaactagtatctgcttgtgttaaggaagccctggagggcactgttgagatcacgattctgtcaggacctaaagtttttcatggaaaaattagtgcttgcacaacagatgtttcgaattatattgtactgtatgatagcaatgtttgtggtgcaacctcagttggggatgacagagttatgcaactgctgcgacgtgttgtagcagtatcagcaaatgagatattgatactgaatattcatgcccataatattcatcagaatgataacgtatccagtcgcactttgaggttcactccacttgctagaggggcagatgaggaggtgatcaattgcgatctttacaagatgcaggtgaaagttgtttggtcagtcttcaagggttagaatagaatatactcccttcatccaaaagtctaagacctattttatttttttgtttttaagtctaagtcatatttatagttactatgtgctatattaaaataattaaatgctagtcgaggtggaaggtggtgaggtcgcacaagctatctactccctccatctcataatataagcgattattttaaggatggaaaaaaactgcaatacccatattaaatgtgattttggttgtggtgagtgggtagttgggggttaaaataggttttgaattggagttgatgaatatgacacaatcttttatactgtagaagtagaagggataatgggtgtgtttggttgcaagtcacattttgccacagtttgccacgcctaaggttaggcaattttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctggaaaccaaacagccccaatatctcttatattactagacaaaggggtaggggtagacgtcttgggatgtgttgttgctgcttcctcctcgtcttgctgctccggctccatatgctttctctgatgccgggtggttctgtcatggtgggcaggatatgggccttcaggtggcaggcccaatcctccttttttttttgtgacacctataactcacgtaatctgcacagaaaacagtaatgcatgttcaagcacaaaataaaaaacaaaagtacatatataacactttccatcatcagatcagagacaagtaaaagaaagaaacttacttgcaccgaattaacagtgcatcaacatcatcctggattacattacattacaccatagtacagtacacatgactggattaacaacacacaatgacacggcagacacaacaaattaacaaacagttcagcaaagctgatactaataacttcagcttaaactgtaaaaactaaaaacaaggcttagggcttaggctagttttgtgccctgagtagtactctagttatgttacagcatcaacaacaacccatcactcactcatattgacagctaacagcttcctctctcttttcttttcatctctctagtgctaaataaaatttgtacagcagagtacgtatactcatcttcttcttcctcctcatctttacaacttcttccttccatattggattagcacttgcacacatcactcactcaatccatcatccatccctgctgcctgcggcgtgctcctcaactacataatatacactctccagtgcaagcgattttaagatgcgtatttttattatttctcaaataggccatactggcctacgtttttagttgcaaaaaacgaaaacgtgagtgcaaaccaaacctagccactgttagctgtacagcattgcttgcccttcaggcggcactggtgcatgctggttgaagccctagtcgcttctctgcatttgcgtcgcaacaacgaatattaaacattgttagtccctatggcagcaagaaacaatggctgaatgacaataagacagtacaatcatacctccagcagcaacaagcttctctacgcgtgctactatgtgcttcccataggtatacttcttcagcgtgttcagatgtgcttttatccttgtaaggatcgcctccctctgctgatcatcacaagtctctagcaccttctgcaccacatagtttgcaaactgatctttcatcattacctgcaacaggtgcagcgcagttaacttccatcaggtctctaaaatcagctttccatcttacaagatttagcaaacttgtagctggacaaatcttaagccaaatttggtttgtataagttttaagaatgcaaacctcaaggtgttcactctcattagtggatccaagcatttcactgatcaaaatctgtcgttctacaggattcccaaaggctaagcacttctcaatgacatttgaggcaaacttttgctggctcatttgaactatttgtccaattaacttctcgataatagcagatctctcatgtggttttccgtgctccagtacatgctgtaaagtagtgtgttcaatgttaaaacaaaaaaagagtgaaaataaaataccttcaaactaacataggatgccaagattctaagaactaagactgaaaagtgaagcagaattcaacattagcacactttttttttagataatggaatgcattctggtctttacttcagagaagctacaaccaattcttacagagtttacagggtgaataaccgtggattacaaaattatggcttaattaaaaactagaaaaactactaggaatatcataattgttgtttcaacaacagcagatagttagcagtaaccatccattcatttacatattactgtgacaggacgggtacgatactggaagatcaggaaaaaaacaacctaaagatgctactgcaaaatcagaaaatggtctacctcacttcactgcaagtcaccattaagaaagcataagactagaaatatctaaatcttaagaaagcatcaaacaactagaacacacatagtaattgcgaagcagtaaaatcattttgaagtaattacgttacactatgtaaatggtaaaacaatctagaagtttggttaggttcaaaaggtatatgatacaaatcatacaatttgcaacaatgtcatggggcagacctgaacaacgtagttgccgtattgatcttgagccagcaagcaaacggactggagaatctcatccatcattatttgctgtgttgtaggatcatcacaatgctccagcaccctctgggagtttcacatgaaggatgacaagtgagtttgcatattaacatctgtaaacctcaacataaactgattacacgcatattatatgcatacctgtataacccgacaaccatatggatgagtggataacatcacaacttgaccatagaatgttgagacaatgaactggatagcatgttgagggatgcattctatgcatttctgtattacatggttcccattttgatcacgtacacagcgcatgacgtgtccatccagctcagcaaccattttagtctgctgatctaaaccaacaacctctatagcctgcatatatatcatccatgacatcagattttgccttccttgatatccttcaatcatttatgcattcatacacttaacaaagggtctgtactttgtatagataagagcaagtcatgactacatcaatgcctataaaaatatttcctgaaagtgttccatagtttggtactgttgttattggatgacagagaatacatctgaggtgtcttacatcagaagtgaggaattgtaccattcactgataaaaatacacacaacctcaatcagtcacgacaattttgttttgctctgctcttccaatggttggttctgaccatttatgtatttgtataagtaagcaaaaggagttgtttatggtccttgggaagtattgagaggtagaacaagttttcagtgcattaaatagtaaatgcaactaggacccattcaaaagggcaataacacagattaatcagataaaaaattccaaaaaagcaagaactcttaataacttccaaggttaaagaaaagatccagtaataaccaccttctgtataacccggcatccatacatctgaagactgagagcaagaacacgtccaataagctggtcggccaattcctttatctgggtagggcttccgtgctcaaagaactagtcaaatgacaaactataagaatatttatcacaaagtaacacttgaagagattatgtttttccccttaacccctttaccttctgaacaacataatttccaaatacatcggtcatcaacgtgagagcttgaggcatgatttctgaaaagaccatgtccttctcttcagtactggccgtttctagcttttgctgtatgaatcggcttccatattgatcagcactataagtttgtcaattattagtagataaaccatgtaacatcaataaggacaaaagcgttgtcacaatcatagttaacaagagacagatcagatggaaacagtcacatgtcttgatgtcttgtactaatgtttttacatactgtagcacatgtcaaagcatatctctaacattttcttccccggaaatagatagaaacatgttgtaagaaataaatggagaacaaactagattaaaccaaatcataaatctacccatattattattcatgtcaagccttttttggttgatcattaaaaaaaaactagtcaaaagcattagtagccgcgctgtacttgagtactgcaattcagcaggctatagaagctacaaggttatgaaattgacaagtgtacctgaactcaacaacatgaccagcaatttttgagagctcataagatttgcttttgttgctcttgaattcctccaggagtgaaggcatcatatcgatgttcatctttccacctaggtcaggattccatgaaccaaaggagccaccaaagtttcttatacctgattgcatgcgcatgcggcgttcaccatgcctaagtggactaccaggtgcagcaggggaagagggaagaacaggactcatcaaaggacttccagaataaccaaggccaaatccaaggtttccatagtagccacagttcttctgtgactgaagcaatggactagcataagctttctgaggaccaagtaaatccatataagaacttcccagatggccactggccatgagaggatcatcacagctagctgcgagttgggcagcaatctcagctgcctgaaggtactgaatatatgacggatcaatggctgtttgaagagaagttgctgcatttggacttccaattccattgtaattcagaaagttagatccaccaaccaaattctgccttgaagataaagtcccacctggggacctagaaccgatcctaggagaagcaaagcctgatccagcagacagattgtcaaacgatgtgaaactagcagcattaatttgatttcttatcatagaagaattaggcgagtttgcagagtaaccatcaggtgccttaaaatgtccttgttcgggatgtttcatataggagtgttgctggttgccatttgattgatcaccctgacgatcaaatagaaacttacggacattatcaacatcctggtagagctcagactgggtcacagtttgctgtccactagctgctccagatgatgataaattcatcccagataaagcagctatcagattatcagattcaccaatagcagacgaacttcgacggaaggaagatgaaccaccattgttcttcttatcatcagcactgactttcacaccaattggagggaggcaaggactggggaccctcctaacaagctcaggatctggagatgcgcttctagaaagagatgatcctaaaagagaggcatatgtatgtgctgatgaatcattgttctgaacttcagccaagctttgtatattgctgtcactctgcagaccacccatagctctactagtctcacgatgcagagcatactgtggccgagaagaatccagaaagtcactaatgttgcggtcggcgccctgcttacccatgtccagctgatacgagctctcctgcatagtatgcaacaagttgtacagctctgatcaattaccttggattggataagatgaaactgaataataggaaaccaacagttcacaaaggcgtactaaaatgcttatgatcagcaaaccaagccaaaaaaaacatagaagttgtgaccatcaataagaacaattaagcttattaagtggttgaaccatattgggtaaggtggactagtgagacagcgaggggaaatggtagttgaacacaaaaacattactacatgtagcaataaagtcaacaaatgcacacagctgcaaggtcaagaatatcatctcccatagcatacagtactgaatcaagatggacatatactactgaaaaagtaagtaaaaaaagaagaagaagatgatgagatctttaattcatcaaaagggcgagcaaacaacctggaagatactggagaagctcccctgccgatcgaggtcgatcccgggcaaccccacgagcccatccccttgcgccgccgcggccggttgcctccagccgtcgccgatcccgccgaggacggaggagcgaagacggtgctgcgccgagcgccagtcctccttggagagcagcggcggcgggaggcgcgggttgaggtgcgcattggagtagtagtagctctggtacaccgggtcggcccggagctcatcgtccaggaacacgtcgccggcggccgcggcggcgctggccatcgcgccctccaccgtcggcggcgcggacccgctccggaagagctccatgtcccggtccgccgccgccgccgccgccgcctccccgcgcgtcgccatctccgtcaccatccgaaaaacccaaatcaaaaaagacgacgagatctacagtgtctcaccaagctaaaacccccgccattacagtcgcaagaaagatggccaagatttccacccccaagaaaccaaaaacaaaaacagaacaaaaaatgggcagcagaaacggatcccggttgctcagagcgggcgaatcggagaagaaaggtccatgtgcgggtcgagcaggtgtacggattgcgcgtaatggtgcggatttgggagggattcaagctcccattttagtttatttattcttcttttttttagctaagctaagctagtgagagagtgtgggggaagagaagagaagagaagaggcgagaagaagaagaagagaggaggaagctgggctgcggctcagttaagtacaacggccggagtgatttgggccgtcggatttctggctggatgttccagatcttctggagggtttgggccctagggttttgaggttgccacccttgccattgctgagagagaaagagagaatgtgtgtgcacgaatggtggtagcaagctaggtcaaggcttggttgatttagaaaatggagatttggttgagcagcgctcatgctcttcaacgacatgcttccaagaaaatgctacaacttctttactccgattcaagtacaactcgtgtactgtgtaaatttacgagtaaatttttcataaaataataatatagtggacaaataagtagatttttttctaacttattcaatgttttctttccaaattttataaatcaattaaaaaataaacttttatatacggcaaaaaagattacccacttatattcttttcgttgtttgaatactagaattaaacttcccatgatatattgaacatacatattctatgcaaaagtttatttggctgagtgaaaagatataggttataaccactaacccaatttaaaacttgctttttttaatgataatgtgaaaatcggaataaattgttttttatgaaaagaagagggttgactgggagacaaaagaaatcgcggacaagggaagaggaaaaaaaaggaaaacggtagcacttacttcttctagtactctattagtagtgcctgtttattttgatgtcattttcaactataccattttttcttgataaagttgtcaaaattttagctatatttagtttgttgctaaattttaataagtacatatgaaatcttggcaaaattttgacaaccttactaaattttggcaatgccaaaacttggtaaggttccaaatggtaacaaagtgaacaagcccgtagagtagaggcgatatatagccattatattcgtaaaataaacatttactagttattatattttaagatgaagatattggtatatataatactatagttagagcaggtacaatagcaagctataaatcagctataaccacgtatcgagaagaaaagagaagagagagaagaaagtgggctgcagatttgtagccagctgcaacacggactccaagatgttatgtgtgtatgagaggtgggacagagtattaatggtgtagtatatttttatagttaactattgtatgaattgactattagattagctatagataatttggatcaatagttggctatactattaaacttgctcttattatactccctccgtttcgaaatgtttgataccattgacttttttagcacatgtttaaccgttcgtcttattcaaatttttttatgagatatgtaaaattatatgcctacataaaaatatatttaacaatgaatcaaatgataggaaaagaactaataattatttaaatttttttaataagacgaatggttaaatatgtgataaaaagtcaacggcgtcaaacatttcgaaacggatggagtagttatttagttattggtggtgttcttgttgcacgagtcagcctaagtggccgtggcatcccaaacggatgggatggcacgtgactccatcatctcctccagagacttctttcctttgtgtacctctttgctcaagtgctcatctctctctctctctctctctctctctttctcttactaccatccattccaggccttgggctatcatctgcatctactgcacatcctgtccggcccggcccactagataaattgacagctgggccttattacactgcagtaaagctgttgccgtcaccttgttattttttttccttgtaataatggtgtggccaaatgttgtttgtcgcaaaacatgctagggaggatgagtgtagaggaacaaaaataccattgaggattaatttaccgaggcaaatgtagggaagaggaaaataaagataatcatccaaatatactacctcctcctgcaaatagtttagctcaattttgagctatacaatgtc

SEQ ID NO: 67533 - DNA, 7760 bp, Oryza sativa
cggacgggcgacggcagccaactccggcgggcgcgtagaagggcgacgaaagcgatggccgagcgggggagcagcggcgatgactccggcgggcacgtggacgggagccgacgccggcgggcgcacggacaggcgacgactcaggcaggcgcgcctaagggcaatgaaagcagtggccgagtggggaagcagcggcgacgaacacgcagccgagagaagtcaccctaaactcctaatgtgtgattaaaagcatctaatcattccaaagtgtgattaaaagctaatcaccccaaagtggcatttcattaagaagtatcatctatggagtggcatttttataaggacatcttatgaggtggcatcatgctaaagccacccctatagagtggcataatgttaaatttctcttaaatacattgttcatcctataccacttaacggaagacggctaacggaaccctaacagcaatgacatttttgggataaagtcacttgtacgatggtatttcatgaaacacataattttcgatgatattccttggaatagaacacttgttaatggcgtttcttagattttctctattttttttccaaacctttgtgatgtgtggccgccaaattattagccacgtagttgtcaatgctcatcgacgatttggctaggtttgcaaggatgggtggcaatgctatggagccatctaaacatgccctaataatctaatttgaatttcaactattgaggccaacttgagctgacactcgcagtcgcaactcgcaagtggatgagataggaagatcccacagtgctactactcctgcttcacgtggtgaacagacaacagtgtattgaaagccacattttgtcgcttaatttattaccagaacgcttaaactagcttgaacatgagtattagctgaggttcgtggagtactcctagatgacatagttttgacatatgtatatgtgatagtcccacatgtcatatcgagatggaaacaaaaggattcttttttttctaaagaaaaaaggaaaaattgaagactgatttctagtctacaccaagggatgtacgtaaccatgcattcagatcgagtcactaccacatactcccctccgtaaaaaaaaaatcaaaccctagatttaaatttggacatagggtttgattttttttaacagactagtacttctcaattttggtgaacctttttttttttacctttgaaccaactagctagggatttgattttgatatcttgcaaaaatggctaggtggtgtatactgagtgtgtgtgtagagttctgttattgtattgatatactgtttttgtatttggttaattcctgtaccaggcaagaacgtgcatcagttgattttaattgatcgccttctatgattgaataattaatatcattagaaggctaccttcgacaactcatgcatgtcacccttattttatcctgcactataagaggatatcatagttagctatcttaattaaaccgagaattttctgtttgattgttattcatgatcgcctggcagcagagatgccgagatacgtacttctacttggatgtttatatctatttctaacccagtgatgccggaagaggctgataattggatgcacttatcaagctaagataattatacgtttggtaaaattttacagtaaaagtacgcgaaattattcagactagtaatcatggaattgatcaaacatattgttcttttgcaaatagacaaataaaacaacattaatttgaaacactatttatttgaagcagcgcaaatagataaaaacaagagtaaactttacttgggccacctagcttttattatgaatgttttcacttggattgccctttaaccgatgctttcactttggatcggataatcttacattgtaacacttggatcaccctgactcttttctcaaccatataaggccatcaccaatgcgtgtctttgggttgttccctcgccgacagacgtctgcttttccatccgcgccggctccccacgatggagcgcgtcccccggctgagggacgagtctctcgccacttttcggctgagcgatgcagtcgagggacgcattggggggcgacgggctcctgtagacatcggttccccagctcgtattcctattccaccccttagcagagctagagtcgccgccggccgacgacgacgaagagggagagaggagcttcattgcgaccaccgggaccgggatggcttcctccgcgtcctcccagagcgcggcacagccgggacggcgccgaggcggacccataagagagagagagcggcaagcggcggggccgacgtatccgcggtggtggcgacggcggagtaggcggctctcctcgttgccctcaccaacgaagcttcgtccgtccgcgcggcgctcgccgtccgccgcctcgtccgcctcgcgctcaccgtcagccgcctcgaccaccgcgacccgtgcggcactcgtcaccgtgtcctcgatgtggcgtggccggcgccactccatccaccggggggctagatacggccatggcggcgccggatctaccgcctctggggtcaccgccgccaccttccacgggagaaagaaagggagagcggcgggagaaagcggcaacgggagatgcgggagagatcaaaggtgccccaaagtgaagactaggaaaaaaaagtgacatccatatgaaaagatctatctatttagatcactcgagctagcatcacattgatggtatttgtaactatggtttcttttgtttgtcctttattggaagatattgtttagaaatagctggataaaaccgttagttgctgtaaagttctatattcagcgtctcaaatgtaggtttatctcttactaattagttcaaggcatttatatgttacaagaatgataacaaacaaagcataacactaaaaaggagccatagtaaaagatgcacttttgaatctaataactaatcagctctaatgtggctagccaagtaaagtaatgccttctcttattctgtgcagaaatgccgctacttcaggacttgcagcagagtcagtatctaacaaaactataaaatgattgaaatgctcaagactttatctttggaaagagagagagagaaagaaatgctcgagacatggtatccaccaagtgtatcataagtcatactccctccattaaaaaaaaaccaacctcgcactaaaatatgacacatgctaatatgaggttggtttttttggacggatgtagtagtagagtagaaagcatcgtggccccattcagatgtttgatataaaaaggagaaagaatcaatcaagaagtcagcaatttagcggaaaatgcccaagatcaggggtgccgccaaaagaaccaacgctgatgtggaagtaaatgaaacatatgtatttaactacatgcgtgaatactttctttttttgttgatgtccggaatggtatgcctccacagatccacctaaaacattttgagaaaaaaaaattgcaaagctttgagcttggttttccgaaaggatgtccactggaaaattgttacaacaattttacatcggtaataataaaagagagctacgcacaagattaatttaaaagtgaatggatgcacagaaacaaaagtttaggctgtgtttgggaggtgtagttgggaactccacctcctcgcacggaaaatctaaagcagtccattagtgcataattaattaagtattagttttttaaatggatcaatatgatttttttaaagcaaatttcgtatagaaacctttttaaaaaaaatacaccgttaaaagtttaaaaagtgtgtgtgcgaaaaatgaagggattgagttgggaactcaaagaaacaaattaagcctcgggcaggttcaaactctaacgagaggtaattcgctactcttatcttgatcttggtggattgtatctgacagatgtcattgatacgttgatctagactatagttgtcgtgaatttagtgccactaaggagactccctgcgcatcttatataggtagaggcattgaggggcagggttataaggaggaaaaggtaagatacgactttaatttcctaatttatgcaatgtattattcagttagggctctacaccctgccttgtgtaaggcaacataacattcgagtcatactctattgtatatatcatggtttcggaccaccaccagtaccgtgtggatacttcttacctatttcctccatgcaacctctcctcaaaattgagaaaagaaaggccgtgtttagttgttttggcaaaatattttttgatgtatacgggcacatatttgaagtattaaacgtagactaataacaaaacaaattacagattccgtctgtaaactgtgagacgaatctattaagcctaattaatctgtcattagcaaaagtttactgtagcaccacattgtaaaatcatggcgtaattaggctcaaaaaattcatctcgcaatttacatgcaaactgtacaattgattttttttcgtctatatttagtgctccatgcatatgtccaaataattgatgtgacgaaaaagttgaaagtttgaacgaaacacagccaaagcatacccactggactaatgccatcctccatatggtggagtgcaaacgccaaacgatgctgagttttcgatttgcatttctgaataaaccgatcgtgcctgtcaagttctaaatgaaatgattatgcgtgcggttcatccatattttcaaatttatgttccaaatgatcatgtgatcggcgatccatgtatccctaggttgattctaaaatttaaaattgcctccgacttggctcacacaagcggacctaaagaaggccctgtttgagggagcttatcccagctgcagcttttagaaaaagctacttctgctagaagctactccaaacagtccacagcttctaagaatctatacactggtggagaaaccgtttgtagtcccggttggtaaccccctttagtcccggttgtccaaccgggactacgaatccgggactaaagatagctatctttagtcccgggtgaaataaccgggactaaagatcgatctttagttccggttcgtgttaccaaccgggactaaaaagatcgatcagccacgtggtcggccaaaccatctttagtcccggtttgtgttaccaaccaggactaaagatcggtgcaccattttttttatttgcatggccctgtttgctgcatggttgattttatatatatatatatatatatatattacacacacatatgtacaatttaaagcacttaacattttatgtgcatatatatatgttaccaaaatatatattaacacagaagtaaatgtgtacatatataaatatatatatatatacatgcatatatagtacaattcatttgttcggtagctatagctacgacttcgacgccggcgttgtgtcagaagaggaagaaccgacgttatgaattgtcgatccgtcgtagtagaattcaccgtcgggattaaggacttcttcgttgatgaatcccatcagttgttcttgaacagccgtgataaaatccttgtgtgggagattatccctcatgtgaatacgctatcgtttgaaaaataatgacgtatcaatatatgaaattaataaacaacttaacaaatcaatacacaatgaaattttgaatggtttatgtatacgtacatcgagcactcgtgttgtgcatatttggtttgataggcagtgggcatactcgcatacgtagtagccgcataagttagttccctggtcctgctttgcacactacatgagaaacgatgagagatttaatatactctttatattaaattagagattcaattcaatataattttggatcatgcatgtactcactggaaaatgaaacctccatccaagtttttctttccaagtcccacggaccaattgacggaaccgatcccaagccccacatatgcagttgcaagctatgattaattaattattacctgagatcaacataatagcaatagattccccgcgactttggaatagatggcattatattacctgtctatcagtttgaagaccttgtcaaaaatcttctcctctttattcattgagtcgtatacagtgactctgcatgcgtccaagtcaaagaataacaggacccagtggaatatgaaatatgcgtgagatgagatatatatgatcgaaaatgtacatgctatatgtatgggaataaaatttgttcgaacgacaataaaaactcactctgtgttgtacggcagtagtatgtacgtcttgaaatgctgctgcgttaggagatggacgagattgtcctctgtgtctttctcgtacttgtcgatcatttcggtgttgattttccgagggtcgatgaacccagtatcgtagaccctccgccgtcgggcccattgaatctccattctacaacgatgaaaggaaagtattattgcttatatatatgccaggagctaattattgaacgaaacaaatcgaactcaaagatactcacaaaatccatgcgctcagaagagagacgtcgagggtgtccaactggtacagatcgaagagatccttgaaatggatccagagaacatcttctccttgcaagaagtcggggtttctgatcctcgctccgaacatctctctacccttggcgctcatttccatgtaccgttcatggaatttgtacatctgtgtcgatagggactgcagctgttcaggtttgataagcggtttaccgagttcaaacttgtatgccacttccgccttcgggattggtgcgcctccaaccaactgatccacagttagaccggtgtctgaaatgaattccgttatgccaaaatcttcgctggtcaccaacggctcaacctcttggtttggttgttctccaagctgagggactggtttggacttcttgtgataggctctctgaagtgttcgatcatagtccgatatctgtaacgcttccttgtttgttgtggacattcccttgaagaagttcttcacgctcgggttaataggtatcttcttttcaggactccaaggcttgagttgcctcttcacctctcctgccacataagcatcaagctcctcttgactgcaatcgtacggtggctccttgtttttggtggcgtcaactttcgccatcttcgttgcccttgtgcgggcaggcggtggagcttggcgagaccttgtcttgggaggtgcaggcggacacggtggaggcggaggagccggaggagatggtgcagcaggaggtggcggaggagccggaggagatggtgcaggaggacgtggcggaggaaccggaggagatggtgcaggaggagatggcggagccggaggagatggtgcacgagacgccgcttatcgcccaggaaggatgatgtaccgcttgcgccatagtatgatggcgtggcttgtgtctcgtagatgcgtctcaccgtctcctcctgggtagtccaactcgaggtcctcgtacgcggcttccaccaactcaactacgaccctcgagtatcctgctggaatcggcttgcagtggtaagtcctggaagggtctgttgggatgaccattcccgacgccaccttcacgtgatgagaggttatctattaataatcaacctaagcagcacttgcggaatgtacaagtcaaaaatcatcaaactacgagtataccttgattgataagttcttgaagggaatatgcagctcacatggtgtccgttgc

SEQ ID NO: 67534 - DNA, 2578 bp, Oryza sativa
ccggcccggcagcgtgcgggtgcggcggcggcgtgccacggcgacggcgtgggggcccagcggcgtgcgggcgcggcggcggcgtcggggcccggcggcgtgggggcgcggcggcggcgtggcaagctcgaggcggtggcgacggagtggcagtggcgacggcgtggcgttgcggtggcggcggagtggcagtggcgacggcgtggcgtcgcggtggcgtggcgtagcggcccggcggcgtggcgtggcggcgtggcgagcttgaggcgggggcggcggagtggcagtggcgacgatgtcgtcggcggcggcagccgcgtcgaagtcggtcatcggccgtggagagagagagagatatcgagatcgagatcgagagagagaggcagcggcggctctcacccaagagatgcggcggcggcgtctgcggcggaggcggcgaggaccgccaagcgatggcgagagacgacggcggtgtcggcgtggggttgccctaggcacggtggaggcgaaggagaagccgagatcgaaaaacgtctaagtgttggtggagaagacgagggcacaccgggaatatatataccctcggatctttagtcccggttggtgagaacaaccgggagtaaaaatatctttactcccggttcgtaacaacaaccgggactaaattctacgcagaattcaatgacctcctcttttccataccccttggcgatgcttgcctctggacgagcacggttacaaacatacttcttcagaacgcccatgtacctctcgaaaggaaacatgttgtgtaggtacataggacagagaataccgatctctttgacaaggtgacaaagcagatgcgtcattatattgaaaaatgaaggtggaaatatcaactcaaagctgacaagacattgcaccacatcattctgcagggcttctaatctatcaggatcgatgaccttctgcgaaattgcgttcatgaaagcacgtagctttgttattgttgcccggacattgtctgggaggatatcccttattacaactggtagcagctgtgtcatcaacacgtgacagtcatgagactttagatttgtgaacttcttctccttcgtgcttattatttgctttatatttgtggagtatccagacggtaccttgatgctctccaagcattcaaacatactttacttctctgccttgctaatagtgtagctggctggactcaagtaatggcttcctttctcctttggttccgggtgaaggtcaccgcgttgttccatatgcttcagatcattacgtgcttccagtgtatctttcaactttccatatacacctaggaagccaagaaggttcacgcaaagattcttagtgaggtgcatcacgtcgattgcgtggcgaacgtccaagaattcccaatagggtaactcccaaaatatagagttctttttccacatcaccgcgtgaccatcttcgctctctataggctggctgccaggcccctttccaaacactactttaagatctttaaccatagcaaacactgttttcccgctgcgatgtttaggcttcgtacggtggtccgccttatgttcaaagtgcttgcctttcttccgtaccgggtggtttgctgcaaggaatcgacgatgacccatgtacacaaccttcctacagtgcttaagatacgtactttctgattcatccatacagtgagtgcaagcgttgtaccccttgttggactgcccggataggttgctaagtgcaggccaatcgttgatggttacgaacagcagcgctcgtaggttaaactcctcctgtttgtcctcatcccacacggggacaccttccttcttccacaacagtttaagatcttcgaccagtggtcttaggtacacatcgatgtcgttaccaggttgcttggggccttgaattataatcggcatcattatgtacttcctcttcatgcatagccacgggggaggttgtagatacacatcgtaacgggccaagtgctatggccactgctcatctctccaaaagtattcatgccatccgtacttaaaccaaaccgaatgtttcgtgcgtcctttccaaagtctttaaattttctgtcgatgtttcgccactgcgaaccatcggcggggtgtctcagcatcccgtcctgttgacgctcttcagcgtgccatcgcatcattctagcattcaccttgttcctaaataaacgccttagccgtgatattatagggaaataccacatcaccttagcaggaattctcttcttcgttagctgcccgtcaacttctcctggatcatctcgtctaatcttgtatcgtagtgctttgcaaacagagcatgcttctaggttctcgtactcctcaccgcgatataggatacaatcattcggacatgcgtgaatcttctgaacttccagtcctagagggcagactatcttcttagcctcgtacgttgtctcgggcaatttgtttccctccggaagaatgttcttgacgagttacaataaatcgccaaatgccttgtcactaacaccattttttgccttccattgtaagaactccagagtggtatccaactt

SEQ ID NO: 67535 - DNA, 22956 bp, Oryza sativa
  unsure (1)..(22956): unsure at all n locations
cattatcctcacagccccggcgcactcgcccgcagcgggccagccaccgctccgcgcgccggccgccggcctccctcactgaagaagaagagaggagaggagaggagagaaaagaggcgacgtcggggcgggcgcccgtgaaggtggagaagagggagagggcctcccaggggcggccgtggcaagagtgcgcggagaggatggcagtgtaggacgagtaggcaagggagggagagagggtcgacagggagagtgcgccgctcgccggcggcggggcccgaggtcgagcacccggcgcgttcgaacatctccgccgccgagctcgccatcgtgtcgaccgccacctctcctcctctcccgccgccatcgcggaccgcctctctctccctctcccgctgccgtcgtccccgctccgccgctggccacctctctctccccctatgtcgccgcgcccgctcgagagaacccggagagaagataagagaaaaaggaaaaaaaaaaaagagaaatgtgggacccacaccattgtctcacttacatgtaggccccacatattaatattaattatttttgctgactaggatgccacgtcagcgaaaccacccatgtatactgcctagggactttgagtgaatggttttttgtggttaatggatccaaaaaaatcttattgttaagttgagggacctccggtgaacttattccttttcgtcaactgttttcatgatttcgatctctcgcttgatttccacccgtctcctacctgctgccgtagattgtatcgcggagataacgttctgtttgtattgaacctttcctttttcaagcgagttattagaaacttcattaaaaacttttaactgtatccgcatgtccttcgcagattgcatctgaaacaaatccatatcagggtccttttttactctatacaggcacaccaaggtccttgtaacttcattttagcagtggtttttactatttcgcttgtctttgtaacattgcaatctgcaaaagcaacctcctgttaagccggatgatcgtcataatgagtattatgcagaggaggaataactgggaactaatttgggtcaagtgggcgtgtgtgcgtgtcttctgagttgtacgcgttcaacaagattaatttggagacaagatatgagaggtgattaaatccatttcactagtgtgcaatgagcaccctcttctctttataaattctgtaacggttgattttaacaataaaataaacttctacggttctacatctgctttcactgcaaacatctagtcatacaaaggaatattttgagccgcaatattaaaaaaatagggataaatataacaaaacacaaaattctgacatgaatataaatgtaaaataaatgattgcaaaatattaaaaaaacacatgaatgaatgtttaattgaaccgtagaaaaacacatgaatctaaaaatttcccacaagattagagctcttactaagttttcttcaaaaaatatataaaatgaaccattccatataaattctatagtatctgaaaagtttcaatcagtgaatcaaataggcacataaaaaaaagtcctatatgattttaatgctatgaaattcatgcatagaatcctttaattagcccttatacatcagtacttacaaccttgtcatcatgatgtacttcctccgtcccaaaaaaaaaacttaacctattaagggatgtaagttttttttggatggagagagtaactcgcaactctcttgccttgtggagtactccctccgtcccataatataagggattttgaatttttgcttgcaacgtttgatcactcgtcttattcaaaaaattttgaaattattatttattttatttgtgacttactttattatccacagtactttaagcacaacttttcgttttttatatttgcaaaaaaaatttgaataagacgagtggtcaaacgttgcaagtaaaaattcaaaatcccttatattgtgggacggagggagtagtacctaagaccaaatacaaacatattactcataatacaaggttagtataaccgttcgcaactctctcgtcttgcagtatatatgctccctctagtcatatagtagtaatactttagactatgttcggttagtcccgagagaaagattaaaagggatttatttcacacctattatggtgtggaattactccccctcaaacccctccaatccgctttaaccccctccaaaccaaacaaggccttatgttttgaaaataaaataatcaaactttataacttttgtttctaaaatacgaagaccatacgtaaaattagttttgtataaattagttttaagaagtacttcaacatccataaaatcatatatctattgttatttttatttatactatagtagaaaataaaggctattgattttttatatttatactgtagtagaaaataaaaagttacagttgttcttttaaggccgtttcgttatcaaccggagggagtagcacacatccaagcccaccgaaaaacgccccacgcagaaaccgggccctataaggttattgcaggcttgcagttatgacaattgacaagaacgatcactaaatcctgggctacaagagccttcggtgtgcgctgaaaaggtcagattaacactgaagcttcgcccaggttaatcgtgctcgaagttgcacaatgacgaggtgaaaggggccaaaacttcttttcccggttcgctggttttttaagtgccggcgggcgatgggaggtggacgactgtgctgtgtgcagagtagtatagagaaaattgattagcgtacaaaattgacccattgcatagttgtacaaaatcataaaagagaacagggtcgatgttgcaggaaagatctgaaatgtaaatgaacagagatagaggaaattagtgacgaatgagacgaagacacatcatccatctttattcatagaatccacagcaacaagagagatacaaacacacacagaccaatgtatgatacaaatgaataagaaataaacacaacatgcctcactcggaaacgcacccaacccaaccactgctactagtactactctatagccggaaacgactcgaaacgagccgtgtccaaatcggagatcatcaacgaaccaattccatccatcaccacctcgcgcgcctgcctagtgcatgatcccacccgcgacgaggatggacagcacggcagagcacgccacggccagcgccgccgacgccgcgccccccgcggccgcgcccgtgaccggcgccggcgccggtggcacgcccccgtccacctgcgccgacgccaccgacgcgaacatcacggccaccgccgcggccacggcgaccaacacggcgcctctagatgccatcgcaggaatgaccgagcacggcaagcgacgcagaagcacctggcagggagagagagagagatagagagagcggtgaaacggtagcggcatgggtagtggggtatatatcgaggtggcgcgcgatgacgcgatcggaggctgccgccccgggcgcgcggggcgcttggcgccgtaggcgcgacgcgtggtgggcctctccgcgacacgttgggctcgagggtggcgcaggtggcgcgacgcgaggcggtctcggcgcgggcacgcgactccccaccccaccactcgtcgggtctgacgactgacgcccacaacccaaccgaccggaggccctctgattggcgaggccccaaccgcaacgagtcccctgcacgactcgacgaccccggctaaaaccgacaccataccattcatcagccgccatgctacgccaagcacaaacacgtattaatcccggctaaaatttacagcaatactagtcgacgaacgatacgtttgtagtactatataccacttgtaatttgcgatgactagcagtagaatggtaatttaacgtcgagtacgaggcgtgtctcccacgcttttttgctcgggggtcaagggtcgttgtcgtacatgtacacgtacgttcgtgcgccacgcagtgacacacaccacaccatgacgcacacaaaaaaaaattaaaagctgtgcacatgatgtgtagggagacgtacaagcccggctacgggcgatgcacagggccacctgccgtatcgatcgatcgatcgatcgcacggtgtctacctccaaagtcgtcgcgcgcggatgcgtacgctgacgctttactgccacgattcctctcgttggctcgtagcgcgtgcgtccgcaacgaacgttccaacgagcagccgagccgactagtaaaaaacgtagcgtagtgtgtgttggggtcaatcacggtacatgcgcccctgtcccgcagaagatgtcacgtatttttttcgcgatagagacaggaggcgatcgaccggacgtgtgaggttgtgaccgtgaaatgtgcctagcacctgcatccatttcatcggtccttccttcgcaagagctgtacgctacattggctacaaagagaagataaaaaaaaaagtgttggtacacctaaaagtccattcagtttcgtgctgagttttctgaactgggtctgaataatgcaagagccgcaaaaaagaaaaaaaaactcgaagtgtctgaactgaacgtgcggcggaagccggtcggcgccgtcgtcgaatcgatcgatcggtcgcacggcggaagttgccagggcgaaagggagggctcagctgcaggtagagagcacgtccgtctcagtagtcggctcgcgattctcagcttgtggccgtggatgcgctccatcgattcgatcttgtaacacgatggcatgtctcgatcgacaatactggaacgatctttaggggatttttatcactcgggtatatatgcatatcatcgccaagccggccggtagatcaggagttagtaattggacttaagacattctgaatctgttctgtccctcgttttgccgtgatcgccagcgtcgatggatgggtcgttgatttttgcgtacacttgtcggtagcacaagacttcagccgaggtaaacagttaagatcgtctacagaattacagataacttgtcgccattgcaagttagcttgaaaagtagttgattcgtacaaatacacaccaaaccagcaagacgacagtgcgaataaccaggacaatacacgagtttctggtactgcccttgttacacgaaaaatattatttctggtagtgtacttataatgtttcactatatatagatctaatgttgcaatgaattaaaatattattttttaacaaatcacccatatattttggaaaccctctattaagataatttggtttattttttgttccacaaaaaatgtttcacctagtgtactcacaatatttctctatgtataaatctaatattgcagtaaactaaaatattctattgcaacaaaaaaaaaactcacatattttggaaactccctattaagagaattcgtttcattttttgttccaccaaaaaatgtttcacctagtgtacttataatgtttcactatatatggatcaaatgttgcagtgaactgaaacattctttagctatttgctgaaacattgttttatataaggtgaaacaatacccgatttaagcaagtgaaacattttcgatctacttagtgaaacaattccgatatacctggtggaatatcgtgcaatatttaaaaataattcaataataagctaatttttttcatcggaatatatccatgtgtagtcttattttgaagatttaattgcaacaaatttaatggtgtaatcggatcatgatttggataagtaatttaagagaaaaatcaatttaaaatagttttacacgtaaatcggataatgacgttagcaccgattttaacctcctcccatcatgcgcccgagccggagtcacgtcctactcctacttcagtgtgattgtgtgaacaatagtgatagggaggcaaatctgacgggcaagttattattatctaacagaagttaggttttctgtcataaaatttcttccggctatactactcattctaaatactttagcatatattaagttttttttaaaaaaaaactataatactaatgatagtatattgttaggagggtacaaggacacatacaaaggtttctatttgctatctctcagttaccagcaaaacaaaatcgttgacgtggaaaagagaggagaggagatagatgtagttgttttccatgacatcggccaaacaacaactttggcgagcaaaaacaacgaaaaatcaagtgttctacatcgtggtatttaacaagaggcggccttggatcccatgggtgattggatttttggcaaggaatggattggtgtcgcataaaatcgacatcgatgcaagctaccatttaggagttgcacatatttggggaaagagggaggagtaaatccactatttatttatttatttatttattggggggagagggatttgaatggaaggtgatagatgagtgataagtattttgagagacactttaaatgagaaaatgggcatttggtcacgttccaaaaatggtttcgatggaatgccatcccgaaaacacgtttcgctaaaatgccaatatggagcgcgtgatcacagccactttgttattttctccatttttgtcattttcaattccattttcgttggaatatggcttgatgagaccaaattgccccctgctcaccgagaccagcggtcctttcctctaggtcatccacccaggcctcgtcgccggcggcggcggcgaccacgccgtcctcaatgcgcaggagcaggtcttgctccatgtcgtccaacctcttgacatcgtccatgtcctcgacgagcaggagtaggtgctccggcaccgcgttttcaagagtctggacctccttgacgccgcgttcctctccagcctctacggagacgcgaccgggagcgtgtcggtcctcgtccccaccacggccagcctcatggaggcgctggggagcgcgtccagcaggcgcatgcgtactctgccttatctcggacatcatcggcctacgcgagccgccgctcgtgccggattccttgctgggctagaggcgactgggtggatcaccgtgcgcgcgccggcatacgtcacgtgctgggcagggccgcgctacacggaggcgttggtggcctccccggacgccgccgcgctcgacaccgttgtgttcacctccaccgccgaggtggaagtcctgctcagggggctagacgctgcgtggttcttgacgctctcgcctcgatgaggagctccgccgcgagcaagtcgccgctcatgtcgatcccctttcagccggtgagcggcaatttggtctcatcaagctgcattccagcaaaaaaaatggaattgaaaatgaccaaaaaggagaaaatggcaaagtggttgtggtcaggcgttccatgttggcattttagcgaaacgcgttttcggaatggcattccaacgaaaccgttttttgaacgtggccaaatgtccatttttctcattttaaatactagaaaaataactatttttaagaggaaggtactccatccgtttcacaatgtaagtcattctagcatttcccacattcatattaatgttaatgaatctagacatatatatctatttagattcattaatattaatatgaatatgaaaaatattagaatgacttacattttggaaaggagcaagtagtacataactaatacaagattagtagattacacctcaatttgctagtttgctcacgagaggtcctgtcttcccgactgaactgtgaactcccagcacttcgaaattaacaatagacttgatttcaaatctgaacaaacgatgattagtgaccgggaggcagctgttggccgctgtcccggtgtcccctacattcattcacgcgcggccgtgcggcaccatgaatgcatgagaccatatgggcggagagtcgggttgatcgagctccgccccagggatcctcgcggatgattgatgattcttccaccgccgccgaagggtcacaggactcacaggtgctgtcgactgtcgtgctgatccgacggcttccagtaggattacccatacagaggaccacatgaatatgaattcgtgcaaacgaatccctaattcgaatcgctatcaatcgtacgcaaatagaacccctaggatcgggtaattcggtacaagcgggagcggtcctaacttatgcatttaaatctccgatatttatgcaaatcagtctcttccataccgattcgtcgcccttcttagacagaccctaacgtttcggtcggcagcatctcgccgccacgcatggatcgagctgcttcaacctgactgtggcggtgtgccccgccgatcgaccaataaccgcaaccattacctttctgtgttaaaataatctacaactaaattagatataacttgatactacgaaccataccgatattcgtaataattgattatgtctaagttgttactccatttatttttagacaaaataagagcatctccaacagaaatttgaccaacacagagaaaaaatgagctccaacagattcttcattcggatgaccaaattgctcctccgacagaccaaatgtagccagcctcctccactggccaaaggtaggtcccaccaccactcctagtctgatccttcctctctttctgtctacccaccagcaaggcagcaacttgagcgcatcggccggggccgaaccggaggacacgccggccacgagcgtgccgccggcgtctgggccaccatccgccgcgactatcgtcgtctgggccaccgttcgccgcggcagtcattgtcattgtcgctgcgccacggtcacgtagagccgtcgccaccgcaaaaggcgaaaccacgacacgcacagtgaggaaaacgaatcgcaagtcccaatcaattcctgccatgccggtggcggtggtgatggcgaggaggatgaacccttgttcacggacctccagaagctcccgccggacgtcgcctgcgacgtggaggctgttgttggcgcggccaaggggttccacgcaggcgccacatgggccaggggcctcctagagcggtgcggcgccatctgcatcaccgcccctgccgccgccaagcatcgccgcgagccctcttgcctcgagcagcagcagccgctgtgccatcacctgcgcatccaccggcgggagggtggggaaagggaatgacgtgaagagaaatgaagaatggtagagattgacatgtgggacccactattaaaattggagaaggtaatagagagatcgttggagtgaaatgcaaatttgactctccaactctttggcaaactggccaaataggtatttagaaagttgtatttagagatgttgttggatatgctcttattaattcttatctaccctaggcctcaactcctcctggctgagccgcctcacattcgatgcctgcagcttggcacgaggcaaggcccccgacccaccaaggatgtgttcggaggagggggttaggaacccctcctctctggcacgcaaaacgaagttcgttttatcgcatgattaattaagtatttattattatttttttaaaaaaattaatatgattttttaaaataacttagatatagaaaatttttgcataaattataccgtttaacggtttgaaaagcgtgcgcgtggaaaacgagatagttgcgttgggaaaatggggggaagaacacaacccaaggaggcatggactacagggctagccgtgttgattggaaaattagggcttccataggatggcctattcagtcaaagaaaaagccaatgtttgaattttcaaacacaatttttatattgatttgagatattttcaacatagtttctttttcagcattggcttttaagtcaccgagaacacatatataaaattttacctataaatacatttttattctctaataagccgttttggcttgttacgaaaaaagccaaacgatgagaccctgggccgttggtttgtgccccggagccctgatcacgcgaaagtggtggatggccggatcgaaaagttttgggggatttttatcccgttactctgcacttctgcagatcatcagaagcgcccggagagctgggtcctgtgctctgaattatccaaggggcaaaaaaaaaaaggcaaaacgaatgaaaagaaaatgattcagatactcaaggggacaggatttttgttccacgttagattaaaatcgcaaaatcattggcgagaacgtgttgctggacccatcaagatggaacattgttgattggcgagctggcacgcatgctaggtagatagctagttcatgggtcccatgacaccgttgatgcgccatgggcttgaactggcttttgtgtattttgcaaggcttgcacagcgccaaaccaagcttcctcctatcatagcatcaagttgaacaaagttgttcctcgcaaaaaaaaaagttgaacaaagttgttaaagatctttttgccagcttcaagccttcaaacatggggtttgctacagtgtaaatatcacttttaaatcctaaagactaaagaggatcacatgaagtggaccgatgaattttcaaacacnnnnnnnnnnnnnnnnnnnnaccagccttttaacacttcatttctctaatctaataaaaatctccgcaacacctcctgataacgaacgaactcgctatcgcttttagtttgagtaggggccggaaaacacaaaggaaacggtgaatagtgcactgcaaatcacgcccaaattgcccaagttattggtcgccgaagactcggccaagtgaatgactcgtggaaaaaatctcgttctagaacaacacatgcgcgcgttagctgcaaagcctgcaacttaatcaaccgtgaccagttcaaagttcagagatgagaggtaaaccaaaccaaagcacacacacaacgtggacgcctctggctgcacgaaacgggagagatcaccgcgcgaagccgcccgttcaccatgcacacatgcaggcacgtacgcgagcctccacatggcggccactcgcatccccgaattagccccccactaatcccgctataaattgtccccgtccccgcggctcatctccctcctcaggcaaagcgcagcagcagcagcagcagcagtagccatctcttcttcctctcgcctccgtttccgccgtcgcctgctcggttccagctgagaccgtgcgcgcgcgcgagggagcaacctcgagaggaaggggatggagatgaagaagatcgcctgcgccgtcctcgtcgtcgccgcctcggccgccaccgtggcgttcgccgccgaggccccggctcctgcgcccaccagcgccgctcccgcggccgtcgcgccggccatcggcgcggcgctcggcgccaccgtggtctcgttcttcgcctactacctgcagtgagcccagccggaggaggaagagaggaagaggaggagatggatgcatggccatggctactaaaccgatccaaacacgcgcgataatgtgggtgctttgatttgtgccaactttgatgcctcgtcttctttcttctctttttataatgggttgtatttttgatgcaccggtttgatttcggtgctttgatttctcatatttcgtccaccctatttgaagggaatggatattgtactattattcaccatttgtttggattaaattaagatattggaattactggctacgcattttcgtttgatttcaccatcattcggttacacacgttctgacgttcatcttctaggagacgcgcatcaatcatgactggcatgttaatttggcaatggcattgccgtattggcattcgtattattgcctgtatctgaataaaatcgagttcatttcgtacttcagtaattggattactgaaaggtatatataactgctaaatttcttttcagtttttccataacgcagtagattaattattgccataacactcagaaacaaacaattaagcaggaccaaatggaacagcctggaagggaatgattttcagaaggccagtgacatcaaattgcgctgtaatcatgccaatataaatcattctagttccttcgaacagaatgtaattttagtccgctttgcagttggcaaaagacttacaaattccgttaaaacatacataagggatatgtggtggcttaatatcacccgagacaactaaattccacaagtatgttcctcctctttttttttttttttgtcgaactgacagatcaaaataggccccagttcattagatcaagaaaatcacaaaaatcttactaagcattattgctagctctcctgaaacaatgcctaagtaaataaaactctgaacaaaagttgtaaagggggcacacgatctgcacaagtacagaactgagcggccaaaaataagcattggcaattcagattcaactactccagcagcggaaaggaaataaaacacaggatactctgttgccaaagacaaggagaaacatctcactacaacattgacatcagaccatcagtccactttgccattggcttatttgcacgcaccagaaagaatgaaactaatcggaaaaaaaaaaggttccgacaaagtctctgcgatgctgtatcccttagtggccaaaaaaaaaacttgctttcgagtcatgttacttagtgagagtgtagagcatgtgattcagaatgaccaccacaattgattcataagtcatatcaatgataacaatagacaaagaagcatgctgccatgcgcaggattcagaaacaaatacaccatatatgttctttctcgttaaccatgacaaatgtatcagcttgacaggaatgtcgcaaactcgcaactcatcaaggaaacagaagattaatctagaggatacaattcatcttgaaataatgcagagtacagattacagaagagcagacaactaaagcaaagagccacacttcatcataggcaggtgccaaggtcacccatcccccagcatgtagctggtaccttggccttgcaaggtcaagaacattataaccaataacataaggattttcccacccttgtgcaagaggaaaatgataatggtggcataggcttgatctcagcccaaggaggatacctaaactaaagatgatgtactacatggaatgctaacagtctgacataaccaaagatgaaacgagacctgaaagtttaggaactgggaagctgaaggtgatcaatgtgtatcctcctttcagccaaaatgccaatttatagtaatagaaaggcaccaataatggcaatggttatctacttgttcagaaagagctattttaactaggccaactgttaagagcttaccaattagcagataatattgccggtgaatctttgtcacatccaaaaggaaagtgacactttgtcacatccaaaaggaaagtgacaggctattccactgcaccctacagaattctatttatcagaggaaggctaacctagctgatagaggatgtctgacgcatattctgtatacagcattaccagtttgccacttagaccaaacctacaagttaagcacagtgcagcgtactgtatatatttattaataatgataaactccatgccttcatcagttttgctctacagaaatgatcagtatatatgatgccttcccatcaatagaactactactccagattatttctagtttatcatggaaatcttgtcagaaaattatcaaacttctcaggtatcaggatacctgtaaaaatctcatccaggactgtagtctgcgatatcttactttcccctagcaggatttgcaaggcctatatggccataccatttgttgaatatattgctacaaaagcatatttttatttaagggataagaatcaaacttttagattgtataaattatgcaaagctaaacctcattgtattcataaggcaagtctggacagtgggaaagttccaattatacagctcacggtttattaaaagcaacaaccttttaaaataaaaaccaaccttttaggtcatgtcaacattgctaaagactaccttcaagttagtgctgcagatagggagaacttattaaaaacttattgataattcaagttctacctacaacagtacttacaaggtctcataaagaaagtatctgcatacatttccatcactaatcaagacatcactaatcatcttgcaaagaaacaaaatcagctcagtgagggggtgattggattatatttaatcccaatactgtttgctatttggaaataggagagagattcagtatgcaagctacaaaaatagatatgacaatgtgaccaataagatgtaaaataggagaacctatctaatctttatagaaaaacagttgtccaaatagaaaacaaacaaattaatttactatcatttggacattgaataacaaaccattttaaatttacacaaatagaaacgtgtcaatacatagagcaatgctgagaatttcagtagacgaaatcacatcaattcaaagccatttattgataaattcttgtgacttttgaaaatatattgatctcttgtgaaactcaatgtaaacttcaacagctcacaaatcaacctaaaaagactcaaattactgataaaaatgagctgtgaactgaaaacataaacagacaaagagctttccaaatgcattctcacctcactaggtaccaatagctgtctagtgcaagatgataacttgacaaaacatgatggtttcaaaacacagttcagccataaacgagtcagcaggcaaatggtatctagtaaaatgtttttacaagctcactgctcaccacaggcacagcaaccatgctaagttgctaacaagtaacacagagctggtttgtcaaaaatccacaggaaataagaagatgccagaagcacttcgatacaacataaagtcactgcacttagcaacatttaaaaccttttgcggtttagctctgcaaggtattttgtaacattgctttgacttccattaacatagtggtcataggaagagtaatctctacatttgcaggtaaaagtcgagacagtaacattacgatttccttgatagtgtaagcatacacaaaaaaaaattactctagcaatgatcgacatccaaaagcacccaaatttcatagttcagactctcatgcctaccaccagtgcacttttattatccgaacaatgaaactaaccatccttcctagagagtttcaccgcatcaagatcgtagctactgacccgacagacaccccgagagcgcacgagatggcgaccacccgcgttcggagcagcatgaggttcacattcttcgtggcctggaggcacagcgtgagcacctgcagccgcccgttggcctccatcttctggaagaaggcgatgggcttgatggcgcggcgcagcaccagggcggccgtgaaggggaacgcgaacgccaccaccccctgcacggccgcggccgaccccacgccgacgggcgccgcgcccgatgcgatccacgcgcccgcggcgaggtgcgccccgccgaggagcgcgagggagccgctgatccgctgcacggcggcgcggagcgcgtcgagctccctccgcgtctcgtccgcgagcggcgaggtgtcgcgctccaccgtgggcccctcgatctcctggtgcttcatcgactccggggacaccggagcggggccgccgccgccatcgggttgcgagggagcggagaagtggcggtgcgggtggaggaagaggaggggatgcggcttagggagaagcctggccgtctcggcggcggggctcaggaggcggcgggagaggtgggagatcgccatgggagagcaactctgctgcggagtgtgcggcggcgcaagagaagtcgtctcctcctccggtcaagccgaaggcgtaatcctataatccgctttccacataatgtcacggtctccaatctttccgttttccaggaccggaagcgggttaacataggatcctgcggctggacacgtggcggagcaagggaaaaacgctagggagacgggggacggagcacatgccggccacaccgttcagcggctgccgcctggttcggatttgccttcctttccaaaccagagagcggtttacagaaaaccgcctttctcttcttccgtcttcttccctttccatttctcccttttcctacctcgcctcgccgcccgcaccgagcaaactcaaaccctcgccgcaagaaagaaaaacaaatcgagagaaaaaaccctcgctgctcgccgccccaagcgaagccagccatggtggtgtacacgcaggagcacgtgtaccggcacccgtgggaccgcgtcacggcggcggcgtggcggaagttcaccgacccggcgtcgcgcacggcgctctcccacgtcgccgacgtccacaccctccaccgccgcgtcgacccggaggcggggcggctgcaggctgcgcgctccatcacggtgcgctccccgccgctccccttcatcctccgccgcctcctccccgccgcggcgtcgtccccgtccggcgcggcgctctgccactgcgtcgagacctcgctcgtcgacgcgccgcgccgcgccatggacgtcgtcgtccgcaacgtctccctccgcggcctcatcgaggtcgaggagcggtccacctaccggccgcacccggagcggcccgaggagtggacgcagttcaggcaggagaccacgatccggtgccgaccgctctcggccctcgccgccgtcgcggagaaggtcgagacccgctgcgccgagagattcctgcagaacagcgccaaggggagggaggtcgtcgagcggatctgccggtatctcgaggccgaggccgccggtgctgcatcctccgccatctgagttggcctggtttgcgcctcctcacttggccttccttgatctgatcggatcgaaggattcgctcgatctgtgctgcgtgcgcgcggcgggacctcgcctcttggccaggtcccttgcagttttccatttttttttatgaaatgatgagctgaatcctgaatggaataaagcttctggacatatacttaatttcttcttgaccgtggaaccatgttaaccccaatttgtgcctgttcttgttaagcatattcagatatgctatgacatttctagttgttattgtgctgatttgacgaattcgttaactctgatctctgatgttttcatggatttacgaatgtgttaattcttgaggggacaatttgattcacatataggatactgaagttcgtatgttctatcatttttgtttgctgataagaaaaccaactgggtgctgtgggaatgtgttaactggtagatactggattagctttcttcttggacaattcttgcaagcgtaggttgattggtactttgtgactgttgttgtctaattggctcctctatttgactattcctcctctattatgatgttgattccaggaaaattataatcttgtgcattggtcacattttctgttgtttaatctattgatggataagtagctgcattgactcatttttgctctaccacttgagactgattgagttaagaaatgaggtgagctaataaccgtacctctaacgtgtttggtgataacaataattgtactgttgtttcagccttctttgttgatgtcctgagcaagttactgtatctaggttgataagctgtactgcctgagttagttctatcttattggcttctgagaaagtttcttctttacctggatgtttgagttttataagtgattggctggggaattaacatttagtttattagttattataacattttcagagggaacacattggaaatatatagatcaatacaagttcggattcacagtttgaaacccatgtcatgtgttaggattgctgccatcttgtgctcataggtatctacatcttatcctacggatccagctttcttcagagttttgttccattttgcttgatttgagacatgcttgaaatgtttatttcaacatcttcccgacatagttttgtatggaataatgaggcgatgggccactgctagttcagaattactagctttcatttgttcctcttcagcatttttctttactctggtacaggcataagccctctcacaagacaccattcttcctcttggcttcattgttactgtgttgttgctcatcagttatcaccatatttgactgtattatgtgttgtttgaactgtgatatgagatctaaactgttttccagtattgtttttcttctgtattccagtgttgtttggtagttccatgattgtttgtcattaaatctatgaagaattaattattttgttgtttataaacaaaaagaatccagtgaaaattgctggtgtttgttttgtttgaaagttttaatgtatatagttttcagcacaacctgtttcaatactcctgaagtcctgagaaccgaaacatattctgcagaaatgctgatgaaaaacagtgaagtttatgaatgctgatatttttgtactcccccaatggcatcagctactagcctacgagcagcctctgctgcaaattcttgtagacctcagtgcatcggcctctgttgcaaaataacacctacgagaattggtgctgcagctgcatgtatatctgtgttggactgttggttgggtccagctctctaagcgtcacaattctgaatttcggatggttgtgttgcacaggagttgctgcgtttactgaattgctcttacgccctagaacttcaaggtgaaaagttttggcgtgtcacatcggatatacggatacacatttgaagtattaaacttggccttgaaactctagatgtgaaaagttttgttacacacatttgaagtattagacgtagtctaataacaaaataaattacaaaatccgtctgtaaaccgcgagacgaatttattaagcctaattaatccgttattaccaaatgtttactatagcacgacattatcgaatcatggcgcaattaggcttaaaagatccgtctcgcaatttgcacgcaatttatgtaattagtttttttatctatatttaatactccatacatatgtccaaacattcaatatgacagggtaaaaagtttttgtgtgggaactaacatggcctcagtcgtgttctctgcaaaatgaacagttacttgtgttctctccaatctgaacaccaatccaagcaaagctcgtctcaactcgagccttcacaaaatcagaaacaagctgcaaagttcgaaatataagaataaaatggaaaaagggaaatcaccatctaaacgggcttcttctagttaaatgggccgtttttattctggtacagttaggcccagtacgcgagcggagccctaactccgcgccgctataaaagcgtgaccccgtcgcgtgcgactagggtttatctcctctcgccgcagcctccctcggagccagacaaaggagagaagcgcgaaggcggcggcggcggcggcgcaaggcgaagatgtcggagaagaagcgcggcgccggcacccgcaaggacgaggtggtgacccgcgagtacaccatcaacctccacaagcgtctccacggatggtatcgcctcactctctcgctccctccctccctctcctccatttccctgagctttgttgcgcttgcagtagatccacgagctagatgttggtttcacgaggtgttagggatctagcgctttgctggtgcggagggttgctgcctgcgagcactttgtgggctcgtgaatggctgatacaccttgtttggatggatatccttagaccagctacagcacagcaggaatcatatgaccgaggggggtttgattcatgtggatccttctcttgtatttgatcccacattcctatttatgtagatctgcgttcgagaccgtagcttcgctttgtagctatttattgccatttgattgggtgtttaatcgggtatagtcaggtgtctgcctttatatattgttgtggctgcacacagttacatgcccggctcatggactctgctcatcgttacatttgttgcttctccttgtgctaccaagtgttccatttgggcaggatatttcgtaagagcgcactggttaaatccgtatttttttttctcacgtatcttcataattggatggcattgtactgtgatttgtttgtgttgaagtattgtttgctctaatgatttgatccattatgccccggacatagtcaggtatctgtctaaatatggtggttgatacagttacatgcccggtaaatagatgttgctcatcgttacacgtgctgcctttatatgctatcatgtgttccatttgggcaaaacattggaaacaagattacattatgaaaacactgttatgtatagttattggcagtgtgtattatagcagttcatctgttaatctgttatgtttgccctgtcattggttctgctaatcaattctggtcattcatcttatgtggttcatactttttagcactgcataactaattgttgttgcacatattttctttataaagcagccaacttcacagttcatattacatttgaccttttagataaatgcagattcttgtttagaagttttgcaatcttgaaaagtcttgatttgttgaaataaacgttataatgaaataattctttctgataaacagcaccttcaagaagaaggcgccgaatgccatcaaggagatcaggaagtttgcacagaaggccatgggcacaacggatatacgcatcgacgtgaagcttaacaaggccatctggaccaatggtatccggagtgtcccaaggcgagtccgtgttagaatctctcgcaagagaaacgatgaggaggacgccaaggaggagctctactctctggtcacagttgctgagatccctgcagagggtctcaagggtttgggaaccaaggttgttgaggatgaggagtaaacttttcattgttatctgtcagttagcgcttagtgcatatttccatgattccagtcactatgctgagagcaaatttggaagtcttgctttagcgttttgttatctactgttgatgattcaagactgcattttcttaagcgcttggaattttgacatgtttgtcaaccttttgggatatatactccatgctatcgtgctgtgaacaaggatcactcttaagcttaaaaaaatgtctgttagatgctggtattgattttttgcttgaatttgctcacatccttttctgctaccatcggcttcattggttcacatcatttgttgagaggatagtttgttgtgaaggtcgtaacggttcagctattgtaatgcgtccgccatccagtgatctgatttgctgagttctattcgtgcgtatgctatttttcttgacggtaagggttcagctatgctaatgcgtccgccatccagagatctgatttgctgagtttctatgcgtacgtgtgctatttttcttgacggtgagtgaaccgtcgagacgggccaccaagttccttgtcgcgcctataatgttagggcgcctcacttttaacggagaatatatgaaggaacttcatgaaaaactcatctaagcaaaagtaggaacatgttattgtaatttcattctcaaagcttagcttcttttgaaataaattatatagctccaagggcagttctcaatggtacaagctgttgtgcccggctaaaaaatacaagttgttgtcaaaaaaatcaaagtgcatcctaagacatgatccccgtcggcaggaagaaaattctggacggatatgtggtgtaccagattttgcggcaggaagaaaattctggacggatatgtggtgtaccagattttgctatgctcattagcagcaacttacctgcgacaataggaggaactatgagatctcagagttacacttcagatagtgagatcaaacaccgagtaataaattatgggtagggcataaaatgaataacagatcagagctttccaaatttgaataaataaagggtaacatggaagtatatgttgtgatagcactgttcaaaatgaaacattggagaaagcagatttgacccttattgcaactctgttaagacattttttttcccaaaacagaccagaagaacttggtgtaaattagcaataatgcatggtaatgatagaccgcatactacatttcacagacaatggcacttggaaggcaaaccaacagattccataaaatgaaatttaagtatggtagacattcacagcatgtaacaaaaaaaaatctcacggccctttgtgtatatataacatggaattcaatcaccttctacgtatgtggaatgctaaaataatgacgttaaaatttctgacaaatttaagatgtgattcagactaaagtagagaacagcaattgcctagctagctcccaaggctgttacatgaaaataaaagggatttcctaaaactatatctatcagtcccaaatcatgccagtgatcaaagtatcttgaaactaatggtcataaactaatgcaatcatgctgtcttcaaagaatactactgtaggagtaaaactgataattatcctgcagttttgcaagtattgctattaccctagaaatatcagacaataaaggaatgaacttcatcagatatacaaatcttagggtaatgcatttgaatatttacattgtgagtcaactggatgaattgttagagcaaaaacacatggaagtatttatcagcaaattactgtacgctgtggagagcattgttgtcgttttcttaatatttggaacagtgttaagtgttaattatagcatatcaacgtaggcaaaacaactaggtgtgttactaagcatgggtctgcatcttattagacgcctagacggttagctcatctggtacgaatgtagtagaagggctcagtcatcacagtaaatcattgatcctaccaaa

SEQ ID NO: 67536 - DNA, 10359 bp, Oryza sativa
cccctcccctccctcttttccccttcttcctcaccgccggtgccggcgccgccgcctccccccgctgccacagcaacggtcaccgcctccgccatctccggcctccacttcgcctcctcgtcgtcatccacagagctgattccctcacctctcatagagagagcctgttcgcgttgctactcgtgtctgatcccccacctcccgagccgctccaagaggtgctcgccactagcgacgtccacgtcgcgctcccctcttcgccgtccccaccactcctccctcccctcttcaccgtcgccgttgcgctcgccgaacacccccgcacccgcctcggcgccgggctgtgtggagccagcgggcgagatgtggcccgccgccgtgtccctccgcctgggagccaacgccggcggaagcgcggacgggcgacggcagccaactccggcgggcgcgtagaagggcgacgaaagcgatggccgagcgggggagcagcggcgatgactccggcgggcacgtggacgggagccgacgccggcgggcgcacggacaggcgacgactcaggcaggcgcgcctaagggcaatgaaagcagtggccgagtggggaagcagcggcgacgaacacgcagccgagagaagtcaccctaaactcctaatgtgtgattaaaagcatctaatcattccaaagtgtgattaaaagctaatcaccccaaagtggcatttcattaagaagtatcatctatggagtggcatttttataaggacatcttatgaggtggcatcatgctaaagccacccctatagagtggcataatgttaaatttctcttaaatacattgttcatcctataccacttaacggaagacggctaacggaaccctaacagcaatgacatttttgggataaagtcacttgtacgatggtatttcatgaaacacataattttcgatgatattccttggaatagaacacttgttaatggcgtttcttagattttctctattttttttccaaacctttgtgatgtgtggccgccaaattattagccacgtagttgtcaatgctcatcgacgatttggctaggtttgcaaggatgggtggcaatgctatggagccatctaaacatgccctaataatctaatttgaatttcaactattgaggccaacttgagctgacactcgcagtcgcaactcgcaagtggatgagataggaagatcccacagtgctactactcctgcttcacgtggtgaacagacaacagtgtattgaaagccacattttgtcgcttaatttattaccagaacgcttaaactagcttgaacatgagtattagctgaggttcgtggagtactcctagatgacatagttttgacatatgtatatgtgatagtcccacatgtcatatcgagatggaaacaaaaggattcttttttttctaaagaaaaaaggaaaaattgaagactgatttctagtctacaccaagggatgtacgtaaccatgcattcagatcgagtcactaccacatactcccctccgtaaaaaaaaaatcaaaccctagatttaaatttggacatagggtttgattttttttaacagactagtacttctcaattttggtgaacctttttttttttacctttgaaccaactagctagggatttgattttgatatcttgcaaaaatggctaggtggtgtatactgagtgtgtgtgtagagttctgttattgtattgatatactgtttttgtatttggttaattcctgtaccaggcaagaacgtgcatcagttgattttaattgatcgccttctatgattgaataattaatatcattagaaggctaccttcgacaactcatgcatgtcacccttattttatcctgcactataagaggatatcatagttagctatcttaattaaaccgagaattttctgtttgattgttattcatgatcgcctggcagcagagatgccgagatacgtacttctacttggatgtttatatctatttctaacccagtgatgccggaagaggctgataattggatgcacttatcaagctaagataattatacgtttggtaaaattttacagtaaaagtacgcgaaattattcagactagtaatcatggaattgatcaaacatattgttcttttgcaaatagacaaataaaacaacattaatttgaaacactatttatttgaagcagcgcaaatagataaaaacaagagtaaactttacttgggccacctagcttttattatgaatgttttcacttggattgccctttaaccgatgctttcactttggatcggataatcttacattgtaacacttggatcaccctgactcttttctcaaccatataaggccatcaccaatgcgtgtctttgggttgttccctcgccgacagacgtctgcttttccatccgcgccggctccccacgatggagcgcgtcccccggctgagggacgagtctctcgccacttttcggctgagcgatgcagtcgagggacgcattggggggcgacgggctcctgtagacatcggttccccagctcgtattcctattccaccccttagcagagctagagtcgccgccggccgacgacgacgaagagggagagaggagcttcattgcgaccaccgggaccgggatggcttcctccgcgtcctcccagagcgcggcacagccgggacggcgccgaggcggacccataagagagagagagcggcaagcggcggggccgacgtatccgcggtggtggcgacggcggagtaggcggctctcctcgttgccctcaccaacgaagcttcgtccgtccgcgcggcgctcgccgtccgccgcctcgtccgcctcgcgctcaccgtcagccgcctcgaccaccgcgacccgtgcggcactcgtcaccgtgtcctcgatgtggcgtggccggcgccactccatccaccggggggctagatacggccatggcggcgccggatctaccgcctctggggtcaccgccgccaccttccacgggagaaagaaagggagagcggcgggagaaagcggcaacgggagatgcgggagagatcaaaggtgccccaaagtgaagactaggaaaaaaaagtgacatccatatgaaaagatctatctatttagatcactcgagctagcatcacattgatggtatttgtaactatggtttcttttgtttgtcctttattggaagatattgtttagaaatagctggataaaaccgttagttgctgtaaagttctatattcagcgtctcaaatgtaggtttatctcttactaattagttcaaggcatttatatgttacaagaatgataacaaacaaagcataacactaaaaaggagccatagtaaaagatgcacttttgaatctaataactaatcagctctaatgtggctagccaagtaaagtaatgccttctcttattctgtgcagaaatgccgctacttcaggacttgcagcagagtcagtatctaacaaaactataaaatgattgaaatgctcaagactttatctttggaaagagagagagagaaagaaatgctcgagacatggtatccaccaagtgtatcataagtcatactccctccattaaaaaaaaaccaacctcgcactaaaatatgacacatgctaatatgaggttggtttttttggacggatgtagtagtagagtagaaagcatcgtggccccattcagatgtttgatataaaaaggagaaagaatcaatcaagaagtcagcaatttagcggaaaatgcccaagatcaggggtgccgccaaaagaaccaacgctgatgtggaagtaaatgaaacatatgtatttaactacatgcgtgaatactttctttttttgttgatgtccggaatggtatgcctccacagatccacctaaaacattttgagaaaaaaaaattgcaaagctttgagcttggttttccgaaaggatgtccactggaaaattgttacaacaattttacatcggtaataataaaagagagctacgcacaagattaatttaaaagtgaatggatgcacagaaacaaaagtttaggctgtgtttgggaggtgtagttgggaactccacctcctcgcacggaaaatctaaagcagtccattagtgcataattaattaagtattagttttttaaatggatcaatatgatttttttaaagcaaatttcgtatagaaacctttttaaaaaaaatacaccgttaaaagtttaaaaagtgtgtgtgcgaaaaatgaagggattgagttgggaactcaaagaaacaaattaagcctcgggcaggttcaaactctaacgagaggtaattcgctactcttatcttgatcttggtggattgtatctgacagatgtcattgatacgttgatctagactatagttgtcgtgaatttagtgccactaaggagactccctgcgcatcttatataggtagaggcattgaggggcagggttataaggaggaaaaggtaagatacgactttaatttcctaatttatgcaatgtattattcagttagggctctacaccctgccttgtgtaaggcaacataacattcgagtcatactctattgtatatatcatggtttcggaccaccaccagtaccgtgtggatacttcttacctatttcctccatgcaacctctcctcaaaattgagaaaagaaaggccgtgtttagttgttttggcaaaatattttttgatgtatacgggcacatatttgaagtattaaacgtagactaataacaaaacaaattacagattccgtctgtaaactgtgagacgaatctattaagcctaattaatctgtcattagcaaaagtttactgtagcaccacattgtaaaatcatggcgtaattaggctcaaaaaattcatctcgcaatttacatgcaaactgtacaattgattttttttcgtctatatttagtgctccatgcatatgtccaaataattgatgtgacgaaaaagttgaaagtttgaacgaaacacagccaaagcatacccactggactaatgccatcctccatatggtggagtgcaaacgccaaacgatgctgagttttcgatttgcatttctgaataaaccgatcgtgcctgtcaagttctaaatgaaatgattatgcgtgcggttcatccatattttcaaatttatgttccaaatgatcatgtgatcggcgatccatgtatccctaggttgattctaaaatttaaaattgcctccgacttggctcacacaagcggacctaaagaaggccctgtttgagggagcttatcccagctgcagcttttagaaaaagctacttctgctagaagctactccaaacagtccacagcttctaagaatctatacactggtggagaaaccgtttgtagtcccggttggtaaccccctttagtcccggttgtccaaccgggactacgaatccgggactaaagatagctatctttagtcccgggtgaaataaccgggactaaagatcgatctttagttccggttcgtgttaccaaccgggactaaaaagatcgatcagccacgtggtcggccaaaccatctttagtcccggtttgtgttaccaaccaggactaaagatcggtgcaccattttttttatttgcatggccctgtttgctgcatggttgattttatatatatatatatatatatatatatatatatatatatatatatatatatatatatatatatatatatatatatattacacacacatatgtacaatttaaagcacttaacattttatgtgcatatatatatgttaccaaaatatatattaacacagaagtaaatgtgtacatatataaatatatatatatatacatgcatatatagtacaattcatttgttcggtagctatagctacgacttcgacgccggcgttgtgtcagaagaggaagaaccgacgttatgaattgtcgatccgtcgtagtagaattcaccgtcgggattaaggacttcttcgttgatgaatcccatcagttgttcttgaacagccgtgataaaatccttgtgtgggagattatccctcatgtgaatacgctatcgtttgaaaaataatgacgtatcaatatatgaaattaataaacaacttaacaaatcaatacacaatgaaattttgaatggtttatgtatacgtacatcgagcactcgtgttgtgcatatttggtttgataggcagtgggcatactcgcatacgtagtagccgcataagttagttccctggtcctgctttgcacactacatgagaaacgatgagagatttaatatactctttatattaaattagagattcaattcaatataattttggatcatgcatgtactcactggaaaatgaaacctccatccaagtttttctttccaagtcccacggaccaattgacggaaccgatcccaagccccacatatgcagttgcaagctatgattaattaattattacctgagatcaacataatagcaatagattccccgcgactttggaatagatggcattatattacctgtctatcagtttgaagaccttgtcaaaaatcttctcctctttattcattgagtcgtatacagtgactctgcatgcgtccaagtcaaagaataacaggacccagtggaatatgaaatatgcgtgagatgagatatatatgatcgaaaatgtacatgctatatgtatgggaataaaatttgttcgaacgacaataaaaactcactctgtgttgtacggcagtagtatgtacgtcttgaaatgctgctgcgttaggagatggacgagattgtcctctgtgtctttctcgtacttgtcgatcatttcggtgttgattttccgagggtcgatgaacccagtatcgtagaccctccgccgtcgggcccattgaatctccattctacaacgatgaaaggaaagtattattgcttatatatatgccaggagctaattattgaacgaaacaaatcgaactcaaagatactcacaaaatccatgcgctcagaagagagacgtcgagggtgtccaactggtacagatcgaagagatccttgaaatggatccagagaacatcttctccttgcaagaagtcggggtttctgatcctcgctccgaacatctctctacccttggcgctcatttccatgtaccgttcatggaatttgtacatctgtgtcgatagggactgcagctgttcaggtttgataagcggtttaccgagttcaaacttgtatgccacttccgccttcgggattggtgcgcctccaaccaactgatccacagttagaccggtgtctgaaatgaattccgttatgccaaaatcttcgctggtcaccaacggctcaacctcttggtttggttgttctccaagctgagggactggtttggacttcttgtgataggctctctgaagtgttcgatcatagtccgatatctgtaacgcttccttgtttgttgtggacattcccttgaagaagttcttcacgctcgggttaataggtatcttcttttcaggactccaaggcttgagttgcctcttcacctctcctgccacataagcatcaagctcctcttgactgcaatcgtacggtggctccttgtttttggtggcgtcaactttcgccatcttcgttgcccttgtgcgggcaggcggtggagcttggcgagaccttgtcttgggaggtgcaggcggacacggtggaggcggaggagccggaggagatggtgcagcaggaggtggcggaggagccggaggagatggtgcaggaggacgtggcggaggaaccggaggagatggtgcaggaggagatggcggagccggaggagatggtgcacgagacgccgcttatcgcccaggaaggatgatgtaccgcttgcgccatagtatgatggcgtggcttgtgtctcgtagatgcgtctcaccgtctcctcctgggtagtccaactcgaggtcctcgtacgcggcttccaccaactcaactacgaccctcgagtatcctgctggaatcggcttgcagtggtaagtcctggaagggtctgttgggatgaccattcccgacgccaccttcacgtgatgagaggttatctattaataatcaacctaagcagcaacttgcggaatgtacaagtcaaaaatcatcaaactacgagtataccttgattgataagttcttgaagggaatatgcagctcacatggtgtccgttgcgtgatctcatcaacggggcaggtggtttcgtcctgggtttgcatggcgtccatgctctgtgatccgacctgccccgttgaggcgcagctgctatgattgcctgatgggctgaccattgcaggatgaatgtacggatggggatcctgggactgatgtgcggccatacgttcatccaccttccttgccacctcctcttgcatgctgagctcgtagcttgataccctgtactcaagatctgcaatcttcgcatcggtatctctcttgctcctcatccgactcctgtacgtgtggatgtcctccttaaatccaatcttccagggaatcatgcctttccctcgtgttcgtcctggatgctcgggagtctgtagggcgagtgacagctcatccttctctctgtcgggtcggaatgtgccctgagaagaggctaccactgcgtccgttagtcgactggcagcctcgcgtatctgatcgctaaagacaagggagccatcaactgggttaagcgttccaccgtgagcatagtaccaaaacttcgatcgatccggccatttagcggtggccggttcgatacccctctcaatcaaacttgcctccatctcctcccacttcggcattgcgacgctatatccgcctgaccccaagtggtgatggtacttcttcttggcggcattgtctttgtttctagccatcatcgcttgccattgttgccctgtcttgtaagcaacgaactcgtcccaatgatcccttagctttgggaatacgtcgaagttcggtgttagtcccttcaggatgtatttcttgtagagatctcccttgaagctctggaactgttctgccattttcttcagagtccagtgtttcactatgttctccgtacccgcgggtagcgtgaacatctcgagcattgtggtccacagcatctctttctctgagtctgggacaaagctatcattatccccgcgtgcccatgttctgcgccagtacaccgtgctgacaggcacgttgtccctcacaacccaaccgttgtggcgtacaaaattcttggctgcttctgccggggcactaggtcggccgtcttcgtccacctcagttatgatgtgccgaccctctatcttcttcgcggcacctcgttgtccgcgtgccctcttctgtccagcggagggatgacttccactagcctcctcctcatcgttcccctcctcgttcccctccgcatccctctctacgttcccctcctcgttcaaatactggtttagatcgtcgttcccctcttcttcgttccagtactggctgcttccctctatgattgtatcgtatagtatctgttcctcatcgcaatcagccatctgtgcatacaaaaaatatttgttaggtatataggatgtatttgctaaccgtaatattaaaactctgctaatcttatattaaatctctaataatcttatattaaatggctactaatctcatattaaaattgtaataatcatatatatatatatatatatatatatatatatatatatatatatatatatatatatatatatatgctaagtctaacaatcttatattaaatctctaataatcttatattaaaattgtaataatcatatatgctaagtctaacaatcttatattaaatcgctactaatctcatattaaaattgtaataatcatatatgtatgctaagtataacaatcttatattaaatcgctactaatcttatattaaatctctactaatctcatattaaatcgctactaatcttatattaaaattgtaataatcatatatatatatatatatatatatatatgctaagtctaacaatcttatattaaatcgctaacaatcatatatgctaagtctaacaaacttatattaaatcgataacaatcttatattaaaattgtaataatcatatatgctaagtctaacaatcttatattaaatatctaacaatcacttctttacatcacttgcctgcgcgaattacttcgatggctagctaccaattcggcttgagggacgacgacgacgtcttctctgcaacattaccaggaaaatgtattactctaaacgggccaagttacatatataatcatatatgtattaccaataaaatgtatt

SEQ ID NO: 67537 - DNA, 6173 bp, Oryza sativa
ttccctgttcaaccgcgacggttcaccttcctctccgctctggtgctgcgcgccttcatcgacgctcacaaccgcaagtagttttgccgagcaaccggtctttccgccacctcggtacgtgttcgacatgttgcgcatatttgatctgttcatgttttactgcttagtttacatgtgtagatctaatgatacgttaatgctattatatatctgtatgtcatgatttatttatggaatatattaaatcattatatgcctatattctcaacattcaaaagacacgagatagaagcttatgaaaagttcaaaagaagtgcagtggggactgcattgtacattcatccctgcctgtcagaaatttcagagggtgatgctgcagatagggcgagcaacttgacagatgccactgttgacagcttgattgagtctatcatcattaaagatggggtgaaagccaagtttttctttaacattatgtctcttgctaactctgcaggagagaagttgcttgccttcagtcaatatatacttcccatgaaatttttggaaaggttgttggttaagaggctgggctggcatgtagggaaggagattttcatgatatctggtgatactagtgcagacgacagagaagtggcgatggatcagtttaacaactctgccgatgcaaaagttttgtttggttccatcaaggcctgtggagagggaatctcccttgttggtgcatctcgagtcatcattctagatgttcatttgaacccatctgtcacccgtcaagcaatcggacgtgcattcaggcccggacagcagaagaaagtgtttgtgtacaggcttgttgctgctgattctccagaggtgaagttccatgaaactgcattcaagaaagaagttatcccaaagctatggtttgaatggagtgagctctgcactactgaagacttcaaactgaatcaagttgatattgatgactctgaagatgaactattggaggctaatgctattcgccaggatatcaaggctttgtatagaaggtcagctatctctttctccccgtgcgcatgtgcaagttaaaccctggagatgctctctctgtcttatccaaaattgtcttgtaggtaacaagttatatgtggctgctgtacaccatgtacataatgcaatgctgatctttctgggtgatcatcgctgtgaagtaaggggatttctcgtgaatcattcttcacgttacaaaatctttgccccttattctgttctgattgtatgaccatcagctttttcgttaaccttcatcatttttcttccttcaggatgttacagtagccccttctaatgccggagttccgttcatgctaggatttatcgttaacctcggtcgtttccctacctatttgaaccactgtccgctttgttaacatgtgccagcttggcgcagcggttcgcgagctgatcctagtcttatttccttctgaagatctccaggactaataactatggtttctgccgttcctgctaacaacttaaataatgccactgtttccttacctgtcttttgtgcacttcaattggtcttcaaatttgccctttttgatagggtaaagatagtttctttctgcgcgtaacggaatgtaggttatccgtcgtgcatttgtgcatctcttttatctcctttgttgcagtacctggtttttgtgtcgaccattctagtttcaattctggctcccatgaaagatgctttaagactcgcaatgccaggatgcatactttttttttatgcatactcgatcgttggctcgttgcactcatcgactccagatcagttgccagcggcaactaatctctcaaaggcctggcggttgtgttcacctggtgctggtgcatccgagggtgacgacaaggacaggggaagaggagctgtttgtacttttgcagggcccgctttttttcagcttagaagcataatatcacctgattgttacgaattatttgcttcatgtttaagaataataatttctcatgaaactttcttttactttattgcccagaccacttgttttaaactacaactatttattatgtttagataatatgcaatatttaatgtattcatattattaatttatctgcaataaaacaaacactagcctagagcgagtaggaagagcgggctgctggagtgcttgcgggaaaggaattgggccgctgtggggttgacgttgacatatgcccactggtaggaataagttcacttcagatccctcgatttgtcacccagtccgatattcatccttgattcgaaaaactagatataactcatcccccaacttacaaaaccatgcaaacaaggtccctcggtagtattctctgattttggctgacgtagcacacacgtggcacctttgactaggtcttcgtctcacgtggcattgacgtggtgcttacgtggtagtttgataaaaaaaagaacaaaaattagaaactaaaaaataaagcaaaatatgcaggacccatatgtcagttaaaaaaagggggactcacatgttagtgggtcccacttcctccatctcaccctcttctcctctcttccaatcctctcattttctccgaggaaccgggcgggagcgggggacgacagggttggcaagggcctgtcggcggcagcggcggcgtcgaagcgggtgaccactggctagggtagtggcgccgccgcatttcctccacgcggcgaggatggaggcagtgggagacggggtcagaaatcgctcaaaatccccccgatttcaccttcgcgtttcccagagatggacgttggcgttggcagcgaagaaggtagtggggcggaagctgggtgggccgaagaagccggtgccacgctccgtcaaggccgggctccagttcctcgtaagccgctacctcgagaacggccggcacgcgcaacgcgtcggcactggcacccccgtctacctcgctgccgtcctcgggtaccttgccgcagaggcagggggttttaactatttgccacttttagatttggcaaataactatttgccacccctatctcaatgacatgtgggtccacatgtgtctatgacatgtggatccaatggcaaaaagttaattgccacatctaaatgtggcaaagccattgtgtttatctcttcctctcccgatccttccaacccactcggtgtgcaagcgtggtttaaccgggatgggatggccgacgggtggcgaggagagggcgttggccggcggggagaagggacggcgcgcggcggccgacgggagaggagcaatgcgggctggtcctgcagcgtagctgtggcggccgcggcgaggaggagggaggggagtagcagcagcgcggggacacccatggctgtcgcggcgacggcggcgaggtggtaggttggatgggattgggtttgtgctctgctctgtctcgtaagagtagaaatggaggtgggcgagccgcccttgcccccatcttgcctcctcgctgccatggtagcgacggcggccaccaccaccgttcacctcgccaagttgctcccgtcccatcccgcctccactccgccatggcaacaggggcggccaccaccaccgctcagctcaccaccctgcccccatctagcctcctcgtggctatctctccccctctctcgccggcaaggcggcgccctctttcccctctcccgccggcgagatcgaccgtctcctccctctcccgccggcacggctgaccccctccgaggatgcgcgcgtgtgttggcgagacacattcatcccaccgccgagatgccgaggtcgatgtcgacgtcgtccacggccaaggtcgcggtggccccgtcgccgccgggatggttcccttctcctcgtagctcctctcccgacggcccgccgtgcgtttccctttctccccgccggcccccgccctctccccgctgtccattgaccgtccaatcaggagagaggagagcggagagagatgaagagaggggagatggggagataggaggggagtgagaatgacatgtggggcccacgtggaacccaccgtttttaattattatttttggtgtaactgatatgtggacccgcgatttttattattttccaaatcaaattgccacgtaagcgtcacgtcaatgtcacgtgagacgaagatcttgtcaaattagccatgtaggtgccatgtcagccaaaacaagaaacaatactaccgaatgaccttatttgcactcgttttgaaagttggggatcctttatatctggtttttgggttaaaggatgaaaattggatttggtgccaaattaagggacctcaaatgaacttattccccaatggtactcttgatcaccacactcaaaagtggaacatagtctgtttcaaaaggagtctgtttcaaaaggagtaaattatgtttgaggtagttgaacttaagagataggtgtattttagctggaattttttaccttttgatccttttagaaaacctattttataaataggcccctaaaaaggtattacagaaatgatccttttcatgggcgctaaacgccattggtaccgtgatccaaatatatttgtaaaaaaaattacaaatatatctttgacgctagtgctattgctgtcaagaactatttgtagatatattttattcaaaataggtcattttctattacaaataggtcttgagcagcatcaatgacttagcttccaccgaggggtaaggggatggcggccgtcatgttggaccacaacgctaataatgtgacgctgcgaaaaggatctatttttggaatgattctttttaggtctatttgtaaaataagtttttcaaaagaattaaaaggtgaaaattccaatgtattttagtgcacgaatatgtaaaacgactattctaatatataaatttatgtggtacatagggaataagatcagaacggtgcaccattttataaagttctgtactatattttgtacccacattgtaaatttatgttccgccaccacaattttctcaaattaatactcttaatcaagactcctataaaataaagtactactccctccgtttcatattgtaagactttctaggattgccatattcatatagatgttaatgaatagatatatatgtgtctagatttattaaaatctatatgaatatagacaatgcttgaaagtcttacattgtgaaatggaggaagtacctgtgtttcttttaattattgttttcaacgtcaacacgatctctaacatacatgcctcctgattaattatatgtttataaaacattaaaaataaaacttttttcatgcaaatctattaatatcgttatcacatattaaattgtgatgttttaatttattaatgatttaagatattgatgtgacaacatcaaaagaatgaaggggtgcttggtttactatcatacgtttcgcacgggtattatatagagtgtcgcatggggttttcgggcactaataaaaaaactaattatagaatccgtcactaaactgcaagacgaatttattaagcttaattaatccgtctttagcatatgtttactgtagcaccacattatcaaatcatggagcaattaggattaaaagattcatctcgtaaagtagtggcaatctgtgcaattagttatttttttagcctatatttaatacttcatgtagatgttcaaacgttcgatgtgacaggatgaaaaattttagagtgagatctaaaccgggcccaaatcatgccacgcttatgtcatatcatagtttttctagctctgggtccacatgccatgtacataatttttttgaaacaatcgaagaaatacatatcattgacaaatacccaaattcaagaaataccatcgatgagtgtgagtatcgtaactaccatcatacaagtgatttttatcaaagaaataccattgtcgttagggttccattcatccgacaccattaaatacatgagaaatttaacaatatgccactccatagaattggctttaacaggatgccaccccatggaatgtccttataaaaataccagtccatagaggatgcttcttaatgaaattccactttggggtgattagagaatctgtgtgacatgtgctgcccgcaaaaaatatccacgtctactcgcccgcgtcctctccccccct

SEQ ID NO: 67538 - DNA, 17795 bp, Oryza sativa
aaactatcttatacttgaagtccctcagtgtgtaaacctcatggtttccttgttgcattgggactaactcttgtcgacctttacctcatatattccaacttcatctccatacgagattacattcatatgtccagccttatttcctcgcttcactaatagcttatcaaccctttgagaccattgcttgccattgttaagtaaattaacaacatttcgccttctctcaacaaaccattctaagcactttgaaaatgtttcctccacaatggctgccaccggtaacctccgagaaaacttaaacacattgttcaatgactcagatccattgcttgtcatcattccccaacaatatcctccatccttgcattgaaataccttctcgggcttttcttgctcatctttatcttcctgcaagtgctttccaacctttttaacatatgttattgcctcaggacaaatatttgcaattgatgacattccttcatcaaattttctaggtttctttttcttcactgtccacttaaatgtcttgagcactatttcattgcgacaaaatttccatagattctcagctacatgctgtgagcaaaggcggtgcacacattcaccggcgctctcattccatccaatgtggggctgcttaaacaaccattttatggctttatgtcgatcagatataacacacagaaacttaactttccatagcctattacctcacttcgtagccatctcataaaccacccccagtttgcactatcttccttttccacaatagcaaatgcaagaggtagtagttgattgttagcatcatatccacaagcaatcaacaatctacccttgtacctccctaacaaaaagcatgcatcaacacttataactggccgtaggtagggaatggcatcgatacaaggtccaaatgcccaagcaacacttttaaatgctcgccgtccttcctgagtcgttggctttgacaaaaggacatactttgtacctgggtttttagcttttatagcttgtaagaaagggatgaggaggccatatgaaccttcccaactaccaaaaagttgtgctattgccttatctctgcctcgccataatttactataagatggcttcacatttctatatctctgttggactagtgacctcacattttttatactcaattccagatcatcccttaatgcatcacgtatcacattagcaatcatagaagatgataactgagcatgatcaaatctatcagccggtgctcgacaggtgtgagcatagggacatttccttatcatccaacctgaacctatctttgtgggagttgcatagagcctccacatgcagctattattcgtgcattcagctacaagtttagactgactacttgtgctatacttgatttctgaatttttacatatatgaaactcacctatagcaatttgtaggtgctcttttgaatcaaaagactttccttctgttagtgggttagaaaattgattcttacgtccaaagaaactctcgtatgctgttgtctccttcaacacagatatatcattaaatgcttttataggattttgtccagatgcacgcataaaaggaaatgcattgacagaatgaacaactcgtggttatgggggctcatcatctgaactattattaagggcaccatcacaatcctgcttgttgtcatcgtctagtccaaatctatcctcaccaacatatgtctcctcaccaacatatgtgtcttctgcagtattgtcatcatctatagttggttgtgtttcggaaaccacattatcctggttgataggtgaagacaactgaactgttgaatgcataccatctgctaaagtgggtacaacctttgcttgtgaatgaactgtacctggctccaaagaaacacctgagccattcctttccgaatgcctagttgatgcaaccaaggttgtactattaacctgacttaatcttgcttccgtataggcgcattcaacataaagctcaacaacctgcccacatgtcttctcaaatatcatcctccatcccctgtcttcataaataggaatcaattgaaaatattgtggcccaggatttccgatatcaaaccgagcttggatattcattgcacaatgatcctcaatgtatccaagggcctgaaaaatttcttttttgacttcctcaaaggtcgtagcctccactgccggaaaagttatttttggaggaatattatattctgcacccttagctccatattgtattctcccatcaacatatactagaacaataatcattttttctcagtcaactctgcaaaacaaactaaacaagttagcaaaacaagttatataattaactttaagttagataataatctgctgatatatcctttcaagttttaaaaaatgttgttttgcttattaaaaatgtcaatgaacaatagtcattttatttcctggttgtgtcttccaaacgaactcaacaattaacaaaggcatggtatatgtctactagttggataataatctatacatatattcaataaaacactaatgtcatatatcaagtataggtatgaacaatgtagtacatatcaattaatgctaattagatgagggtgagcagagacatgctataagtgaaaagacatgcatgcatgatataaattgcagggcaaacctattgctcacgacgagagagctgccaatgcacacggcgccgtggctggattgcaggattggtggcgccgtaaaacacggacaaatcgaaggccccggcgtcgacgacgagagtggcttggacgacgaagcggatggatcaaagtcgtagagagggtgaactcgtatatgagttacgacgatgcgtggccggttgccggcatgcgcgatcgagcgctcatcgctagagttagggttttcttttgattgtcagggttttcttttgattgttctcactctattcgtggcttggctgcaccagggaggtggacgctggttccaacagcgtccaagtatggacgttgtttacaacggcgtccaattatggacgctttctatattagcgtccatcctactcctataaatccccccaacgatttactaattgtttaatttaagggtaattatttattataaataaaaaattcgggacctatattgtgtttgttttaacggttaatggacctattatatagttatttcggttcaatgacgaaaatcaaactcactttcaagttaagagatctaaaatggacttattcctttccctgcaatcaacaattaatgggatggccgaccggtgtggttgtattgggactgggggcaccagtgcaccacctgcaccgcctcgtgctcacgaaacccgatcgatcggtgatctgcaccgtccatcgctccacacccaattccctccggccacaccgtatcgcatcgcatcgcatctcggaaaacggcatatccgcgtcccccccggcggggaagtcatagaaatcgacttggccgctacgaaacccagagaaacacaccccggcggcacggccccctccgcctctcgtctcccgatcccgcacgcggccagctacaaatacgcgatttgccctcttgcacgcgtcgccccgcgcaccgcaccgcaccccacccccgcacgcaggaacggaaggtgggtccccccctccctccctccgctcgccgccgcacgaatctcgaggcaggccggaaccctagcatggccggcggcaagcgccgccacgcgcgcagcaacccgaccgccggcgggccgcggcacggcgccggggccgggcgccgccgccccgtccccgagctcccctccttcgtctccccggcctccgtcgccgccgcgttctcctcgtcctcctcgggcggccgcggccgcggggggaggggcgggcgccgcggcggcggcggaggcgggtcgtcgaactccgcgtccgactcgtcctcccacgccgtccccttcagctacgccgcgctccgcccctccgcctccttcgagggggcgactcaggtgctggatgtcaccatcgacaccgccccctgcgccgacccggcctccgcctccgtcccggtgtactcgtacggcccggttggcgggatcgggctggggtttcacggcgaggaggaggatgaggaggaggaggctggtgaggctgggctgcatctcggattgggattccggggttgcagcaacgaagaggtggagttggaggaggccaccttagtgacgccgaggaagccgaaggagaagcctaagggcaagcgcaacgagggatttttgtccattgggggaattcggatctacacggaggacatctcatcgccagagtcgggggtgggtgactctgatgaggaatcggaatcagattatgaggggagagatggcaatgatgatggtgatagtgacgaggaaggcagtgatgtcaacgaaggtggttcggagtctgatgaagagttgtctggatcagattcagaggaagacttgagcattggtgattcatcagttgatgatgaggttgttgccgattacatggaggggatcggcgggagtgaggagctgttaagcagcaagtgggtggctggaatgaatttggtcgattcagatgatgacgatgagatggatacagatgaggatgaggatgggttcttgaagaaggtgaagggacagcttgagggttatgccttgatgaatgcatccgagcagtatgggatgaagaggccgagctcagcagatcggttgaagggaaagggcactgctgtcagggcttgtgaccgggacctggcaagtatgcgagtgatgggtctggatgctgtgatgatggtaaaggatgtacgcatggcaaacagattaagaaagggagcaaaggtggcttcatcatcttctcacctctccaggtcctggcctaatgagggtaggaagagcaagaagtatcagagtgtaccaggtaaaatgccttcactgttttctgttgttttttcttttatgttatccattgtcaaatatgggaaaattagaacaatcagcgggcaagcacatctcactatgtatcttgaattgaaaagtcgtagtgctaagactgccaagcttccattaatcatggaatgttcttactagttgtttgtgtatgttaataacatttaggtttgatttgttttaaagcttttaaattttttgtttcataaagatggcataaagtaagtctggttgtatgctattgtttccactttacagagaatttgagataatagctgataagtattgcccaatttccactctctttttaatagaagtcatgggctcatggcagatggtgtgtattgattttagaaaaatagcactaggttgatcagtgattatctattgtgtacctttttaatacattggcgcaactagcttgttgtgttacattatgattgtccgtctccatatggagaagtaactcaatgtagacctttcaaattgaaaagtctgcagggaatatgattatccttggaaagttcagcttcttaaaaagttgctcggccactgtttacattaatgctcttctttgttcacgtatgttacaattatattatgtttgtgtgcctgctcaaatgttcatgttctcattatatttaacctatattgcgatgggtttgtaaaattttttgtatgtgattcaggtgagaaaaagaagcatcggaaggaactcattgcaaagaagcgccgccaacgaatgctaggcagaggagttgatttagatcaaattaatactgtgagtcttatagttgctttcacatgaagtgaccttattctgaaagttatgcccgtatgattctaaatcatcatagcaggagtctagttattttctaattctccagctcaatcccctgaaaaaaaaggcaagcacacagtcattaatgtctatgatatggtataaagatattagggattgtacaaagttcagtgataaatgcaagaaaatagtagtaatacaacattatgtgaagagaccttttacattttgaaactcagggtctatgcaatgtgattctgtccattgagttttaaaccggaggatgttagtgtggtgctatctggattcagttttgtactctgtttgttaaagtggaggtacaagataagatgtgcacaatatggagaaatgcacatccctagagagagtttcatatccactgtagctcttcttatgctgtctgttttcctttatgttggttttcttaatcaagctggttatgggtaaactttgagctttcatactcgcataggatttcttatgctttctgttgttggatggtacttggttattttcccttccccattccttgttagtataaaatgatgtgtggcctggttctgtttcttatgtgcagaaattgaggaagatggtcgtagatcaggttgatatggtatgcttccaaccaatgcacactcgagactgttcgcaggtattagatgcatgtctgtctatcattgattgtttgtattgcttgttaaagcatttgtattcaagcgcatgctaattgtgccattattgttgttaaatttgtaggttcaacgccttgcatctatttatcacttgaagagtgggtgtcaaggttcaggaaagaaaaggtaagtgccatatgagtaaatttaccgatcctagtagcactcccatgtcatgttgaatcttgccacggacacattggtttgatacaacatgtcataatgatgagtcatttttcccatctcttcgatgatgataggcatgttagttagtttccttaactccttgaggtatgcttatgttgcagcgcggtgagtgataccaaacatcatcattatgcatgcgagttcatgtcatttcaatgtgcctggaatttttgcattgctagggctcaaactaaaatctttacataattgtcgttgtattaagtaatgccttactggtgtaggatcttgttctttccctataccccgactgctctgactgttacagatccatccttagttcctaaccgacttacccactcaaattgctcttgttttatattcgctattttattttactctttaaggtaggaaggtgcatgacctcctgcaacaaaccatctgtcctttatggacagtggtaaagggtgcagtggcttattaaccactcccctgttatgcatgggcactgatacgagagacgtaagacaatgacgtgtttccttgtcgtgttcatcgcgtaagcgatgtgtctgcgcatatagcaactgccataacctggttatctataccaagatggttatgtgttagttgtatgcaggacattgcacctcccaaccatcttgtagcattgcatttttatgctttctatacttacctgctgtttacctattttatatcaattatgacatgtaatggagataatggtagttgcaatctttttcttgtttaaaatcagtttatgttggctagtcaagcccatgtccatatgagaaaattgacatcatatgtggttttgcactatattaaaaatttagttggtgaggttgcaaattaaatggataccccaaatttcaattaacttgcattctaattattttgtgtaagtaaaaaaaaatcatatggaaattctttgatctgctgaatgcagctgcgttgagtcaaatgctaatacaacattcttgccgtaaagtcaataattctgtcttgcagatttgtcactgtgacattaaccgcggattcttctttaccatcttctgagggccaaatccgacttgaaaaggtgtgtatacactgctcatattgttagtcgccactctgttcaattttgaagtgctttgattcgttcagcccttcatgaattcacatcacatttttcctttttttatgcccctcggtttaatattatagtcactttgggtttgtcctaagccaaatatcgtcaagtttgaccaagttagacaaatatagcagtattttcaacacaaaataaatatactataaaaatatatccaatgatggatttaatgaaactaatttgatgtcgtaaatgttggtatgtttttctacaaacttggttaaactttaaaaggtttgacttaggacaaatctaaagtgacttataatatgaaacagagggagtaataaactatgtcgaatctcagtactgtagtatttctacatataacataaaacattgtacatcatttttttgtcttgatattcaccaaaaaacattttatttggcataattggtcttgatattttgttttattgcaatcatgttatctccttgccagtgttaattgttccaatcttctgtctaaattgcttttcttctatatttcagctcttgggaactgagcctgaggactttactgtcaattgggagaactctaaacgtccagcccaagtgaagggcctctcagctccaggaaagttggcaaggaatcagacttccagtggaaagaaatcttccaagaaacaagtatcatttgctgaacgtcctgtatcttttgtctcctgtggcactatggcggaatctgttactgagacaattgcagttgccacaaccagtggtgaagtctcatgtgagaaaattgttgaaagcgactctgtcaagctgggaacctttgagatgcacaccaagggctttggttctaagatgatggctaagatgggattcattgagggaactggcctgggcaaagatggccaaggcatgatgcagcccatccagccaattcaacgtcccaaatctcttggactgggagtagaatttgacagcgaggctgaggcaatcaaggcaaggtcagaaccaccaaccaaagcaaggtcagaaccatggcggaatttgaggaaagtggagattggtggcgttggttcctttgagaggcatacaaagggctttggatccaagatgatggcgaggatggggttcgttgagggctctggcctggggaaggatggccagggcatcgtcaaccccttgactgcggtgaggcgacccaagtcaatggggctgggagctaagaataagtattaataccatatgtgccttctatctatctatgttatctatgttatgtaccttttacagccgcttgagtttgataacctagttgtatatatgctaggagagcataaccccgttggccgcggcaaacagcacgcgaaatcgtgggttccgatgcccctggctgtaggcagtaggttctatcttgtttacattgcggcatttcacatttttcattccctgttgttttgttcaattctctggaggaaagttatttatttccatggtacgtctcatctagtgtttttgtgtcaacttgtctttctgaagtaatgtgaagctgcgatggatgccctgtgatctccctgtgatctttgcatcagcaggttgcattcgtcttgcgtctcgaatccctctgcttgtttgaacttgaaataattctaggattaagcttttatacttagcggttgtaacactaaaccctaaactagttctaaaattgaaaactgcatttggcttataagccaaatccaaactagtgagtctcttcatacacagaatggctggatctggtttctaaccagtaagtttaaacagaagttctctgaacgatgagaagacctagcaaattgtttgcctatctctcgtctcacgaaaaggttcccgtagacctagtaaagttgacaggttgaataaagcttaagcaaagctatgtgtagtcacacttgacacatggatagatcttaagcaaaggcagtggaagtcaaacagctgacacgtgcagatataaatacaaagtgaaatcttgtaatagtgctcctttaaaccaaactcaaactcgtttctatctagtactactacggtgtatactcatgaagtacaaaatggaaaacaccaaaacgaggaacaaaaaataataatcttattatcatgtagtaataaaacgcatagatcacctacataatgaaatgacgtggacagtgcggacgatgacgccatggatcagtcgagcttgacggcggagaagaggtagtagacgaaggcgaaggaggcggcgagcccgacggcgccggtggcgagcatgacggcgagcgccatgagcagcgagtagccgacgtagagcgcggcggagaccgggccgctgaggctgtgcaggtcgaagacgaggtagtagacggcgtagccgagggtgtaggccgcgacggagcccgaggcgaagaaggcgcgccaccaccacctccagtcctccacgcagagccccatgtaggtgagcaccaccgacacctcgccgcacacggccaccagcagcgccatcaccaccagcaggaacccgaacacgtagtacaccctccccagccacaggctcgacatgatgaacagcagctcgatgaacagcgtcccgaacggcagcgtccccgccaccgccacgaacacccacggcgagcactgcgccgccggcacctgcctcgcgatcttgttcgtcttcaccgggtactcgaggtgcccgacgcgggatgccaccagcccgccggcgagggtgagcggcacggagacgaacgcccagaggaggaggatcacggcgaagagcaggaacggcacggcgcccgtgctgccgttgtaccagagcacgcagttgagcgcggtgaagacggcgaagcccgcgccggggaaggcgcaggaggcgcgccacgccacgcgcttccacccggcgctgtccccgtgccgcaccgtcttccagagccgcacggcggcgtaccccgccgcgaagccgaggaggaggtagatgccgagcatgcccgtcacgagcgcgccgcgcgacgccggcgacatgaacccgagcgccgcgaagaggatggtggcgacggccatggccaggatgcgcaccccgtcgccgaccatcacgcagaggagcaccgggtgggcgggctcccggaacacgtccccggcgacgagcttccacccggcgagctcgtccgcctgcggcgccaaccccgcctcgccgccgtgctcgtcgtactgcgcgaggtcgcgccgcacggtgcgcagcaggatgacgagcaggatggcggcgaggaacgccaccaccacgatggagttgaggatggagaaccagtgcaccttggcgccgcccatctccaggtacgcgtcccaccgcgacggccactcgacgccgctctccacgaacgccacctcgtaggagaagacgagcggccggttggcccgcacgcgcatgccgaccaccgaagggtcgcacccggcggccgccctcgccggcagctcgtcgtacatcttcttgcccttgatcgccgccgcatcgtgctccacgctgcacggaacgacctcgaacccgacgacggtgtacccgccgccgtccttgctcccgccggcgaagctgatgagctcgacggcgtcggcggtcgccatcagggcctccgccctggtggtgccgttccgcggcttgttgaccagcacggtgagcttgaggtggttgtacacgtagtactcgccgtcgtcggcgcgcacgccgacggggaagccggtagaccggacgaacacccctggcgcggccaggttcttgacataccggacgacggggagcgtgtcgaggaggaggttgacgtggtaggcgtcgtcgatgcggaacatgaggaggtcggcggtggcggggggaagcgggtcggtgcggcagaggaaggcggtggcattcttgagcatggagaagcggtacggcgaggtctcgatgcggtcgccgaggaggagctcgccgaggctctcggcggcgcggttgacgccgccctgcggcgcgcagaacgggagggagtagtaggggaaggggagcttggacgacggcgaggtgagggagttcaccttcgcggccagcgcctcgccggggcggtagcggtgcgggtagctgcccgggagatagaacgcggccgccggagagtggccggaacggagcaggaggatgaggaagatggcgaacgtggagcggggagccattggcgtcgccatggccattctcgcgtgcaggaggatgaagaggtgagctgatcaatgtgtgtcgtgcaaaacctgttcttattgagtacacctgcttgattatcaaagaagaaaagaaaaaaaaaggtactttacttatcagttatcacccatgaaatgggagtttttgagagcatgaactgggtgtgaaaaatcgaataggtttacttaatgggattgtccaatttttagatgaattttggtcagtttttctcaacattaagtgaaaatctaaccattcttattatcattccccttattctctattgagtaaatttcacaaaactacgggtagtttaactaaattatcacaaaactacatattgaaagtgttacaaaacaaaactatatatttaatataaaatctatcacaaaactgcatatttaaaatcgaatattagatttaataccagagttatcataaaaataaaactacagattctatagtttaataatccttaccactactgctatgttacggttacaaatgttgtagtttagtactaaacatgaagctaaatttgtagttttgtgataattgtattattaaatgtatagtcagtgatctttcatcctaaatctacagttttgtgatacacctttttaaaatatgtagttttgtgatagtttcatcaaagtatatgtatttttgtgaaatttatactcttctctatttaaacacactcacttctatattttagataaaaagggtcaactaataaattgttctaacatatactaaaaaatatataagataaacatttacaactaaatacaaaaatattcaaactctacaaaaaaaagagaaaatatggaccaaagtccttctgcctagctacaacttaagtagaatcgaagtagagtagcaaacgagcaaagttaattagcacataagaccagcgttagaaattgatgattgcatgcttgtcgtacattttgactaagcaaagctagctagcctcactagcaagaaaacctttttgaacatagatcaagattccagcacaagaagaaactagcaggccttgtggtcgccaaagatgcaaccatggatatattggatttgtttgattagcaagatttgctccatgtaacagcatctccaatagcctctccaaatcggactctccaaacacttatatagtcagctttccaattgatttggtaacccaaactcattcctcactccaataggctctccatcaatactctccattacgagcctatgacactgggacccacacgtcagcttctactaccccttcttcctcctctttttctccctcttcctcttctcacggccctcttcccgtgcaagtgcgcgacgacgatcatgcagaggctgacggcggcggctcgcaacggcgaccttggcaatgacggcctcgacgatgacccatggaacggaggcggaggccgtgcggggccggaggccgtgcggggccggaggccgcatggaggcggcagaggtcgtgcccccaccccgaatccagtgggggcagagccgagcgaatctggcgggggcggacgccgtgcttggctagaggcctctagacttggcgacctcagtgacgatggcagcgaatggcgacgtagcagacgacgacagcgacggctggcgacggagacctcagcagcagtggtggatggcgatggcgaccttgacgacgacagtggtgatggcgctcctctgtgtgggtgcgggattggtgctgcaacggcgacgcggggatgacagcgacgcacaacgggctcctgcttaggcaatggcgacgccggattcactcctcgttggcctcgtccgctccacgctcccctcccttatgttgctttttttctgcttctcgttggtggcggcggtcgcggaggacagcgcgagcaacggcgtggtcacggcgggcaacggcgcggaggacggcggcagtcgctgcttcgacgcctcttcctttgtgccgtcgtcgacaccaggacatagcaagcaagccgatgcaaggagccgaagaggagatggaaggaggaatgtgtgtggggcccatagttggctagcgacttttggctagccaaatttggctagtggagggagggttttggccagccggatggggcttggccatccggttggagaggctgttggatgacttttttaagctggaatagctaaaatttagcttggagagtaaaatagagaggctgttggagatgctctaagggcatatttaaagatatagctcggtatgtaggctcttagtttatttagaaattatctttttataatggttaagaagacaaaagctgtaattagtgtaccaaaataattttctacgtattaatttctttccatttttccatctctattttataagcgctaagagtcgatattgagctattgctaagcttaacaacgatccttttgtttcatttcccatctctcttccatctcgatcaacttactccgatagggggagtattttgttaacaactctaagagctcaatattaattgtggttttatatgccctacataccctacagctagggaacaatgattattaagagcaagttctggaggctactacaacttattttaaccatgtcatctacttggtaattacctcaaatacacaaacaacaacaattttattttattaaacggcgttgctatatttgtggcgccacaactctcatgttatctcactttctctttgcatgagttcagacttgtagtttagagcagttacaggttcgcgctctcatccaaattaaatgtttgaaaaagagtaaattacattcacggtacaacaaattgttaggtgtgtgcagtttagtgcaagaacttaaaatttaagcgttaaagtacaccaacttaactaggcggtgcattttcaattgtagtgaaagccctgtgggattttctttgccccagcgggcaagtggaagccacacgacattttcggtcaggttttaatccctatatgctttgtggctttgatgtctacatgttactaactgcatagggatcatcacatgaaccgaggccatgatgaaggtggacatgtttgcattgttttttaagcgtttatttgttagtttagcaagtatgcaccgataatttactatgttaatcaatggagacacaccggtggatttgttgctgatcagtttaaggaagggggagatggctctcacgatatgtggatagtggatgctggtgagatggtgaatggttggtatttggctgaaatttagagattggtggtgtttaatcagtgccaatgtgccgctgatgtggcaaaaaaatccaacgagacttgcactttgactgaaaatgcaccatctagtaagttgattcactactcaaatttcaagtgtttatactgaagcgcacccacccgataaattcttgtaccgtgaatacaatttactttttcaaagaaaaaaagatttagcataccaaagaaagtgtactcgggtaggatttatgaagcttcccaggataccaaacaaatggaaaaagaaaaagtacatctaagatccttcatcttatcatcgaattacaaaatcgtccctcaattgaaaaaccagatactcctatagcatcccttaacttacaagactgggttactataggtccttagatggtattgaacccggttttatctgacgtggcaaccgagtcagcgtgggacccacatgggccccacatgtcaggttgaccatgtcatcaccatctctctcctctcttctctctcttcctcctttctccctctcactttgctccttgtctgggcgggctggccagtgggtgcggaggaggccggcggggtgaggcaggagagaaagaggtccaacaggcagtgacgggcgacgcagcagcggaggcaacacggtgttgcgccgacgaggatggggccgatgtgcagcgagagcaacgcaattggcgccaccatcctcccatagctcctgcagctccgatgccacttacggctggtcctccttgtcctcatacatcgcgccgcccttgcagccaacgccaccgacgcctcaccagctctcgcgcccatcggccggaggcgaggaggtcgacgacgatgcggcgtcgacgaggatagggccaacgtgcagctggagcaacgtgattgacgccgccatcccccactgttcctgtagctccgacacctggtccttcccgtcctcatccacgcgccgcccttgccgtcgatgtcaccgacggcttgcctactactacacctgccgtccgaaggcgaggaggtcggcggcgagcatgcacgaagaggaaggaggctgggaggccgtcaagggagatggggaggccgacggcgaacacacggggagaaggaggaggcggcgcgggagcatgccggggctccgagtccacctccacggcgcccaccaccgcaacgctcgcctctacaccaaccatcacggcgcctgcctccacctccgcgacacccggccctgtctccacctccatgtacactgctacgatgcccacttgctctcggcccgttgctgccgccgctgccgcgccgccacatcgccccttcccccacgttgcccgtcgcaggccaccagatctcctcccgcctcgacccgccgcccgacccgcttagacgaggaacaaaatgagagagagagaggaggaagggagagaagaggggagagagagggtgatgatgaagtcaccctgacatgtggggtccacgtgggtcccacactgacttagccgtcacgttggataaaattggggtcaataccacctaaggacctaaactgacccaattttataagttgatgaatgctatatatttggttttttggttggaggacgattttataattcgataacaaaataagggaccttacgtgcacttgttcccaaataaatagacctagcttgggcttagagccttagacaaaaattgttacccaaagtaacaaccaggcccaagttcataatagcccactaacgacgggtctacagcccatttatactccagtttcaatagatggaaaaaaaagcaccgaaggtccatcaatttgtcatcgagttacaaaatcgtcccccaaccacaaaatcaaatacaggacatccctcaagttataaaaccattcactttaggtccttcggtcgtttttgaccccggttttatccgacatggcggctaagtcagcgtagaacccatgtaggctccacatgtcaaaataccaggtcatctctctcccctctcttctcccccttcctcctctctctctcacttttctcctctccgcagggcggctagtgggtggggaggatgtcaccgggacgaggcgggaaagaagatccggcggccgacgacggcacgtgcgacctcggggttagaccatcggagaggcccgggaggtgtcggcggcggcgacgacacgtgagaagggaggcggcggcggctgcgatgcttgagagggagaggtggccggcagcgaagcaggggtggtggcgggcggagcgggcgccgcggcaggcgagcgcgcaggaataagctgtcttcggcgtcgttcccactctgctcaccgccgcctgttccgcccatcgccgcttgctccacccaccgctgcctagcgctcacacactcccgccagccacctcccccctccctctcaagcttgtgaagaagagagaagaaagaagatgccgcggagcttggtcgggaggaggtggccgtgggagaggtataccaccggtgcgcggatccatccacccccgc

SEQ ID NO: 67539 - DNA, 5243 bp, Oryza sativa
  unsure (1)..(5243): unsure at all n locations
gttaggtcaatagaagcttctagaccagatcgcctctatgtgaaactatggtgaatttggtttacttttgctaatacattgcataaggattatcatgcaagtgctgtgtaaatacattacattctattccattatctaaaagaatgcatcgcatttcttttcttcttcgtacttcacacgaaaacaaggattcttggatgaaatattctggttgctctcgaagttactcgccgtcataggctccagcttataaatttatggattattcctgccacaaactttaaattatgatttttctatatatattctgcattaatataatattgcttagataacttgttctaaaatacttttatgtttataatatgtaatatttaattaatccttataagcattaattatccatatatccaatcatttataaagaacaaaaaccataatcaaatgctgagagatatatatcatatttttcgtataaaacttattacctctagataagtacctcgagattctaaaatttgtgtgtaaaattttagtacctacaaatattttctcaaacgtaaaatttgtcattttctaaacattataattcagaactatttgactacatatatgcaccaagaggtttcttattccaagtatatacatgttgaattgtgcgtgtgcatataaaagtttgtgtacattcttgaccatatgaatacttcttacctttcaaatcaatatattgaacgcaaaaacggaaaaacctaacaattttatttcctaaaaaatacagtagtcaagcagctgctatagtcagcaaatatagttagctactttcatcgctcacataactcatcaatagattatacacaaagttatctcctcaatagaccgaggatatagatcatactgttgtcagttgacaaggttggcagccactcttttctcatttaggagtatatgtaagattagtcttgcctaacattctccagtcatacgcattccaattaatattgtgtcttactccctccgttccgtaaaaacaaatatagtacgtgatatataactttgtagtattacgaaatattaggagcaatcgtttctattttggcttgtaattagagggcgtttaattagctactcaaaaaaaatactccatttgttttaaaaaaacaaatatagtagcttgatttataatttacaaggatcgaaattaaggagcaatggtttctattttgacttgtaaccaaaggacgtttaattggtcataaaaaatactcgagatataacctattttattaccgtgaatttagacagagatagaaaaaccattgctccttcttatccttgtaataaatcaaactataaatgaacccaatcccttaacaacatgtagtaccatcataaatatatcattataatcatggaatgacggaatatgttagtacataatcttaatagccaacatttactgagccatctttatgtcatatagtacactaatcatctactaaagaaaagaagaacaataattattgctattttaattccttacaatatttttggccaccgattgaaagtgtgtttatttgacccattttgtcatcctaaattagtttggtagtcacagtcttcaatcaacccgagttataattccttgtcctctcctccaccgtaacccgaacagctcttcttgtcaaggttaacaaaaccgtatgattatcgtacgttatagtggttatcacgtacggtaatcttttcaactttttaaaaatacggtataccacgctgtaagcctgtaacgtcgtcccaaacaatttggcgaagctaggtgaggtgacgctaaaccccgcttcttgccgacctgagagtcggagagtctcggcacgacacgacgagaacgatctgataaacactcgaccgcaacgtccccacacgaaaaacgtccagggtcgggtggggtgaaccgtgtccacccaccaaactccaccagtccacccccatccatccctgactgtccgactccgagcccatcgcttgcggtcgccatcccaccaaccacccccctcgccccacgcggcccccacccgtcgccttctccaacgaacgacgccacacggggtggaagaaaacccgaaaaataggaggaaaccgacgggggaaagccgcaaaaaaaaaaaagtagagagaaaaccagagtgagctgcgcagctcatgacacatgatggtgagctacgcctacgcgagctcggagctcagctctaaccccccggggcccccccccccccccccgggccccaaaccggggggcccccccgcgacgnccgtagnctataaaagccgctccacccccaacgagcccaccagctgctctccaccaagagctgctccgcccccctaccccgcaacccgttgctttgttccgcgcctcgctttggtcttcatccgcctcagatctgattcgttctaggttggtctggtgagtggtgcttggcgtttttgttttttgttttttttttgttttcgtgtgtgaggggattgggatgctcacgaggtgtttggtggtatgcgtgggcggcggcggcggcggtggcaggggaagatggcgatcacggtgaggcggtcgacgatggtgcggccggcgtgggagacgccgcgggtgcggctgtggaactcgaacctcgacctcgtggtgccgcggttccacaccccaagcgtctacttctaccgccggggccccgagggagggggcgcgccggaggggttcttcgacggggagcggatgcggcgcgcgctggcggaggcgctcgtgccgttctacccgatggccgggcggctcgcgcgcgacgaggacgggagggtcgagatcgactgcaacggggaaggggtgctcttcgtcgaggccgacgcgcccgacgcctccgtcgatgactacggcgacttcgcgcccaccatggagctcaagcgcctcatccctgccgttgattacaccgacgacatctcctccttctcgctcctcgtgctccaggtgagctccaaatttctagtagcaagtacagttagatccaagcacaaaatcaaacgaggttagagatagctttctggaagtggagcgcaaacaatgctttgcaactgcagctgacaactaagtttggcagtaagccattaattataacattttggggctgattgtatagctaggtcccatgttggctgttgcactaaatgtttggggctgagcttagcgggtcacctactctttggttggctttaattagctgcatcagatgtacggttccatccaggcagttgatgtctttctgttgtgggcggggtctatttttggtttgatgtttatgcttattgtgatagtttagtaggggttgtgtaggaattatagaattttaaaacaccataattcaatgccaataatcagtatccactaaaaaaatgaagtatatgcttcaccttgactgtgtcaaagcctagacaattttgatttgtccagagtgattgtatcatatagatttgaaatgtgtttttcacgttggactccacattgtcttctatgttataccatctaaaagtggcagcagcgtgcatcaatttgtgcattaagagtaacagacaacaaaagccaccggtcgtgcgggtacatccctgccaagcttgagaaactaatactagaggactactttattaagtagccctttaatttgctccggtatatccctatatcctgtcctgaactactacacttatggattcatgacctacagatatttgaaccgagaagcttatcccatttggagctttttaacattggatttgcacgtttaaccctgaagcctttgttgaatacttaaaactttgtggcgatgactatatatattgctttgatcacttaagcataagtgccgatcattccatgtcattccatgttactgctgatatttaagtgttttgatgccagaagtaatggttagattgcattaaaacttgttattagatgggaacaattttagtaggcactaatgtttttttttcttctagggcctctatagctcccatatatggttgattggtcaatctcattgttccaaaatgtcaaccatttgccccatgatgtagacaggaggggacttaattgggtgtgatattaacattttgtgatagttagtctttgactgacaatagctttcttttgcctgttcgataactggagcccttgtcctgtagagcctcatgagctgtttatcctttgatggatacatcattcaggttgcacgttcaattttgtcctaaatgaaacatgtctgatctgctcaccttctggttatccatcatcagctgccctttcatgctggaattcttgtacaataaatcaattaggttgaatgaatcattagtcttacgtgagacatacttgactttgaaataatatggtacagtgtacaacacaacgtgttaatggaaagaatttatttgcttgtaagtctagtagaccttaggagctaaaattttatttagaaaattgttctaataattgaggcacatgctaatactttttccttgcaactgaaaatttgtgcatgcactttccataacataaaactgggccaaaatttacaaggttacaaaccatagtttcattcaatttttttactcgctgatatgtcagcaaccatgactctgagtagtcttggtgcactgcatgttggttggtatggatctgagtgttaactggagcatgttccatctgacaagtttttgcttataataagttaatagatagtactgttttgcgccatattgttccaattttagaagttatttaaaccttgatttcctctcttttatcaactctagttgttgctaacttgttgtaacacctgtttagatggcaagctgacttcaattgtggtgtgcatgcatcaaccttcttttttttgtgggttgggttgaccatggaatgttgcatcctgagctagacaagccatttgcatgtagtccttctctgttagttgccaataaaatgtcttgcagctgtggcaaaggtacttttgcattgcttggtagagtgcttgtcaattgttggatcctaacaccttgttaatgtggatctgaggcctgcgaatatcatgcatcccaaccccaaaaaattgtagagaaaattatgttactctttatctagtgcacaattggagcatctcttgtcatctgtagttgattccttctatgttcatcagaaacttggt

SEQ ID NO: 67540 - DNA, 28756 bp, Oryza sativa
  unsure (1)..(28756): unsure at all n locations
tagttgccaccactatctacaagcatcgactagaaaacatccagagtcatgcacggcgatcaaatgattctgatgtatcaacaccatgcctgctgacagaaagattgcctttcctgtcacgttaggaagcaatcaagcttatgcggttgcatgtagcgtctgatgaagcccagaatgttcaggttcaagagcagagctgctgcttcatatctcccaggtaccggcatattgctgcagcaaacacctgaaatggttgcgaggtcagttagctgaatccctttatttgcatccgaggcaagctttttgcaaaaactaattccagtttggagccggactaaagcattaaagtagcactgcaatattctcttgcactgatcgagtaggaagcatggaactactcaaatgttttacaaggatcatctacttaccattatctgatcctcttgaacccacagctggaatctgcatcacttgaaccccaaaggagcctgggccagcaacagcaaggcacagctaccagcagcgaacacatctagtatgaatcttgcattaaacagcttctagcttgattggtgcttttgtaaaaactgataaaacaaaaggtgcttcctctccaggatggatggttgtgggcacaattgtgtatccttttggataaggctccaacactaattcacatgatatctcccttgagttaacataatctgttccacccactgattcatgcatgtagatattgtaagcagcacggcagccccgtgtcttgagtatcctcattccaatgtaaaacatagaagagtcatggctagattgatagttccggaaaccatttgtctttctagaaaaaccaacaccctggcaaagcatggaatttgtttatatcaacatcatagtgaaatctccaagtacattaacattcaggatggaatatacctgcgtaagggtaataaatacatgtacaggatacagtgcatcccgtcctgttactctaagccggtactgaggattttgatgccatgagtcataatcttggcaaccacctgcactataaccacgccattggccatggacagagtaacgcatctcgggtggataaacacgacagacatatattgaccgaaagtggatctgaaaatcttgccaagacatccagaataccccattctttgactgcaaaaacaaatatgggtagggtcaaaactgcacacggaaataaagttgggaaaatatattttgtttttgtaggtacaatgccttaagctgaaatcaacaaactggaggggtgacaatcaacacatcggtttttttctcattctattttaaattaaactgtagtgtgctcactcaagagcacagtcaacgagataagcaacagaccaacaattttatcatgctaaaaggaaccagtatttggtgggttcatctattaaatttgacgcagttgtgtatctttctaatcacaattagtggaataccagctgttcaagtacacggtcacagagaagagcaagtacctgtggaacatgcttaagtttgtgcttcattcgctcagtccactcttgtgatgagtctgaccacggaccattccattcaacttcatttgcccacggatttctaatttgcacgagcttatggccatcaacttctcttacctgtaacatacaatataaatttgtctagcgcaaaaagaatgggaactaagtgattgccaaaagatacagacaagtcagagcaaacctgcaaaattgagtaagcatgtccctgaacaatgccacttgatgaaatatgagcatccgagccagaaggacttccagcaccaagaagaaagccctcttgtttaaaatgcaacaactgagaccacaatcttccactagcaagatcaatctgcgcttgggggctccgcatgtcaatctcttcaccagctcctcctgtgagatccactagagcatcttgcacaagcccaccctccaatgcctcataagagccatgaagctttgcataagctttttcaagaatggatacccacagctcattttgctttctactagtagcaaatgccggtttccccggagactcacaggggatccaatcatcaaccaccactgccacccattcaccctagtaatttacagaacattgaaatataagctcagatcaaactggtcaaagatagttcttcacaggacaatctcaagtcttttttgtgttggtgggaaatactccctccttcccaaaatgatcatcatatatgtttgtgcaccaagaccaaggataatttaaatcacatcaatcaagacaccatacacacattctcccacaatgcatgcatcgatcaaaacaccatgccaattacacctagcatgcacacattctcccatgctgcattaattgtattctgataaaatccgcgtctatgcggttatatgatgatcaatttgagaaattttgaattccattacatgatgatcaatttgggaaggagggagtaatccacaaggtctggtgaatatgagctatttatactattatttcacttttatcaacttacctttgagtttcatcgtaaaatttacaagcatatactgcatatgtaagttgtgcattagtgacttgttcactcatggttttcaatgttgtttatgcagggcataatgcacatgtgtaattgtatatattgtgtcattccatttgggaatttccctaaaactcgagcaagataatggtatgcattatgttcttcatggtggtatgccccttactagggtctcgcaatgttagcatttcagaagacgttggcattcttatatgcaccctatggaatatgaatagcaaatctaaagtcatgaatcccatttttcttaattaaagcatataggttgtaagcctatgtataaatatatattagacagctctaacaactgtttatgtatttatgtagtatcaacttgtccaaattaattatttcgaactagcggaatttatccaaactaaaatctgcaagtcaaggtttcactgagcctctaacagcactattaggtagcacacatatccaccatagctctagtaacttgtggctgttgtattatttctgattagaacttctttcccacaatgcagaagaaaatggcttgttgatatatgttgaacacaaagtaacaaagagaatcaacttgcagctcacaaatctgttagtttgcttaaccaattcaactttgatatttaactctgtatgagactaaaatgttaaatctcaccaagatggtgtgctctaccaatatactttaccaaaggaacaacccaagaaaatggaatggaggacagatgggtcagatcattgaatacctggatacagaatctgacagtgtaaatcccttcttcattatactcaggagtgattataacttcagatatacgggccatctctgtcaaaactgcaacagcgctcaagaaccaacagtcgcccaaccgaccctgaaaagaacaatcggacaaattggattgtgtgtcatgtataggaagatggaaatgtataaagttgaaattctagtataggggaagaccccacatcagcacaaagcaaaatctgcgtacctgacacacatctgacgaattcacagaaccagaaaataagcacggttgtgaactgatagatacctccttcgcaatatcagaaggcctcatccactcagagacaacctaaactcagaaacacagatgacagatcaatgtcaaagaccaagccaattcttagtgcacaagtcagaaactcagccagttcttagtgtacaagtggtagacaaatgcatgcaatagtacctgcaattttagagatgggttcatcggatctacaaacagagatcgatcatccggagggaactcttgatcagtaaaatttctctctcccttcgcaataagagcctctctaacagccctttcgacagaaagcatgcgctgattgacttcctctcgtgtctcaaatcttggtttccttggtcttctagcaaaggagtcaatgtcaatagctacagaatcacgcgcatgacgtttcctaccactggagtactgtccatcccattcaacgtcctcttgatcatatagttcaaaatttgcttcttcactttcccagtcatccacctgttgaaacaatattagatgtatgaatatcacatgcataacttcataatcccttccatttcatggctctcaagaaaggtagaaatgagtaattgttcaggccttgttcgtttaatccctcccaaaagaggatttggaggggatttgttccacacctattgtgttgtggaatcattccccctcaatccctcactattggggattaaacgaacaaggccttaggagtttcatgttcccttctaattaatgaaataaaagcaagataaacagtaggaatagattggtcgaaacaagaacttgcccttgcagaataacttccatgccaagcatcctcagcagcaagatcaaaaaggccatattcagcagaacagatggctgtatgcaacatagcaacctcatcttcagtcagacatcttccccatagaaaagcatccatgatctgcatctttgagtctgatccctcgctgtctgacctaccaaaggcatctaagtccgtgggtggcctagcaccaacccaaatatctgtcccaggttcccagatgccattatttctaggcaatggcaacgcattctgatatccatcgtagactccgtctatgaaagaagttgcttcacctagatcagcatctatagtcacagtgacaagatgccacctgaaaattaacattggttacagtcaggcattaccaggaaaaaaaaaagttgatgaaatgttccacccaaaaagacatgcgacaagtccatgtaagactagtatttcgatgtgaatctgaacataaacaggttggctctcttgattctttttttttcatgcaaaagaaacagcagttgtcacgagctggtacctgccatcagcaatacttgatgcaccaatattccactcttttgcaacggttgtcatcctttcacccttagtcaccaatcgaagaccaacttggccagcttccattccctgttctgaccctgccaccaagatttcccagcacacttttttctggaattctgttccaaaaagacagactggacctgacaccggctgcaccattactgcaatggagaagctaacttttttactttcacaaagacacaaatcaatctctccacaatgacgcccagtactccttggttcatcatcaagtatgcaaacagtgtctggaatgccagtctgcacagttcgtaacaagtaaaagatccaaagagcatcagtaaaaaagtaattacaagaactgcatgtataacatatggtactaaatttataaacagaagaaatgattccaggctattacacgtaactaactgtcatgcaaaaattgatgctttgtcagataaccaactccaaaatggatggcaaaaacagataataaatatccaaagatgaatatgttcagttcatgcactcaaaaggtacaccatgagaactatatcatcattaaggtgtgctttagaagttgataaaatctaatgattacaggaacagtaacagaacctgctctgctcgccgagccaattgtgcctttcttatgtgacgagctattgacgagaccctgtcccttgcaaaagaatcttccagagcagaatcaccacccacagctctgacagctgctgccatggctgcagcatccctgcttccagcattaggaatagaagatagcagtgatatttcaagctccttccattttcgttcctctctctccaacaatgccttcctcctttcccttcccttcccttcttcctcgcgcctttgcatcaagacctcctcttccatttctttttcccttatgtagctgaataagcgaataagagaatttagatggcgggcacagaggtttacagggttgcagatagaaacattgcatacataaaagttttaacaataacctttcttgaataagttcaaaatgtcttcgatcttcaggcatccatttcttgatttctttggcacttaagtcagaaagacctatgctgtccagaaaaagtctaagacgaacttcatcctgaaacaacagacatttccaacattgttacagattttaagaacaaaaaagattaggtgggagtagtcccaaatgcatacctgtatttgctcagctttggcagtcaagccaagcagaagaagtaaataaccaccaaacttgtcccacatgtaaacccattcagtatcaattgcttcttccaaagccaaaatacgtgcatgggcacacatattcctccgataatctacatctacaggggatccaatcattaaacaattcttcactccacaaaagaacgatcctgccgtaatttcttcatttcttaaacgatctctcagcttcatgacatcagccctaggaagcacaaaattcccagccctgtccaacgtaatagcaggatctccaaccaaaagagcagcagaacttgcggatctctgaggcgccgagtaagtcccagaaatagcatttctcgtctgattgcacacaaagcatactattaacaatacagaaataataaaaatcagagtcataataatctcattgataagtactggtcctggatattggagtagataacaccagcagcacttatgtaagtgtcaaggctgacaaggagtgggaacatacatgattgaacttgatgcactagattaagaaaacatagttctgatctcagcgctagatgctaagtggtaggcttactgaggcaggtttaacagaaaagtatgcaagcaagaacagcatttacctatgttacgcagggatatgttgaatatctgaataatacaaatatacagcaaacttactttgttagcagaacgtgacattgcttgtacaactgtatccttactgagaaagtgaacagcgtcctccagcatctgacaaaaatttcacaattaatttaagaaggatcaagaaaaaagaggaaataaaggagtgtattattgccattggtattggcacttcaggatttgccaaccaatgtgccactgatgtgagcggctacatgtggtggagttgcaactggcaagtgctgaagtgcatatttttgggtgacaaatcctagattttcctaagagagagctcatttcaataatctgctgattttggataaacagaaatactaaccttgagagtcaggcatggtcgagaaacagcaaaactgaaggcaattacaagagtgatagcagaaatagcagccccaataaatggtggattcaatattagactggcaatgacaccccaaacttcagtagccaatgcaatcccatacaagataaggaaggcataactgtaaatacagcaatgttagggtgtgtgctcagatgacaatagtacttctaaaaatagcatagaagaaagaagttatgagttatgaccaatcctggtcaaaggaaagatatataagcatgtagaattagaaaggccatatcctgatatccgtacctaacatttttagcagagtctgcatgggcatcataaacataaacaggtaataccctcggtgaatacacgacaattggtggtgatagaaggacctgagaagagtacagtaaattcaatattacaagcataactcttgagataactcacaagtagcaaaactagcatgagatgttcaacagaaattatcttaaacatgtagctaacttaagttaagaaaaaagatatgaaacttacagtcaatgctcttcctgtgagaagaaatagaaacgagaaataacctatagatgccccaacgaaaggtttctctgcaaaaaatcatcagctgatttaagctatgtgcataatatgggaaactattatgtaactcggagaaagaaaaatagcaataacaggttgaaaagcatataagaagatgtagtcaccctgaaataagcccatcaggaaagcagccaaggcaaggagaaaagcaagggagcaaacaagtaacatttgtgtccttgttaaatagaaattgttagatgtccagtagtgaatgacaccaatagcaaatacaaggaacaagatgacaaggaggcatgcaactccaacctgcatagcaatgacagatcaattatgctgtctcttatcacaaatgaaatgaatattatgataaatttattttgaaaaccaagccacaaactttacttacagtccaaggtctaattgtaacaattactgcagatattgcaccaagcaataacagcactcccatgccaacaaataggtaaactccacgggaaatcttccaatcatcatccttcctgaaattatttgcaatttcatctcagaggagcagaagtatgcaaggacgtacaaataataaacatggtttccaattttccataccatttatacatcccagtaaacaacgagaacacagcaggaatgcaaagtaatggaagtaaagctgccaggaaatcagccttcagaggaactccatcctgtcgtgaatttaccactccccagtaggacacaccacaaaaggatacaaggacagctgcagaaagtcaccagtcaagtgccagttatccaaaagtgtgatgtgctctatttaatatgcaatgagaacggaaaagaagagtagaacatacttgcaaaaaggccaacacatatagctgatgaaggtgaaaatcgataagtagcaaaccaagcgacaataggtatcaccccagtggcaagtacagcaatcgttgatgataatgcccatccaagatacatcgatgttgcatagggagaatagaaactctttttatcagcatcccatcccttgtagcccaatgcatctagaggttttgctgatactattgcaccaaggccaattactgatgcagtgaaaacagttatgctgatggcaaacagagcgcgctgacaagaagataacaacgatcagtaacatgaaaatcattaacaatgctggaaggtctgaatgcgttctacactatttataataacattagagaggtcaagaggtatgtgctgtaaaacagagcctgaattcttttcagtaggatagcctacaaaacaagattttatctaatgctgataggaatcacaacaatacagtgaaaattgattcagtaaacatattcaggcattcatccagaagttgttaacagtatattgacataaggccatatagtaagatgatactggttacagtacttcccttacaactacgcaaatagcttatacagacatttattggatatccaaatatataaacaaaagggtgtcctgctgctgaattaacaaaaacaacaaacctctttctttcctggagcttggcggatattttcacggctatcaagctcccctcccggaatccagaaacggtaaccgttacgcatccatatgggaatagcaaatgagagacaagccaccataagtgggaccgtgagtgacaaacccaaaataactgatgacttgctgcagaatggcagaggtagtatttcagacaaaagtgtaagtacttccccaatgaaatgaatcaatgattataaaaatctagtggctagagagtcatacatatgtataaacaaggcatatgcaagatgctgtgaatatgtcaattgtcaaaacaggaacaatagaataatcaagaagcacattttagcaagctaggacaccttatccagataaaaggagtaatccacttaaagctaaaactttgcatactaggaactcgaggcagcagctatgactggaatcttagaggcagcagtgaccaggaactctagatggtggtgttgaccaagacctggaggtgacaaagatggggagctcaaggcggtggtggcgactaggatgtggaggtgacggcgacagggagcttgaggcggtactgcgttagcgattgggacctagaggccgtggcaaccaggagctcaaggtggatccagcgatgatcaggaccttgagtaggctaatggaatggaaggggatcaagtaagagttttcaggctgagcgctggcagtgggtatgatggcaaaggtgggtaaattactcaaacaaatcccacaaaagccatggaggagcaaggaaatgagatctccttgtcttcatgaatgggcttccttttgtgagcaactcctgggatgagctagccgtgtgagaagtttgctagcttttttctgttcaaaagctggctaaaagctgtcccaaaggaggtctaagacaagactaccatatagcagcgcaaagcacgtcagagtataattttatgtacatcaactcaaaatgagctgtgcatagagaacttaacaagtaattgtaccatgatcagataacaagtggtgaggttatcttcatgaaaatagataggtctcttttgtttgcaacaaacaaaagaatgactcgatgacatttattcgtactaatgctaataataacacacatgatcaattctaccaatataaaaagattccaagcacaaggtggcgtagcaaatgaaccaggcagagacacagtattatagtaacagacttatacaataaaatgtacttgtgtagaatatacgaaacaagtggacatggctattatgctgtgcatgtatcatttgatacccatgtgaaacttctagtcaaaccagcaagacaccaaagcagggaaggaaaacaaatgagtactccaggatttacacaaggcaaaatgcagtagtaactaagtgaagttttaaatattaaataacaaacatgtatacctcaagaaagacagaagtagaccaacacaagtactcagcaaccatgcgatgaagccatactgtagatgggaaaagaaaggaaaagtcactatagctgaaaatccacgaagattttgaaaaaaaaaatcaactacatggtcaaagtaagataaagcacacattgtaatcagatttgatattttgtagacgagttaaggaggacagaacatatctaaatgtctagtgaagaagcaaaaggacttgtcctgccatgattaaaaaataagtgcttggtattaatacgacaaatatatttcttttgttcaacatcaccttccgaggtttggatgtcatcgtcatctcttctgcacacagggaccaaatgaatgccataatggagcagacaactggtgatagaagcagtatcgagaaaccaaactcaaactgccaaattcgaaaaaggacactcttgattaacaacacaatcaacatttcaaagtttttatactgtctttgcaacaaacttacctgttcatgagttgcatttataaccttgatgggcttcggtcgatggacagccacagtaactgtttctatgatgaatattagggtaaaaacaacaaaagcacgtattggtgaacctgctacttgatgaaacatcagccttgaaagatttagccaattttctagcccacttctcctaagttcctctgatagcgagatctggtttgcaatagttgtatctaacctatctgaatcagtaccagtgacatctacatcatcttgatgctctctgtctgcatctaagctgcttctctgcagcaaagctaaaattcgtgggtccataaccttgtctttcatcatataggaaaaatttggatcaaggcctttatcctgaagaagattagccaattctacatctcctagtccaccattcctttttagcatagatgtgattcttggatcattcagtctgtcctgaaaaattgcagccaagttcaaatccaatagctgctgattacccgaggcagtagctgatccactagactcgcagccttgactttccaaaccactactagagcaaacaacgagtgaagcagttgggtccccatgcctgtccgctgaaactacagcagtttcagggtcttgtacagctacagcagaaaggcacgaattactgcgatgggctaaactggcacgtccactatctatgttcttgtcagagctctgtccttcttgacaactattcgatcgatcaaaaggaacattgttccaattgacacaatcgctttgtgagttgcttctgtacatagaatcagtagcattgccatgaggaccagcttcaacactgccactactacgcttcacactagatccacagccatctgatgagtttgaagaactagtttgccccttccttcgaaaaccttctcggagttttatcactgtgcttcttaatgcatctatccttgcaactgaggggtttgaaatagaaagccagcaagagacagctgcagctaaaagcacagatgctacaaaagcataactgatgcaatgtccaaggtacctaatgtaacacattaattagtaaacacaaagtactagatcataaatatgttcaactataaaagcataaagatgaatacaaaccagtagtgcaccccaaagcatataaggaaaacccttgatgttccagctacaaatagcgctatcatccgacttttaagaagctcaaacctaaatgaacacaggcccaaattccagtctgtagaaaagaaaataagatgtcaaagaaatagatacatcatgcacaattagagatacaaggccaaatcattaccgagaatcactactgcaactgaagttaaagcacccagccagcgtgcttcttttgatgtcagaccatataagatggaatagacaacaagaaccatcaatgagcaaaggtaaagaagccctagatgcaagaccctgcattttaaggcattgatatgttaccaaaactactagaaattattgcttaccccagtaacagcataatagaacaagcacgttacttggggaacatatatgcctatgtagtatttaagagaggaaaaggtagtgaagtcacctgctggattttgtcatgtataactcactaggatctggtgggtcaggcgagcatgaaacaggggccacttcaacacaatcagaatatgcaaatttgtacaaccttcggacatactcatcaacatcgaatccacttcctgtacatgtaatgtatgaaaagttatgtttctcaaattttttatttacaggtgataagaaattcagcaaataaagataacggataagaattttaccattgaacagtattttacttataaaaagcatatttatggccaatgaaattgcagataccccaaagaagaagccagatggggaattgagctcagaagcactagcaccggttgtaacataaacagcacaaaactcataagcgcacagtagaccgactgccaggagtagaagataagcaacagcctctgcaacaaccaacatttgttaacatcagtaagatattaataaagaacaatgagatgatagagcggcccaattttgcagaaacagcacatacaaaataccacatgaatcaaagagttagaaattgcagttttataaagtgagaaaagttcaaatttgtagtagcatactagtatttttaatcctccgtgaagctttaaaagttttcctttgagtatgccaaaatgttccatttataccatttcctagttacaattgtctagaaacaaattggacccccaaaataagcagagaagtcctagacaatcatcgcctattagaatatcaaatttaatgaacccatgacttagaagtcatgaataaacagccacttatcagaatatttggtttaatgaaaccatgaccctaagtacaagcacattgagtagtcatcacaaaatgtcctagaaaataaaagcatgtaaacagtagaaaacttactggagctttgccattgcgttctccaccacaacattatagagtagaatgacagaagcaaagcaacaccgaccattataacagctagcccaattatgttcctttccaaaagagcaataaggatgcctccccatactaacaaaactgttattggagaaacgacgacaagccatgcaaaaagagtgaaaaagctgcacagtgtgcttagttgaggtccttgcacatatgctggccatttccttgcatatatccaactgagtaacaaaacaagaacgaaaatgttagtagcttaatgagataatccagctctcagaacatcaggaacaaatcaacataaacaaatatgcatagaagatataagaatagaaaaacatcaacgtttttcagggcactacttgtgattgtagttagacacaattacatgatcgtattccataatctacatatgaatggcaggcttaaaatatataaggtgtggtgttggattagcagcataataaagacacaataaataatttcagttgttagagtgataatgataccaaatctacattgttgtatgcactctgctggctgaaatttatggaaacataacgtatgattaataatgcaacctcgcagactacagatgcaaatgctagatgccaacagaagcacgcctaatctcgagcatacctatatagcctccacggcctccagttcacagcccataggatccaaaagctgagagggccaaggacagcgaagaggaaaccgcagatgctgcaaacaagaacaaccccgcggtgttcctcctcttccatcctccccctctgcaatcaccttctggaagctgatatcatgtatacaggctcaaacaaacctgctaaaaggtagaacatacaaggtccaatgatcaaaagaccaaatatacataaatgacactaagtatgcaggcaaccagattagtagtaattactaagttaattaagacaaactacgttgagttcaacgcatatggtaatattttctcaaaatattggcctaaatcagtccactacaatttacatgtaacagatcaatatatattctatatacaacaaacacccccaaagtcccaatgtggacatggctttggggttttccttaccaaacctaagcaccgaggatgagaaacttaagcttaatgcattttaatgaagccaccagcctgggtgcggctaacaactaaaaacttcactacctaaaaagggttattctgtgcatcacccaggtgctatagccctctaaatatggtatagataaaaaagaaatcccatgtatttgttctttatgcatacaacactacagattaagcccttcaaatggataaccaataaactaaacaagttgattgaaaagcaccagcctgccagctggagttaaaccattcagccagggtgctaaatctacagcaaatttggtggtaacccgataaaggttcactagttaaaatttattgaggtacctcgagttcaataattgaaccaaatattttcagggccacagaaaatataccacaatcagatttttagcacgaatcgctaaaaattaaagaataaggaacattaatatcacctgccccaacatttacactacacgttaacggatattaaataactgcattctgaggcttcaattatctaggagaccattttgccacgtaaaacatactaaatccgaccgttcctagaccgttttatgcccagccttatcccaaacatgaagtaagttccaaaggttgagattaaaccatccagaatgcatgctactgggtcaggacagatccaaccttcattgcccgtcataaccatcaaatctctatgcccagaatatcgcgagctgtacaaacacactaaatttcaccaagccgtttgctgcatgccctcccaaaaggccaccaaatctgtcaccgcgcgccaatacaatcctcctaagcaagcggcctaatataggctagaggacgagcagccatcgcgacctataagccaaatcccactaaaacctcaaccatcttccgcccccgcagcactccaaacacgccagaaagaacatctcctcagaaatccgcacctcccagcagccagtccaaccgtcggaggcagcagcctccgcgcgcacaggaagcgcacccccacaattccaccaaccccccgcaatgcggcggccccggagcccgcaattcccgcgaggagcgcccccgacagcacgccagccccgccagatccggggcgccccgccgcggaagcccccgaatttccgcgcgaaaaccctagccccgcggccgcagaagcagaaacagcagcagcaacggggcggcggttacctcagcttaggcgccgcggccccccggcggcggcgggcggggcgggcctcctcgccggcgaccgaaaccctagggtacggcctctccccacttttttctctctcctcctcctccctctctccctcccctctctctctctctctctctcccctcacgggatggcttcgattcgattcttctccgtgcgcttgctcgcgagcgagacctgtgtcgtgagcgagcggagagggggggagagagagagcaagcgcagcgcggcggggtgggggagacaaagagtgacgtttgtcaacttgggtgggctgcgtgctgactggtgtttggttggtgcggtgcggtgcggtgcgtgtgcgtgtgcgcgagcgtccgcctgcgcgactgaccgctctcgcttcggcctcggcgcgagcgagacttgggctctgctccgaccgagcgcgcgcgtccgcgtctccgcgaccgagggggagagtccactccactccacacaaccgcgagctagacgcggagccagcaaagccagccagaccagcgaggcgcgccgtttcccgtgcgataacgtgcggcttttcagcgtgtttgctagtgcgaaaggccgtattttgctgcgatttccgcgcgcgtactcgcagtgtctttctggactcactgtatcttgtgactttttaaccgggagtgtagtactttgtatggatggcagtttgtatcctaatgaaagaagatacgtaaagagagtggacatgatgaaagtcatatacgaagtacttgacgtgagatgtaacaaaatacgatagtttcctagcgtaagaaattttggaagactttgaaggattggaccgagaggaataaacggtgtactctctctgttccataaaaaaactaacttaatactatatgtgacatattctactacgaatctagacatacatctgtacagattcattgtattataatgtgtcgcatctagttctagattcgttttttgtgggactgacggagtatcttttcactatctttgttaatataagattatatacaaaacgtggggccatctagcaatatatggcgggaatgacaagaaacatagtggatatgctacatgatcaggagtgagagtaattctatgtgttcaccatgttgctccgtaaataggttattaagaaagtggtaggacagataaaaggtaactagctaagcgtgatagtttttttcaccgtacattatgttttggatcatacgctagagtttaatacttattttcttgtgcataactaaaagacataacggtaactctaactaggggctttctccatccaggatgatattattagtcatttaagctcaattggcagtctatggtaaaatttatcgctgaagcgattccattgaggtttatcacaagtttgtccctatgtattccgggtgttattgtttactatatcaacttttctgtacacgaagtgcatgcatggctcgcgttcgactcagttacttcagtgcttcgtctattgcacctgtcttgggacatagtggttatgttcacgcacatgtatactcataaagagaatttaagcgggagtatacatgtcccaagttgtgttaagggtttcaattgagagtagaaccaataaaccatagtttctgactcaatgtacaaggctaatgatgaggagatccatattaacaactccatggtcgtagtcatgaattccatgtatgaggtcgacaattaaggcttcatggccgctgactcattgggagaggccaacgaaaaagtgcccgtggttgccgactccatgatacatgcattaatccagctgagagcaatttggtgttggcttagatgacacgctcgacagtatttaataggagtcgtagaataggaaataggaatctcaataatttattgcttgtgaggacatatctaaaacgaccaatgatatcaatccaaagggagtataaaattaaggtggcgatatgtatatacgacggtctagggtaaaattaacgagtgatccgtgactatacatactataatagttgccatggacaacattttcaaaattcaccaaaatcatccattaggacctgttggtagaggtcatgatgacatatcattataatctaatctacactctggttgatcttcagttgctttcatatcaaaaagtataaaatggattcgactttgtacgaaagttcaaaagaaaagcaccatgttaacatacgcaatcaagaagcttagggacgtccttcctctatatatccattccgtttaagaaaaatatgcttcattcatccttcatttatccaaaaatatatgtattacattaacatagtcttaagacttcaattctgaccaccaatttccatgataataaaataatagtactgccgtgaaagtgcaacaactaatgaaatcataacgtcatggagtatctttcagacaaacatacacacgtcgttaaatgaatccaatctaaaacataaaaaaggtatcgacctaggaatgtttttcacaactgacaggaaattattaacattttaccatacacagtaagtaatacagtaagtaaaatctcaaacaagttcatcagataggttttccctgaattcctgatacctaggcaaatagcccaagagaaagaagaacgcccggctagcatgggccgggccgtagcattggttgattgcagccatcttctcgtggcagttacgagcaaaccttgttgcctgcctgggttctgaatcctttgacaggccgtcgtcctactgtccgaccgtactccctccgttatagattttgagtttttacttgcactgtttgaacattcgtcttattgaaaaaaattaaaattattatttattttctttgtgacttactttattatccaaagtactttaagcacaacttttcattttttatatttacataatttttttgaataagacgagtggtgaaacattgtaagtaaaaacttaaaatctcttatattatgggacggagggagtaattccgtaaacacaacaccttgccgtagattgtactatactgctccagtaataatgcttaccactactcctaccatgaaaaccaactgcctggagagcctggacttctgctcaagaagtgaaatcctttacaatgttagcttcagctgttgccgactcgctgtcatttgtcaactaccgccgccttctggtcaccctggacttctactacactgattttgatagcaacaccgcacgtcccatttcgaggttgatatctttcgtacctgcagaatcagccgcgatagaagccaactcggcgatgcttctgctgccgccgccgccgaacgatgattgtagcgtggaattagactggcagagtggcaaatgtagcgagagatgtggccgtggatagataggctgtgtttagttcacactgaagtttggaagtttggttgaaattggaatgatgtgattaaaaaattatgtgtgtataaaaggttcgatgtgataaaaagttagaagtttggaaaaaaactttggaactaaacagagccatagatagctggttggtacttggtagcagtggtctggtacgtacacggacaattcttctgccgtccatgtggtgggtaggcgtacatcctttattgtgatcaccaaccgtgccatgcacgcacacctaacattccggcacaggtctgtctgaaaatgtaatcactgctaaaccagcttaattatcacagcggagaggggtcgccagcccaccacaacttgattatgttattaatcactagtgctgtccacagatgatctccactaattagctctcttatatatctcacagagattttttttaaaaaaaaacagagtcaataactgaagacatgtttccttcaaaaaaaaaggagagaactgaagaaatgaactttggtatagaacatccataagtttgtatcaagaactgaatgtataatttatccattaatcagtgtacaaagaaggggggctgaaatctaagaacttctaatggtaacatgaagaacagaaggatttcaaagaacatttacgattacagactctaccacattgacatacatgtgtgatcctcttggaagcttggagcttggatgtgtagtaggctggaacaacctgggaagccgaggcggcggcgatctccagttcatggctccggcggtggcagctcggcggcgggcgccacctcctccaccacgggcggggggggcttggcctcccgccgcctggcgacccggcgaggcggcggcgacccccagcagcaccaccggcaagccagcgtggcgcagtcgtaccgctcgtcgggcccgtcggcgtggcgcgcgcacacccggccgaggacgcaggacagcagggtgagcaccagcaccgccgcgagcacggcgaagaacgtgccgatggaccccccgccgccgtggccccgcgccgccgccccctcggcggcggcggtgacggagccctggtagtccggctgcagcggcgccgcgaacgtcgcgatcgccggaggcggaggcggcatcgacgacggcatggcagtggccgccattcttgcatccagtgggggggtgtgatcgatggaatggaccagctgagtgggatcgtcgtggagttggggaggagacgatcagaattcagacgagcatagcatgggatgggatgggagcaggaatggaatattgagaggtttcgtcgaaagcgtcagctcgctttgcaaaactactactactactccacgatggtgatgtgtcgaaggatcagaggaggataggtgcagaaaagttcagaaaaaaaaaagagggagagcaaacagcaaagtctgcatttctgaaactgcaaggatggcttttgtttggatcgagtggaggactacatggaaagggaacaaaagtgtgatggctggtagtcatactatccgtggaaaattcaggaagatgcaaggggttgcgaattaaccttgagaaatgtatacatcagggactttactggtgttgtttgattaacatgcaaggtggtttcccatgaaacatttccaactttacgtttgtctttgtgactttgtccaggcacagggtagatgcagttatttctaccatttgttccatactctcgcccttttccgtttctactttctgctgttgttaattatggatgaacgtcaactttttcttccttgagtcgatgatgtgctgcgccagtcgcaaatactgccgatcaagcccaagcaaatcctactttaaggaggcccaaaggaattggcctgaaagtttaaattgggtctaaacatggcccaaaccaacataaaaactggacgctgctgggcctcgccccacattctcgaggcccttgcactcttgcaggcatgcacagccttatttatccaggccagctgtaaatccttaaaattgagcttcagatttcgccatgaatcagagatgtttcgcgtaatcagaactagctgggtggcccgctcacttgcgcggctagcacctaaacaaaatcatatattttttaagtatgattttactttaaatttattaaatagttatccccgtatcatccccgtatttctaattatatagtttttaaaagtcacatcagctgctaccccttacttctgtcatatccttctttatttgcttgctcggtctaccactatttctattcattctccttgaaacctttaaaaattggatctgttttttgagtttattatttcgttgggtttcgtttttataatttctggaagtctcgtcaaacgctgccattatactcctctatggcccgtccactgtcttttctctttattgtcattgggattttacaaatcgaacataattatcgttcgagttcattttttttactttttataagtcccgccaaaccgtcagcgtttttgccattgtactttttatggctcgcccgctgtcttctttttttattttcattaagattttaaaatcgaacatgattatcattgtttttttactttttagaagtttcgtatctttaaaaattggaccctgtagtttttaaaatttattgtcttgttgggttttattttttataatttttagaagtcacgtcaaacgatgccactatactcctctacgacccatccgacgcctactctttattgtcattgggattcgaaaaatcgaacataagtatcgttggaattcttttttattttctagaaatcccgccaaccgttggcggctctgcaactatactcctatacatcctgcctgctgcttctcctttttattatcattgagattttaaaaatcgaatataattatcaatggggtttattttttttactttctaaaagtcccggcaaccgccttacccgtttgcttcacggcctaccgatggttggtgggacttcttgaaagtaaaatatgaattccaacgatagttttgttcaattattaaaatgctaatgacaataaagattaagcgacggatgggtcatagaggagtatattggcagcatttgacgggatttctaaagattctatttggtgtattactaacagtttttatatgtcgaatcaaccgccaccactctactcttttataggcttgttatttaatttatctcaccgtgtgttttagatggtctcttttttaataatctttatttttatcaccagttttagttatttataaattgtattctattttaaatcttttttctttttctttttctaatttcagaattttttttaaaaaatatttaataccgtatagtgttcttttaatatttttatttttcatttttgaattttagttgtttcaaaattgtattcctacttgaactctcttttaatttttctaattttggatattattttattttttattctgaattttaattaatctcagatggggttcttatatggattcttctttaaatattgcttttttttaattctgaattttagttgattttaaattgtattcctacttgaactcttcttttattttttctatttttggattttatttttatttttatttcgaatattaactaatctcgtattgggttattatatggactcttttatcaatattccttatttttaatttctaatttcagttatttttaaattatattcctacttggactctcgttttatttcctaatttcgtattttattttatttttatttcgaatttcgattaatctcgtattgggtttttatatggacacttctttcaatattgctttattttaattccgaatttcagctatttttgaattgaatttctacttggactcttcttttctttttctctgattaatgtgggaatttatagccctacagcgaacgtagtgccttagcatcattatattttctctcatataataacatatatgttttctcaatgtattattcaaatatattaaaatgacaatataattttaaatttctaaattgtatttctatatggactctgtttttatttttctccgattaatatgagaatttcgcgcaattacgcggctagcacccaaacaaaatcatatatttttttagtatgattttacttaaaatttattaaatagctatctagctatctcattgtcttaagattttgaaagaccaaaccttatcatcctcgtgtttctaattatatagttttcaaaagtcacaccagttgctaccccttatgtcatctccttttttatttgcttgctcaatctatcactatttctattcattcttcttggaacctttaaatttggattttatagtttttagagtttattgtcatgttgggtttcatttttataatttctagatgtcccgtcaaacgttgccattatactcctctacggcccgtccattgtctcttctctttgttgtcattgagattttaaaaatcgaacataattatcgtttgggttcattttttactttctagaagtcccgccaaaccatcagcggctttgccattgtactcctctacagctcgcccgctgtctcccttctttattgttattgagattttaaaatcgaacatgattatcatttgcttttttttactttttagaagtttcaaatctttaaaaattggacttgcagtttaattttttataatttttagaagtcccatcaaacgatgccactatgcccctctacagcccgtctgccgccaaatctttattgtcattgtgattctaaaaatcgaacataactatcgttggaattcatttcttattttctagaagtcccgtcaaccgtcggcggctctgcaattatactcttatacaccccgcccgctgcttctactttttattgtcattgagattttaaaaattgaatatgattatcaatggggtttttttttactttctagaagtcccggcaaccgctttccacgtttgcttcacggcctgcttgacgtccctccttttaatcgtcattaggattctattttggtgatttattaacaatttttatatctcgtatcaaccactaccactctactcctttatagctatgttacttaatttatctcgtcatgtgttttagatggtattttctttcaataatctttatttttatcacaaattttagttatttataaattgtattccaaattgaaatcttaattttctttttctaatttcagatttttttttaaaaaaaatagttaatatcgtattgtgttattataatgtttttattttttattttcaatttcagttgtttcaaaattgtatttctgtttgaactctcttttaatttttctagttttagatattattttatttttattctaaattttaattaatctcgtattgggttcttatatggattcttctttcaatattgcttatttttacttccgaatttcagctaattttatattgtattcctacttgaactcttatttttttattttcttttgccaattttggatttatttatttttattctgaattttaattaatctcgtattgggttcttatatggactattcttttaatattccttatttttaatttcgaatttcagctatttttaaattgtattcctacttggactctcatttccttttctaattttggattttaatttatttttatttcaatttttgattaatcttgtattgggttcttatatgaaaatttatttcaatattccttatttttaattccgaatttcagttatttttaaattgtatttctacttggactctcatttccttttttaattttggatttttattttattgttatttcgaattttgattaatctcgtattgggttcttatatggaaacttctttcaatattgcttatttttaattccgaatttcagctatttttaaattgtacttctacttggactcttctttttcttttttttttcttttttttccgattaatgtgggaatttctaaccctcacagcgaacgtggtgtctcctttcaaagctgttttaataatataatagatagatagatatggacgctcagctgttcagtttgcctggacaatgccttatgcttttctattttctgtttaaaacaggtttgaacaaaattaaaaagaaaaaagttgatctctcccccacgcaaccacatcatatggtccataatgtttatatcattggctaatttttagtctaacagcagctttcaaaccgcattcttttttatttgactatgttgtactactttatccaagcctcagctgatgaagaggttcagagagatatttaattatttacactctttaattattccatatcttataaacaacgagtggtaaatagttaaacatgatatcttaaaagtagtaaatagttaaatgtttaggaattaaaagagagaaaccggtttacgggccgtcataccattaccagcagaaaacgctcgttaagattcacgggaaatgcgtggctttacctgacgcgtgcgtggcttccgtgcatgccttattagctccaaagaccaaaacttcagtacaagaaacgccaatctaggctagctgttagttgcctgtttaagggagatgagcaatgagttggcttgaaagaatcaacgagatcgatccgtcaagccactcgagcttctcaagcaacctaaactaacacctccgtctcactcctccaggcacgctagccacgatgcagttaggcatgggctagctatagctaatagctaagctcgatcgatctcttcttctcctcctcctcctatccactgtccaaaagacggtgatcgatctgtctccgactgccgccgccgatgtcgtcgtcgtcgtgcgcggcgggcgccgaggccaccgggctggtggccatggactgcctggtggtgtgctgctgctgcccgtgcctggtgctgcagatcaccgtgttcctcttcgtcaggctgcccaagaaggtggttgtcaagtccaagaggatcatcctccggagatggcacgggagaagatcatcatcatcggcggcggcggcggcggccaagagaggctgcagcacggtcgacccggctgcaggcgtgaagaaacagctggaggagctatttgacgacgacgatctattccaaggcgcattcggcggcgggatcaacggaggcggcggcgacgacgaggaggggtggtggaaagagaggtgcttcgccgtcgacgacgacgacggcggcgtgtgggaggcgctgatcgagcaagaggggctcttctggttcgggagcttctggggccggacgacggagcaggtggatcgtccggatcagtttggagacgacgaacatgcccacccagccttgaggtttcctctcgttctcgagagagtttgtgactaaattagctagagtacttaatttatcaatgcaagcttaattagggacagtcgcaacataattcaggcgttgagctcggtttctggctgatgattgctcattgagttcttaatcaattacatcctgttccggccatttccatttgcatcgctcttcagtggacaactaacaaatcacaaatgtacatgtcacaatattaacttcagagtcgagaagggacaatgaataaaaaacacacggcattaagtctgtaacacagacgctgacggagccattttctctgctggcctgcatgcatgctcaccctgcacctgcagcgttcacttggtctgtatattttcagaggacttttgatctncagacgggaggtgttttacaacttcgcgcacacttaacanatcacaaatgtacatatcacgatattacccatatcatatatgacatgtatggataaacatatcacttcacagacataatacatagaatgtaaagttcaatctacacaatactccaaaatacacaaatttggctatgaacaataatgttgattgaatctatttatgttcttttttggctgtgtggattgaatctgtatgtttacggtgttcacattctaaaaaaaagagtaaaaaatcaattgtggtgaatgacatgtgtagaattaaagcattggtacaggtaccaaggataaaaatatgattttgctagtagagaaaaaaaagaacataacggtccctaaatttaaatcggtataccgcgtaggtactagttaaagtcgttgtctggtattggcgtacatgttcttatttgcgtcatttcccctagatatacgtcacgttctctaagattctcattcacatggtttcctatatatttttgttttattccaaataacacgttactagtgtaaaagttctcgtttgtatggttttctttatatttgtgttttgttcccaagaacgcgtcaaaactcctctttttaattattcgtgtcacttagatcttgccatagcttctaccatgtctccttgcgggtgcacctgtccaaaatgtagaagaaaaacatagaaggatatctcattccagtcccttatacaacaaaatttatgaactatatgtaaataactaatcaactacataaaataaatcttatttgataagattcgcttagccattaaccgttcgatctcgtcccatgttgaatcctcaaccatgtagtgcttttccctttgtttcattccagtgaaccactttcaaccctataacaagaacaaacggcgaaaagatagaagaaataagacaacctatttttccccataagatctattcaatgcccaaattaaacgcatgatttacattttttccaccaaatgctaccgagcaatgcaaccaggtattcgattcactcaaaatgcccatattttatatagttaattactcaactaccatgatttttattctatatcttaccacttttttgatccatggtccatactgttttacctctcaatacctctaagtagctcgcaggtatcataaaagctcttgttgtataaattttttattttgtataaccttttgataaaagctctcgttgtatcaatggtatcacggtttttattttgtacaaaccttttgattgatactcctccgagaagcaaacgagtacgcatgcacttggagttatagaagcccattccccaaatccagtcaccgatccgttaggttccgtgttagctagctcccagagcgtgccggcgacatatgtatcgctgccgaccgccgtgcacacag

SEQ ID NO: 67541 - DNA, 15739 bp, Oryza sativa
agagcaagtagggcaccagtaccacactaccactgaggaatacaccaacgcatacggctaaaacacatgcaagtacttccccgagaaaacaacactgatccagtacgtttgtcttacagagcaacagtgtcacaacaacaaaagatgcgtgtgccaaatgtacgaggctaccttatcggcagcgacgtatgcttgaaaagtataagctctcccatttgcagccgatgcaactccatcacgatatgatctacaggtatctttcattgaaacaaggagggaaaatgtatgtacaattgcgtgctggcaaagctgaaagacgataaatttccagtgcagcgtctgcacgctgcagtagaaaactgaaaaaaagggggggggggggggggaggaacagggaaatccattttacaaggggaaaaaccttctcttcttgaagtaccagatgaagcagcagaatatgactaagccgcatacgcctgtaatgacaagcgtccattcgaacgcatgtggtacattaaacaagtccacctcaaagttcatgccaaaaactcccgagacaactccgaagatggccaccacgaatgtagccgtggtcagcagcagttcaaattggatcagttggtttcggacgttgtcctgtaagaacaacatttgtgatgatcatgtgagcatattttcttgtccagatagagagtgaccaaacaggctaaaagaaatgaaaaacaactttcatttctcttacatactgaacctaatagcagttgcacactgctaatatcagcaatatgaaagtctgtgaaatcatatctctagccgagctactaaaccttgcagaaatatatgatagacatgatatctggggtaaatacatggtggaaacccatatctgtaatgatgttagtctaagataggaccttcggtttattcttaccaacaggccctttgtgcaaaagaaataccaccacagcagaatacgattgtgcatcctataataccaaccagaatattggtgaataaggggcatatgcaaacatgcatgttgtacagaaactgaccactggctgtcctctgtaatagggaaaaaatctggcctacagacatttgaagttatagtgaacagatgtagtgatacagaagatctttttgttgacattgaaaataagctaaccacatgctccaacagcctgtcaactgttgtaatcttctgacatctgacccaacttacaatctgtctactgtctcaccccagtcccaactttaagttaatctcagttagcatgttaatagattttcattagcttaaatggaactaatgttattgtgagcggattatactttatatttactaacttagtcttactgtattatcatgcatcctccaaaatgctagggagtaatcagcagtaacgttgtccaatattttttctttagtacaatctatcattcccatttggagacacctttttagataatatttggagacacttgtgaatgtatcttagtttgtcttgtgcctttttctagtcaactgtaacaactaaatgacgggttaaaagaagctatatatatgtcaaagtaaacatagtatgatggtcagataattgtactcctgattccaacaattatgcatttgccatatcagtttcaagaatacacaaggcaagaggcatacggtttactttgagtatagagaaattaaatagcagtttcagatgagaagcaagcactcgcagtattggataagaaacaagccaattctgttgtgagattggaaattgatctgctaccaaattaactatcaagtatgaagaagatatttggggactataccagttgtatgttgatgaaatcctctgtatcatcaatatactccttcagctgttggaatatatatatatatatatatatatatatatatatataaaacataaaatttattagcccatgtagttgtaaaaaataaacagaagggcataaaaagcgaggcttcgtaccgaagttaacttgctgagggtgtaatcaatgaccacgaaataagcctctaacaacatttcaagttcttctatgctgtactgactactgtctgcactcttgaagctgtcatgcctacttctggcaaaactcaattccttctcaagccttcgagaagcagggggtgaggaaactggcgaaactggagcagagaaagatgaaccaaatccactattgcccatcccctgaaacgcctgctcctctagcaatgatgcttccatcctcctcttcttctctgtgaggtacatttcagccatatcaccatcgtcgtccatcagctgctctatctcatctctgaccttaatgggggaaatagaccaattattgaaaaccaatttaatgtttgccaaaaacaaaactacattgacacagtccatttaccttttggacccttctagtcaatgcaaccagcttactctttaggcgccgcacacgttccaagttaagggtactgattttcgttgtcaattcatccagtaaaggataagcgtcagcctccaattcgacagcctgacaaatatgcaaatgtttttggttctccagttagataccgtatcattatgcacaaaagaacactattaaaagagcgtagcacaagacgatcactgcaggatttgccaattgatcagcaaatctgtgatgcattacttcattttgttcacattcaggttataggcaatcactcttgaaggcaaaggaacaactaagtatgagatcctgaaaaattagtagttgctacattcctgaacttttatcattggggtcagacactaccgtttagttgtatgcaacaatgtaagatcatatgaatacttagtatcgacataatgaacgttgtggacagtgatcttgcccactgcctgattcacatgtcaccttcctaccgctgtttaaacagagaatagctaaaataaaagctattgtttacatcatacagtgtcctggtaagtaaaaaaagatatcgtttagtggaatctactggtctaatagacattgcagatgcaaatgcttcactttatattaaatcataattgctagagcagtgcaattgttaatgaagtagtagtagcagacgccacgcaagtcaatacttctcaattgttaatgaaatcaataattcgcaagcaaaggtttccagataatacgcagtggcacctgtgcgtcgaggaacgagcaggcagcttcgagcgcgacctccagggcgatgaactcgaacggcagatcgtaggcgcggtccacgaggcggcgctgcagctcagagacgtacctacgcacggactactccgtctcagctactcctaaccccacgtcggggtcgcgcaggatgagcgcctcgtcggcggtgatgatgcaccgtatccgctcgaggttgcagacgacggcgcgctcgcgcccgaggatcgcggaggggtagacgaagagcgggtcgaggaggcggaggtcgcgcgcgggcaggtcgagccgccgcatgagcgccggcttggcgacctccaccgcctcagacgcccccgtcgccgcgtccacgcgcacccacgaccgccgcccgccgccgcgctttttcagcccgtggacgtcgatggccacgccgcccccgcgccgccccccgggggcgcggcgcggcggtggggcccattggccgccgccgccgccgcggcgcggggcggcaggaggagccgctccttgggatcgtggtccatggccgtcgaggtctgtggtggggcccggctgtcagcgtcggaaaggcggcgtgtaaagtgaggtgaggtgagtgcgcgtgcgaggaaaagggatctccgcgaacaatgccacgctgggaagtagcgtggtgcgtgggggtgacgtggcgaaccggatcggggtgaatcattgtgggatggattatttttttagtttacacctttttgaaagtttgtttacgaatagatccctaaaaaatattctagaatggatcttttcgcagctccaacttcattggcgctagtgttgttagcaaaaagaacctatttgaaaatattttataattaaaaataagtctttaaacacataagttctcagcagcaagccatccctttatgtaaatgatttagcttccacgagaaaattaaggggacactatcaatgtctgataccgtcatgttggacaacaatatcattaacgttgggaccgtggaaaaggtctattctcgaaataatttttttaatctatttataaaataagttttcagaagaaaagaaagggtgaacaatccagccggggagggcctagtggcgatttggggagttcgctgccgttggtaggccgaggcttcaggcccatcaagagagtattgggccacgagagaacttactaatggaaaaagtacaccgaaggtcccacaatttgtcatcgggatattaaaaacatcctcaaaccacaaacccagatatgcggggtcccttaaatatacaaaaccggtcacccgagatccttcagcggctttgaccccggttttggtctacggctgagttagcatgggacccacatgccagcgtgccacgccaacttttccctttcttttttttttctcttctttttttagttctctttgccgtgacggagtagcaacggacggcggcgagcggggctaagcggcggccggcggaggcagcgtgcaagcgcacggcgaccagcgaagcggcggtggtggcaggaggacgcgcgcacggcgccggcggatggggagcggcagcgtcctccatgtcgcgtgggcgagcggaccggcgacggcggcgagcgggagacggagccccgaaggcgcctcgccgccggtgagcctagccagccccagcacgtcctcgatgtcctccatctccatctccagctgcggtggcgcgtccaggccagttgtgggctggtggctagtagggttttttcgcttgcaactcctgcggctcgaacatcgcgcctactggagaagctagctcgaacatggcgcgccggagcgacggcatcagctcgccggctcgcaagccgtcgttgccacggtcgcgcatgtcgcgtgcacgctaatttgccttgctgctgctgctactagggcggcggcgagcggtgccaagcaagttggcatctccgtcgcgccggtgccgaaccgctggtggaaggcctcaacgcggcgctcgtcctcggcatacgaagacgagggcgaggacgccttcgcacgctgcggtccgccggccaccgcccgggcgtttgctccctacccgtcggccggcatgcgactgcgagagaagagtgtgagagagagagaggggggagaaagggagagaagaggggggaaaggagttacgtggcacgatgacatgtgggtcccacgcgccacgtaggccaatactgggttaaaaccaccaaaaaaaaaaaaaaagatctcgggtggccggttttgtatagttaaggcaccccgtatatttggttttgtggttcgaggatgcttttgtatcccgatgacaagttgagggacctttggtgtacttttttcccttactaatccatcatgagatgatgggccgacgcagcctctcgccgcggtggctccggcccagcccgcctgaaccctagaggggagcagctcagctcgcgtccgtcttataagtcgccgccccgcgaggccgctagggttttctcctcagccgtcgtctccctcctcgcttcgcgtccgccgccgccgtcccggagaggtaaggtaagcgtcccccgccgcaactaccaccacctccgcccccgccgtcctcgtgctcgtgttcgtcttagtcaagcgcatttctgtgctctgtagccgcgcgggatggagctcgcgtctctcccttaatctgagggcgaggctggatccgctacttgcgcgcgcttttcgtcgatttcttgtagtggatttcaggtcgttgctcatccagtagttggtgcttttcttctggagattcaatttaggatggcgtgttacacagtctagtacggtgaatctttagaactgtgggtgatgtttagggatgctggcgatattagtgtgctcgttatggttgatttgaacttgatgtagttgtttgttgactattaaggtggttttttttttgtgtgagttctgaatctgttgtcttggttagcttttggtggttgattggtttcacatcagaaattaccctgtttggattataatacaggatacattttgattaccacataggatgtatcgttgctgttagcctgttactagtactcttatacttactgaaatggtagggccgaacttttgcctgattgcttatttagatttacttggctaatgtgaaatgtgtgagcaagataccttttcctcctgaagtgtataacgactctactgtgaagcagttctatgcttagttaggtggctttctctttctatattagtaatgtattatgaaatagctgaattcgcaatggtgtattgtttagtttttctgtttcatacttctgatatcactgttctctttgtgtgcagttcaagaggcagccctgtgaagctccaatggctcctaaaggtacacagatgatattgctggatcatgtttacatgttcttttgatttcagaccatgtgcaaattgcttcatattggttgtttttaactatttctagttttgtacatcatattattatgtagtctcgcttgcactatataaggtcttagtactgaataagttcttttatgcatatttgtttaaaataagtattgaattgctaagcattgatgaatatggtccattggaaatgagtgtattcctgtagtcgggttgtataattagtctatgaatccatttctgcctggcttttttaacctcagcttggtgcttaattaagatgcatgaactgattgttttattttgtgtctagctgctcctgccaagaagggtgatgccaaggcccaagccttgaaggcagccaaggctgttaagtctgggacagccaagaagacgaccaagaagatccgcacatccgtgacatttcaccgccccaagaccttgaagaagtctagggaccccaagtacccaagagtcagtacccctgggaggaacaagcttgatcagtaccagatccttaagtatccccttaccactgaatccgcaatgaagaagatcgaagacaacaacactctggtcttcattgttgaccttaaggctgacaagaagaagatcaaggctgctgtcaagaagatgtacgacatccaggcaaagaaagtgaacactctgatcaggttagcactttccttcatacttcattttatcgcttgatttgctaggtagtgtagttaactgaccctacttgtcttccaggcctgatgggaagaagaaggcttacgtgaagctgacaccagactacgatgctctcgacgtggccaacaagattggcatcatctaagttagggtgctgcagtagtcttttgtgtcctggtctctatgtgattggagttttgtagctattacttagcgaatgcctcagtggctaagttatcactattttgctgcacacttccatgaatttgatataatgcaagtgacttatcgtgagctattatatgctttgcagttgatcacttgattgtaccgttgattgctttacgagccagctagtattttctttgcatgcccaaaattttgctttactatcccagtttttcaagttagtactataatgatctgatcaagcattcttacattatgatctggtaccttagcttggtttccatgttgctgtttgtgttaagagatcaattgttgacctcactatgtaactgacatgattcttgatttgttggtgaagctagaactacatctgtcaaggctttataatacagccacctgaaattacttgcacgtttgcgtggcggggccacaacgttgagattcgaaatggattgaggtgtcacggcagaaatgggagatgctactcctatctttcctttggcgttcggttcggccacacaacgccgacgtcctcgccggagtggccgcaccactcaccctaagccgccgcgcgctgagcggggaggacacgaatgaaacgcgatccgattcagagctagtctgttaaaccaagtagccattgatgagaaaatcgaaaatttctccttgccatgaactgaacagatcgttcagagtctaatttgcaaaattccggaccgctacccttgacagcggcatgctctgtaggggtcaattatgaatactttccccatcttttcagtcttccagtttgttcccttctctcccctgccccaactcaggacggccgcggagctccggcgatcccgcggcggcgaccggggatacagtcatacaggtagtaacaagtaacagaaacgagtcctcgccgacgatcctgaggagggccgtcacccgccagttcgccactgccggcaatacgagtcctggccctctctgcacgcagcggatagaacggagacaatagccggtcacgccactagttgcagcaacaatcaatctcctccaaaacaatctcctgatgacagagctagcagcactcggttcagaggatcccagaaatccaggttgcttccacaaggaccacaactaacatcatgcatggccgagattgaaacacgaaccaaaatctccctgctattctgaatgcagagcaactgagaatgcctacttgcacagcacagtgtattcaaagtgaacaaaatagcatggcatgcgttcatgtaggcttcatcagggaattcagatcaaagcatgaagagagatcataaaaagcagaagagatcataaaaggcagaatgaactactagtctgtaaaggcagcttggcattttaccaaaagagtaccactagtcaattaaagcattttcttccacgagactaaacaggatcagaaaggaatgtgcaacgaattcaagcgacccctcctccaggccaaatctccgtcgtcaatgcaccaagtacgacaagactagtcatcaatggaaagcaatcctacgaaggagtaaatccaaggttcacccccatctccgcatgagaaggatcgagatcaaagcgatatgcttttgctgtggcggctggggacggtgccggtactggtgctggaagtagccgccctcgcccccctgttgccctctgggtgcaggaaccgaaccagtatgacgctcatgttgtccgtcgatggtgggtctcgtgtaatggcctcctgaagaaggctctcgcagattaccgacagctccaccccctgtgttggtcacatcatacatatatgtcaaggcaaaaggaataacaacatataactgtaaatggacaaggtgcaaaacatggtgcacacgcttccatttttagactatacaaacggcaatccgacagaaaattatttaactaggccaggcaccatcccatttagaggatagtctgtgctaaatgtcagagctacattcagggcaagatatgctggacaaaattataattctcagtatgaagacatttctacaggcataatctgcacacggataaattttcctcatctggtagcaaggttactgttacagtgtatcactggagagggggcggggaatgtcactcacattgtttaagtgaaggcgtacaaaatcaaccacagcctggtttgccaagacatccctacaaaaccaaaaaaaatatgtaaatatagagcaaacagctgcaagttacattaattgtgtcaaagagtaatggtcaggcagggtgaaattcctatcaccactccatcaggtttcataaataatttcctcatccaggaacttcaagtttagtccttatgatataaattagatatattcgatggtcatttccatcgaactgaacaggtgaaactgaaattcatgccaccaagttaatagtcatctggacacaataaagcatccgaacccatatatagggaggtgcagacatttgacctctccaatgctatcatcacactaaactaacgaaaggaattagacccaccggttcaacaactgtacaaaatgactttatgtacatggtggtaaagtagcctagtcagtaaatcaaactgagctgaacaaaatctgcaaattttgtcggtaaatattttgaacaaacaaataagcgtacgagagagaattgtcatttggagttcctatattctgcaagaaatcatgaacatgggagaaaaatataagaactgtttctgatacttttagctgaggacttaccagactccatcacatgctataacaagaaactcggtatcatcagttaattggtcctgccagagacaaaaggggatcattttgcatcagctcatatccagtgggacaaacttaacttcaataacacaacgtagttatccttacagctcgaatttcaggagaacaagtcagcaattgttgttcaggacgcaactttttgttgttcttgtaagataaatcccctgtataaagaagaagaataccagttacaacacattaaattgtttgtgtatgacctcacaccgccaacaaacatataagctataccgattgctcttgatactgcaattccattattaacacggtgggaacccctagaaaaagatacggaacctcctgcagctactattctctgagtttcctccggaaaatttggtttgtgatcattggataaagcgattgccttcgaatacaacagaaataaacagaatagttaggtgacattagagtgcatcatccattatgaaaaaggaaataccagctaggcatttgaaaacaaaagtagtcactgcacctgaccattccttgagattacacaacgagcatcaccagcatttccaacaacgatctgcgtatttctaatgagaaccacacatgctgtacatccttctgctaatggtccacaatagacaggtccctggaaaacaaaaaccaacttgaagtaaataacaaaaatataaaaaccttagattctcgatctacagaacaattgagatattaccagcacacaaggagcacatctgagccaagaccgcccagctgttctccaatactcgttgccactaccatactcagttaattccttgcttgccgcctgatttctcaacatctcatccattctgcaacaattaaggaggaaaaaggattacatattttatatttggatgcacaacaggtgcaataatgaacaccaatgtggcgatggttgtttcttacattcttataaaaagaactcatgtggcatcaaaatatagagttaatggattaactagctgtaaaaacaacctgaaaaaggattgcctcaatgcattagcaaggttactgctaaaatcttcttgctccaaaaccttattgtgcaagtgatttgcgcaataccttgctacagcagaacctgaaatagaagttaaataattgagatactcatcttacataaccattgcgcaacattactcttgagtgcaatgaaggttgcatgtacatggatattataaattttactagcctagtcctccccccacattatgtactatgtagggtgagcatacttttcaagaagtcaaactttgtaggttttgaccaacaattagtcaaagtgctttctcgtcatattggttttgtagctatgaacaatatattatgtgagacatcaaagttgaaagtgtagctttaaagaagaatgagcatgcctaaagaaaatatgccctatacaatgagaagggagtatcccctcaatcagtacaataaatttgaattttgctgtttatatggggatgagattgaagatcaaacctccatggccatcataaacaccaaagaatgacgtgttagtgagagcatcaagattttcaatagtcgcatgctggagaatagaagagtacacaaattagcctttagaatttcaccaaaattagttgcaagccaaccccccatttctcctacaaaagactggaaggttactcacggcatcttccatggtgctacggtatccttgcatagctgatgaagcataagcaagtacagtgttccctccagaatgagtagactttgttatgtcaggaacttggaggggacgttgaggttgagccatagcggagtctgcttcgctgaaacataataataggaataaaatatccttaaattccatactaagatcaggttacagatcacctaaatactagaagtaacggtgaaaatacgaataggaattattggggcagaatgaatagaaaggttaactagcttgaatttgaactgcattttgcagaaacaaaaaatagatacgcggtatgccactgtttgcaaagctcaaagcataactccaatattttggacacatattgttgatgagcgagcaagcaaagatgactcatgactctaaagcagtccatacaaagcaattttttggtagacacaggtcccacggatgcattccaggatttttttttcttctttttatatcttgcatttataatcttcaagatacacaaatgccatcattttgaacccaagatctagcatgaaagttagacctaaggtgaactatgatgatacagtaaaaaatacatagaaatttagcacagcataatagtaaattttatcagtgcattccaacagagggaagtgaaaacaaacacaactgcatcatacaaaaagtagacaagattacaatcatcttgcaagaataaaccagacaatctgaagaatgaagaaattcactcgaggaagtataatcaaaacatatggtaacgactaatttagggaattgattaaaaggaagtataatcatagattctcgaatctagcattcaagaacaagaataaacgagggggagaaaactctgcggtcccaaatttcagttctactatggtctaaggatggatagatgtttaccaaaaacgaactgccgaacaatgtaacactgcagtagtgcacaacccccggaaactggcaacaaaatggaaaagtgttaatacgcttaataaacagaacgcgtcgatcttgcaggaaaaaaaataactcggtcagcaagaagggaatcctaatgaagatttggcatataaaaagcagaaaattaaaccaaataacaggtaaaaagcacgggcagagacatccagtttccgctcgcccaacaagaccagcaatcgcagcagaagcccaacgataggaaaggatgttacaagcctacacgttctaaaaccctaaacccacatgaagaaatggcgatctcgaacattccggaacagaaaatagtttcaaatggaaacaagcgagagatcgagacgaagcagccaccctcgtgttgccattgcgcatctgtgtagcaccgtaaaaaaaaaagaaaaaaagaaagagatgcatccaggaacagatggtgggaagaacaaaaaatcaccgagttaattccgagaagactcggatgcagcctcctccaagaaaaccaccgatcacgactgaaacagcagccaaaaaagcaacgataatgaacacgcgaacaccagaagatctaagaagggtaaaaatctcacgaactttttggagactgaagggcctaaaaaagagagacgaagctcttgcaccgtacaccgaagggatctagtagacgagaacgacaagaggacgcttcgatccgacggtggaacgagcaaaacccgtgggagttgcaaacacggaggcgaacggagatcaccatggaatcgcggtgctcgtccgcctccggcaacttcagttcatcccatccacgaaaaccaccaccagtagcagcaaaaccaacggcaccaaaacccgagaagaaaaccatcgtcagcatcagcaacagaaaggtcagaagcacgcaagaacacacacgacgacaagaacggagcgggcttaccaaaccagtagcacgcacgcacgcaccccccaccgcacgatgacgagaaacaccagcagcgagcgagcgagcgatcgacgttaccaacaccagtagaacacagacgcgcggccgcaagagcgagcgagagagcgagatcaagcacagcgaaatcgaagcacgaagagaggcgatagatcgagaattcacaggttcccccgcgaggaagagaggcttctgatcggtggaagcaaacgaacaaaaattcagaggagagggagagatgggaggagagagagagagagagggagagggagagatctcctcacctttggccttagcgcaagcggtcgccttccatgcaactgagggggccttcacttatactacccgggcgtcaccaccaacaccaaccaccccccacgcctcgctcggctcggctcggctcggctcggaccagcaacggcttcggctccggctcggctcgcgcgcgtccggacaagccccccgcccgcgcctttcgcgaggggtttaacctgaccacattaggaagtttgttactggtaactacagaatccaatgcagcagtgcacgaacaaaatctcaagaaacaagaaggattcgtagggggttaagagcgaggtcaatatatagccaactactggctccaaaatatctatagccaatctaatagtctatttatacaatagttaactataaaaatatactgcaccattaatacacggtcccacctctcatacacacataacatcttaaagtccgtgttgcagccggctacaaatctgtagctcgcttttttatctctcttcttttttcttctcgatatatggttacagccggcttatagcatgctattgtacatactcttagaaagaatatgtgcatattcggtggtaggcgcaattaatagctaaaccccctggttaattgctaaaccccctggttagtctttcggtggtaggcgcaattaatagcttgatgacgtaactaagcatagaaagaataggagcatattcagatgggctttgtcacgttggcttgatgcacgtacgcatatctaagttcactgtagcctgcactgcacaacctagccttctttttcactgtgctagctgtacctcattccccatccaaggttaattttctccgtattttttaatttatttctggaggaatactctagaagcacgagaaaatatctcgagtttgtttttttctaagattattatttttggtgttaaatagactttcagcattttcacatttgagttgaataaatgagcaattatggcgattgatctcacttgaatctactagtagcaataacactaggaaacgtctagcaagaaggggtggcacacgcaaatgtatctgcaaaaattcccatcgagaagccggcgtaatcaggcaacgaatttaaataatgttgaaattttcctctcgagttcatctgaaatgcgatttggggagttatgatgtgctcaccgatttcacacttgaagcagcgcacgagggccgcagcacacgggtgcgtcggaggagcgcggggtatcagggagagcctccgaggccgcggccgcgggaggccagcgcgcaacggcgccgcccacgggggcccagcaccggcaatccgcagggttgaccgttgaggcagcatcccacgtccgccgccccgtcggcggcgcaccggacgaggaacgtttgaaatcgcggagagcggggcgcggacggcatggcggcggcggtggcgatgagaagccactaggctacgcggggtaaggaaggaggggacggcgtgtcgcctgatcgtgtatcgagagggggagtggggggagaggcggtgagtgagggaggt

SEQ ID NO: 67542 - DNA, 42951 bp, Oryza sativa
gatgactgtcagtatggacttcatagagggactgcctaagtcaggcaaatatgacacaatcatggtagtcgtggacaaattttccaagtttgctaaatttatccctcttgcacacccttttactgcttatacagttgcttaggcatttatccagcaggtgtatgatgtctttgggatgcctcaggttatcatttctgtcagagacaggatttttactagtgctttctagcaggagctgttcaaactagcggatgtcaaacttaacatgagctcttcttaccatccacaaaccgatggacaaactgagcgcttaaccagtgtttggaaggtttcctcagatgcacagttcactttgctccatctaaatggtccagttggctgtcccaggctcaacactggtataacacctcctaccacaatgtgctgaataaatctccatatgaggtcttgtttgccagaaagcctacacattttggccttgtggatgtgggtgcaagtacagtgccggatgtgcagctttggctccaagagagagctcatatgaatgaacttttacatcaacaattactaagggctcaacagaggatgaaaagtcaggctgataagaagcgttctgagaggcaatttgctgttggagatcgagtttatctgaaattgcaaccatttgtacagatgtctgttgcccgaagatcttgtcagaaactgagctttcggtattttggaccgtatacagtgttggaaagggttggcgctgttgcttaccgcttggatttacctgctactagtcagatacatccggtggtgcatgtttccttactcaaggcggcaatcaaaccaggcacccaggtcagttctgatctccctctcaactattctgacgaacaatctaccattcagcctgaagcggttcttcgtcgaagtctgattaaacgtggcaagagtgttgttccctgtgggctgatcaagtggattggcatgcctgaggagctggctacttgggagaacctgcgccaactccggacacgttttcctgatgctactgcttggggtcaagcaggttcttaaggggaagggaattgttagactccaggagtcttttattgcttggcttcactattctatttgggatttgggcctgatggccttgtaaggtggctggtgcgtgagtgaaggcctagttgtgagctgtgtactagctggaacctttatatactttgccgaagcgctggtcgtaggcaacgaataagaaaatacaatatcaccaacctcctctccaagtcaattctccactctgttcttactcagttcctcttttcttcctcccgaattgctcgatccgtgcccagtttggcgtttcgccaagggagatctcactgattcgtgacatgctggcgccgaagaccttgtggactatggtgaacttgtggggttcgtcggccgggaagaagggcgcaaagatgcaatccttggtgcaccgccgccgcagcagcttgcacgacgcgcacggcgacccactgcacatcgtcccaatcctctctatctaatgttcacacacgtataaaacgcttatacgaatgacagtggcggtcagtgacgggccacgtggcggcggcggcggcaacgacaacgtgggagaaggagacgcgcctctgctgtggggatcggctccgacggcggattgctacctctccgcccgctgccgcgctgctccgcccctttggcttcgagcgccgtcgctccacccgccgccacccaatccgcccctttggcttcgcgcgtcgttgctccgccctgctggctttcgccagcctgcgccgtcgccccgccggctttgggcgcatcgccattccgcccgccgtcgccccacttcgccttcctacgccatcaccccactccacccgccgccaccctgccacccccgcttgcttcgcgtgcgtcgccgctccgcccgccgtcgccccgcttcgcctgcctgcgcgccatcagcccgctccgtcgttgctcgcctgctccgccgttcccctcatcgcccaacgctgcggggccgcttcgccgccggtggtgacacaacaccattcgtgaccggccgccgccctcgccttctctcgcgtcgcagccgccgcctcctcctttctcgcctcgccccggcggcctcctccccagcagcgccgctggcttgccagagaagagaagagaagagtgagagagagaggaggaggaagggagaggagaatgaagagggagggtgctgatgtggcatcttgacaatgtggggctgttaacaaccaaatttggtaacatctatgtcaggaaagaagattggatcaaagcaaagttggaggcggagatcgagttcggaaacagagcaggaatcggctgaagtccaaatcggctacgattaggatcagctgggtctgagtcgggttgagtaagccgatacagccgattccgacaatacgaatcgtacgcgacatcgggttcaagttaatgtatttcaagatgattgccacgcacgaatagagtcctgggaaggcaattgtatctattaattagaatattttatgtaaattccttatagataaatgtcggtgacatggggccgggggtatcgtgactagaggcttgggtagccgcggtcacccacatggcctgaccccctcggggggggggggtcgggcccgagggtgacgtggccacccctccctctgtctccccgaggggtcgggccgctcccgtttcggccccgagggctagggcgcccccgtttcggccccgagggctggggcgccccgaccccctgtggttttggcgccacgtgtgtgggttaggtgagcacagcggggctcacctaaccgcatttatagcgggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcgaaatgatgagagcttcctggctctcgtccctagccggagccggcgtgctaactcttggagttggtatgtcagtcccggtcagatccattccaggcttcagcgcaagcatggcaaggaagtcgctggccattgaatgaaggttgaaatgggcgtccaccgggaaagctggcgagcggggcaggaggcgtgtgctctgcttgtcagaggtcacttccggctgtagactagccctcattgtaaaaagcatgtttcctttcttaggcagctggaggcccatgtggtgacccctgaccagataaaaaggaggcccaggcctaggagagggagaggagggagaaaaaaacaggagaaaaagaggaagaggggttgggactctggcgaatgggggctagagcctgaactctctctcgctctccggctctctgtattccttcacgcacagatccaccagaacacaggagtagggtgttacgcttctcagcggcccaaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcaataaatataggcaaaagtctgccgcaaagacttgtggtatcttagagtttgatagagataatagtcgtgtccggtatgggcatatcttgtaattctcaggtataaatagaccccgagccttatgtaattaacaacacacgttcaatacaatcttggcgcatcgccacccttttgctttagttttgtttcgacgagttcttgctttcgggttgagctgcattggtttcgatcttcaacaagaggtaaaactcgttatgacggattatgtttttacgattagtgcttccatctttatgatactctaatcttatttatataattcgtcgagttatcatatatcttatataatctctagcaatatcgccacctaatctactatcggctaacatctgtacgcagagggcagctgattgggttagatcttgatgttgatctagattataagagatatctaccattctatgaaacttctagcggcttgattgtctagatatcgttattcttttcatacttaatgttgtatcagttgagtttgacctattgagtcgtgcttagaataccgatctatagcctgccttctagttgccgattagaatagcgtcagagtttcagccgatcttatctgatttacttatatttgttctatatgcttcattgacatgttaaatctgccctctatatcaagatattgttgtgtctaagtatattaggctcttgttcagtatattattcttactttaatatcctgatatagagtagtatcggagtattagccgatacatgctagatctatctgatcggctatgctataaacatatatagtcctgttattgatatatatttcgatctaagtgatttatactgtctcggcatgatgaccgatctatcccaatcacttgatttaagtatacatcgatataaggagtatatatcgtgaatatctacagccgatcgagtagatttagttcttctttacttattcatgactgtcgatcgatgcacagatgacatcggcttaaagataaatgatatgtcatcggcatctagccgatcggctatcatttatagatttaaccacggttcctttgcttatatttcttgttgattacaggatcaaatcaactggcacgctaacacatctgaaggcgagctttggatctgcactggagttaagcagatctcctaggccacgtgttttctgtcaacagaggcccacgtgggtctcacgttgactcagccgccacgtgggacaaaaccggggtcaaaaccactgaaggacccaaagtgaatggtttttataaagggggctactatataacggaatcccgttttcgaacgggatgatcccgagtaggtatcaggtgtaatacctatcaggtatcagacgattctacacatgtttcaggtgatacttgcaaagtatcatgtgatacttatcaagtatcatacgatttctaccatgtatcgcgtgatactcgcaaggtatcatgtgatacctatcaggtatcagacgatttctaccacgtattgtgtaatactcgcgaggtatcatgtgatacctgtaagatatcagacgatttctaccacgtatcgcgtgatactcacgaggtatcatgtcagatatcgatgatttctactatgtatcacgcgatacttactaggtatcggatgatacctaccaggtattaggtgattcctactagatataactggacatctcgttggggagaggagcatctcgacgcgcggccggccacctgcagtcgtcccttgtagacggcgacgacggcggcggcagcgatggacgggcgcagcggcgacggcggcagcgggcgcggcggcgacgacggcggcggtgagggacgggcgcggcggcggcggcggcgagggacggcgacggcagcggtgggggcgggcgcggcggcgatggcggcggcgatgggggacgtggacggcggcggcgggggacgggcgcgcgttgatgccttcagccgcgtcgcatggatgagaatcgcatctgtggaggaggagtatcctgctaggggacgggataaccctagcattcccgtttataaattgagggatgccatatatctggttttgtggttggggaacgttttgtaactcgatgacaggttgagggaccttcggtgtactttttccacaactcgcagggcgacagggtctagcagatcaagcgaggccgaggcccaatcgagtttgacgagccggggacgcagaatccaactcctcccggtggaagtcaggttgggctaggctggctagccaagagggcttttataggctcctgggacgcatcgccctgcttcggcagtacggcgtcaacttctccgcggatttgttcgtctctcatctcttccgcacgccgctgctcctctgcctgttcgtccatctccgaattctcttctcctttcgactctctttgattctctctctgataaaaaggtcgttttttctcggtttgttttctcatctacgtggatgttgccgatcacaatcgctcgcggaacaccgctgtgtctagcttcatgcccctgcggtgttcgtcgaattgcccggctgggcatcgatgtgtgaccagcggttcaaatgatcaaattccagtgtcgttttcaggtattgcgctttcactctagaatcacgcgtttatctcagcaatttcttccgttggactgcataaaatctggatgtgatgctcggcagtatcgcgctgttcaggttggtggcatgtcgcgacattgacttgtgcctcgcggcgggttgatttcctctgctgcttggacgcatttaactacaaattgacatgaatagtactaaattagcatggcctttttaatggttgctggactcaactgctcattagctacgtccgttatgaaactttgagtttggtataatcgaacgtggctatttgctgtttcaatggtagttgatgataagatcctcttttttttttctaatatacgagacattaggtaatgcacaggacaaaagctaattggccatataagattgatttgactacttgcttattcgtgatacaattgtgacacaagctgcatacgcttgcagctcttatgtctgagcagtgttataataattaggtgactaggatgacaaagtagccaagcttatccttgttttttttgtatgattcaacccttcaacgatgttaatcttgttgaagcagtaaatcggcagctcttaagaagtgagtgcactgggctctaaaacacttttcaactgaaagactgaaatgcagaactttttaccatatttcctcctgataccactgtggcaaccaactaccatagactactgttttttttaataaaaaaaatgacaccagtcacatgctttttcttgatgccaagccatcaagataccgaaatcaaaagaagcaggtgatctagtcatttttgatcgatgtgcatcttcatttcattggtttgttgacctttcttgataaattattttcagaagagaccttttgcaaaaaaaacaagtgtttgtcatgtatgctgtgattttgcttgaactgagcgggattaattggatggaatcactgaaagtatgttattttttaagttttatggttagatgacaaaaatactatatcactgaaacacttgctcagagagaaatctaattaattacgcgtgtgggtacctcattattgaagaaatcagttgattaaatatgccatgctgactttattctcctgttcatatgaaatagtacagatttggttgcatcatttatggtgacttcctaaaggtatgactccacaggcttagttaaactgagacaattcagttgtgttcacaagggaaattgttgcctcttattattatataaatcaaccagttgcacattactagttggttctttgctcagtttaaatggactctgaataaataagtacaactgattcatgttctgtgaggattactgatcagtcttcctgatatttcagtaaaatgtactgaaagtgtacaagcaggactataccaggtattcggtagaactaattttaactcggtggagtgtacatctccaccagaccaccaccttggttcgagttgtttaatactttgatccaatttgtgtgctttttatctgttttgttaataagaaatgtagttttcctacatgttttaattttcatctttgttccaattatttacttaaaaaatcaataattcaaattattgctgatgttgcttaccaatctccccagtattaattaaaaggtgtgtcatgtaatcacaaaatgaaagggggcttgtctatttgtattcagaggtaaagataaacgacacaggtacacaaatttaaaccacagctgatgccattatgagctgtcgttgaattgttattgcatggttgacaggtttttaagttgctctcttgatgtccagcaggtgaagcaaggtaatttctcaagtgatgccttggacataaacatgtcaagctgtcaactcttcttagttgagaggcagtacctgacatttaactcaagaagaagagaagcaatttgtattagagaactacaaaacctgctgaatttctgggctatggtacattcatgttctcgtaccaaggtttgcagtcactttacttagaacttacctctactaaaatctgcttcacttactagaagaagtcgtttcgctgactggccgaaccgtgcttgtcggggtttgagtggcactattttcttagagatagtaacagctatgcatgaactcatacaattgacgcccccatgtgccgtagtgtattgatgcctgtgcagttggccttcccgtatgtgtgtactcgaactgttaagtggatagtaaaatgcacagcttcagggtaaataggtgtaaaaaatagtgtgtgacagacttgacaatgctagtgctattgtggttacccagcatacttgctagaaaagggtgtgtttagttcacgccaaaattagaagtttggttgaaattaaaacgatgtgatggaaacgttgaaagtttatgtgtgtaggaaagttttgatgtgatggaaaagttggaagtttgaagaaaaaatttgtaactaaacaaggccttaggaaaatggataatcattcgtcatgatcatatacgtcagatttgcaatttttattgtagcttgctgacgcaggatttgccggccagagcagtgaaaggcacctccaggtccggactccagatgagagctacctcgaaagataatgcctatccagcaggcttcgcagaagggtccatgcgaaggaatttccctaatccagacactttaggtaaccggtcacatcaaactcaaaaactacatttgggctgagtttagatccaaactttttcttcaaacgtccaacttatccatcacatcaaaactttcctacacgtacaaacttccaacttttccgtcacatcattccaatttcaaccaaactttcaattttgatatgaactaaacacacccttggtctagtcatatgatgttgtatatctatgtactaatacatgacagtgattgaactagtataagaagtctacaaggcacgtatgttctctgtacttgagcatgtagatgcgcatacatctgaaagaaaacacataataagggagattgagggaggggcttctaaattctcgaaggaacattccgtcgttatttatatatcattcaaatggttgaaaaaaaataaaaaaaattcaaccaaatagattaatatgagatagatcactccacaaatatgcaagttaaaattcaacttctacatgttgaaaaaaaaatagaaaacactatggctagttaacgtgttttcacagtcaaatttgtttttttcgttacaacttgtgaaagttaaatttgaccctacatatttgtggagtgatttatcacatattaatctatcttattaatttttttttaatttttttataatcatttagatgacatgtaaataataagggatatcgccttgagaatttataatagtttcccgggagattgatcagggtgtacattgcttgctcattgggcaaaaccctgtttgaaatttgagaaagagatagagagatgatcacaagggtttgactttgaccagggatagaggaaggcgcaacgctgggagcaaatgaaaattgaccattgaccggccgatcggtatgacgagagattagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttgggagaaacctgttagctgtgtttgagacatctgaattttgtgtactctgaaattgatatatgccttgacatttactattttatttcccattgacagattatacagtgacatgccgagcaacaaaccggcctactatttttcttctttccggatggagtcacgatcgctgttgcacggacattttgtctatgacgcggtaagagggagggaaaaaaaacagtacatattatggacgtttgcgttgcagccttgcagttgcgggttagttggatcagtaggaaggtcagagagtttctgcaagcagagaatcagatctggggaatggaatggcgcgagcaaggaagcaaccaaccgtccacttccatttataagtcgcggctcgcgagctagcaaaccccccttgctacatcaccaacccccacccttttctccatttcgtggccaactcctccgcagacctgcccttccgtatgggccttcccggccgtcgccaccgcggcgccatggccggccgcgccctcgtcgtgctgctgtggtgcgtgtccgcctccgtgttcctcccctccgcccgcgcgcagaccaccaccttcaccagcgccatcgacggcaagaaggcgaccaccttctccttccccacgttcgacaagtccctgatgcagctcggcgccaacctgaccttctccagcaacgccaccgtcagccagagcgcgctgcaagtcaccccggacagcagcaacaatcctctggactacctcgtcaaccaggccggccgcgtcttcttccccaccccgttcgtcctgtggtcctccaactcgtccaactccaccgccgatggcaagtacgtcgcctccttctccacggtgttcagggccaacctctaccgatcaaacacgaccatgaaaggagaggggctggcgtttgtcatcgcgtccaccaacgccatcaacccgccgccgggcagctacggcgagtatcttggtctcaccaacgcctccaccgacggcaacgccaccaacgggttcgcggccgtggagctggacagcgtgaagcagccctacgacatcgacgacaaccacgtcggcctcgacatcaacggcgtccgctccaacgcctccgcctccctcacccccttcggcatccagctcgcgcccagcaacaccaccactgacgacggcaactacttcgtctgggtcgactacaatggcacgtcgcggcacgtgtgggtgtacatggccaagaacgacaccagaaagccctcgaccccggtgctcgacgcgccgctggacctctccaccgtcctccgcggcaacaagggctacttcggcttctcggcgtccaccggcgagacgtacgagctcaactgcgtgctcatgtggaacatgaccgtcgagatgctccccgacgagggcgccaccaagaagaaggcggccctgcccggatggaagctcggggtggtcgtcggcgtgtcatcctgcgccgtcgccgtggtgctcgggctgttcgccgcgctgtacatccggaagaggaggaagaggatcggggacgacccgagctccgtgttcaacaccaccattgatttcaggagcatcccgggtgtgccaagggagttcgattacagggagctaaggagagggaccaacaacttcgacgagaagatgaagctcgggcagggcggctacggcgtggtctaccgcgccaccgtcgttggggagaacggccagaacatggaggtcgccgtgaagcagttctccggtgccaacaccaaggggcaggaggatttcctcgccgagctcagcatcatcaaccgcctccggcaccgtaatctcgtcaagctcgtcggtaagctctactacttttctgaacattcaaatcttagctcgatattgtttatgtttttgttcgatgcatgatagtatctttttgtgatttagtgattaagaatagctgagtaggacattgatgccgccctgatgaactgctaatttcgtgatgaaatatttcctcaagaacatcaccttaataaatgccaacccaaatcgccagattatcttttgatttgatttgatttgaaatattttcgcttttattgaaatggatgctccgataagtttagactttgtactttgtacttgttattagaccgcgtagatgttgtctactcgtgccaatttttaactgttacattctcagcaacaatttccttcgtacggttgcgtgaaaatgaaagcttccgagttccgagccgtcggaaatttcagtagccgtctgagaatagacaaaagtaagcaatttttcatacccacaatcacatgaaaacgatacaccacgacaacgattactgcctttatctcaagaaaagtagcagataaaattctaagataattacacacaacagatgtactagtagatatttttagcagctcagcacgccacatggcaacttggcacctaagttcaaaattaaacactgaccagttcccaccgattaccgagcggattggatcatggccaatacaggttggatcaaggcaaaggtttgacatcgttttgtcgcttgcattgttgttcggagaaaaatatttggtacggagtagttgtagaacggtctgtataccttgcaacactaattaagccttttttttaaggaaatcctattaatttttttaatcttgagaataaccacttgtctctgacttgaataattgggtcattgacaaaaccaacatgattcattctacgtttttcacgtttcaaaaataatacacaattctatctcttgggataagcattcaatattgataataagctagtggtgtaccaaaatacacaatcctaaaatattttggacgacctgtctgcaggttggtgccaccaaaatggcgtcttgttgctggtgtacgactacatgccgaacggtagcctggacacgcacctcttcggcgggccggagtcggaggtgctgaactggcagcagcgctacaacgtcgtcaccggcgtcgcgtcggcgctgaactacctccaccacgagtacgaccagatggtgatccaccgcgacatcaagccgtccaacgtcatgctcgactccgccttcaacgcgcggctcggcgacttcggcctcgcccgcgcgctcgagtccgacaagacgtcgtacaccgacatcatcggcgtcccggggacgctggggtacatcgcgccggagtgcttccacaccggccgcgcgacgcgggagtcggacgtgttcggcttcggcgccgtcatcctggagatcgtctgcggccgccgcatctcctgcagcaaccccgccgggtgcagccagctgctggaggccgtgtggaagctccacggcgcggcgggcggcggcggcggcggcggccgcatcctcgaggccgtcgaccagaggctcgccggcgagttcgacgaggccgaggccgagcggctcctgctgctgggcctcgcgtgcagccacccgaaccccggggagcggccgaggacgcagaccatcctgcagatcctgacgggcgccgccccgccgccgcacgttccgccgtcgaagccggcgttcatgtggcccgcgatgcccgtcgcgctcgatggcgacgacgacgacgagacgtcgcgcagcagcacggtgatgaactcgtcgtcgtcgtactacgtgtcctcgtcgggttggacccagaactaccaggtcagcaaggagcacgaggtggcggacagggacgtggcgacggtgtgaccgtagacgagtccacggcccacacgtgcggccgggacccgacccatcgcatcggatttggcacgttaccgtggagttggtgacaacgttgagaacaaagatgggacggatgaaaggtgtaaataatgtccatgaatatgctatcgagctttccatttgttttttttgctctgggagcttctttagtacagtggagtacaagactactggtgtttagatttgtttcattttcttcatactttgatgtcaagctgtaatgttctcaattggtgtaacaatggtggcttgatcacttccaaatagcggaatgtgtaagcattagtcatgataggcgattgctccttatactcgcgtgcaacatgttcctctttgcgttcgatccttcaagttagaggttagtttttacggcacgtaaaataacacgagtcattaacacatgaataactaactattaattattataaatttaggaaatggaattatttgatttttgtgaaaaaaagcacaaaatatatcgtttacagtttgaagatgagaaagctacacgttcaagtttctgaaaagaacggtgtcttagtgctggtcgacactggaccttaaacttcacattacactgtcacactgccttttctgtggcttgcaacgtgagagcaaactttagcaatacatggatcaaacctgtgggagcaaatctgacatctgtggcttgcaacgtgagagcttccatgcttatatattacttaccccagcaatacatggatcaaacctgaccattgtagaccatgcaaatgttaatggagccaattggttctctgtattttgttaggcaaatctgcaatcggagaagtcatgaacttccaaaggatgctaatgtgctttccgaagaagggcatgaaccttcggcataacccaatcggaagttgctggtcccagtctgtcttggtctctttgttcagtcatggtctctcttggactcttggagaagaagagttatgtacaatgtatgtggcaggtggcacgattggcaagtccgcaagtgggagaagtcgacaaccactggaccaattccttcccgcgaatacccccttgactgtacatcagtacatcaccaactccatctccctttacttatgcatcgccaactccactgctccatgttgcttctgcgccgtctccgccgtgccgccatggccgtgctcatgctagtgtggtgcgtgtccgttttcttgctcctcccatctgccaccgcgcaggccaccaccttcaccagcaacgtcgacggcaaggagttcaccacattctccttccccaagttcgacaagcccctgttgcagctccccgacaacctgaccttctcaggcaacgccaccatcgcccaggacgggttgcagctcaccccggacagcggcaacaggcccgagatattcctcgtcaaccaggccggccacgccttcttcaccgccccgttcgtcgtctgggaatccaagtcgtcgtcgtcgtcgtccaactccgccgccgctgccgccgatggaaagtacgtcgcctcgttctccaccgtgttcaaggttaacctgttccgctcgaacctgaacaagacggtcaagggcgaggggctcgcgttcgtcgtcgcgtcgagcaacgcccgcgggccgccggtcggtagccacggcgggttcctcggcctcaccaacgcctccaccgacggcaacgccaccaacgggttcgtggccgtggagctggacacagtgaagcagcgctacgacatcgacgacaaccacgtcggcctcgacgtcaacggcgtccgatccaccgccgcggcgccactcgccccactgggtatccagctcgcgcccaggaacaccaccgtcgacgacggcatctgctttgtctgggtcgactacaatggcacgtcgcggcggatgtcggtgtacatcgccaagaacgagagcaagccctccgccgccgtgctcaacgcgtcgctggacctctccaccatcctcctcggcaagacggcgtacttcggcttctcggcgtccaccggcgccgcgacgtaccagctcaactgcgtgcgcatgtggaacatgaccgtcgagaggctccacgacggcaccaccaccaccgccacgaagctagccggcacgtccggctggaagttggccgtcggcgtgttgtgcggcgtcgccgtggtgctcggggtggtcgccgcgctgtacatccggaagaggaggagacggagcggcggcgacccgagctcggcgttcaacgccgccattgatttcaggaagatcccaggtttgcccaaggagttcgactacatggagctgaggagagggacgaacaacttcgacgagaagatgaagctggggcagggcgggtacggcgtggtgtaccgcgccaccgtggtcggggaagatggccggagcacggacgtcgccgtgaagcagttctccggtgcaaacaccaaggggaaggaggatttcctcgccgagctcagaattatcaactgcctccgtcatcgcaatctcgtcaagatcgtcggtaagcgatcatttctcgttctggttaaccgaaaaggatacttagtttagattgaagttgtgattagagtattagattgggtacggtttgtctaataatttggagtaggaaataatattctgagatggcacacaagttggcacggcaaatagatgttttaagaagctcaccacgctatgtggcaacttgggccacttggcagctaaatttaaaattgaatcatcagtccatgacgtctttgcaagcagattgaatcataagatagatattggagtgctctggttgacaatatgataatgcaagatttgatcttttgcttgcattgtgttagaagaaatatagcgttcgttagttggaacttggaacagccatgcaaatgcacatctctctctatatatatatatagtttaattagctgccaattcaccataagaggagacattcatatcccaaaacaaacaccgtacgttcagtcttcatttttcaaatttcaaaatgatacgaaattctgtaagcaagttctaaacacattttggacgacatgcacgtctgcaggttggtgccgccaaaatggcaggctgttgctagtgtacgactacatgccgaacggcagcctggacaggcacatcttcggcgagccgggcgcggcggcgctggactggaagcagcgctacaacgtcgtcgccggcgtcgcgtcggcgctgaactacctccaccacgagtacgaccagatggtgatccaccgcgacatcaagccgtccaacatcatgctcgactccgccttcaacgcgcggctcggcgacttcggcctcgcccgcgcgctcgagtccgacaagacgtcgtacaccgacatggccggcgtcacggggacgctggggtacatcgcgccggagtgcttccacaccggccgcgcgacgcgggagtcggacgtgttcggcttcggcgccgtcgtcctggagatcgtctgcggccgccgcgtctcctgcagcgacctccccggctggctcagcctgctggagtgggtctggaagctccacggcgcggctggcggcggcggcatcctcgaggccgtcgaccagaggctcgccggcgagttcgacgaggtcgaggccgagcggctcctgctgctgggcctcgcgtgcagccacccgaaccccggggagcggccgaggacgcaggccatcctgcagatcctgacgggcgccgccccgccgccgcacgtgccgccgtcgaagccggcgttcatgtggcccgcgatgcccgtcgcgctcgatggcgacgacgacgacagcgagacgccgacgtcgcgcagcagcatgctgctgacctcgtcgtcgacggggtggaccaaaatcttccaggtgagcaaagagcatgacgtggcggagaaggacgtggccgcagagtgaacagccgggaagagtcagcggctcgcgtgcgggcgaggcctggtcaatcgagaccgtcgagctggtggaacactggacgacgtgcaggagtatgaccaaacaaaacggagtaaaaaaatgtgcgttgccatggaatggcggaggttgtttttgctctaacatttttcaacttgctgcgttaaatacaatctagtggtgtacggcggtgagtgtagtttatgcgagtagtagctgtatttgtcacgtcagaatttttttttcccatggtgcgcaagagggaggggaaaacacttgcttattgttccaagctttgcagccaccttagtactaccatactggagtattgcgagaaaggaaggtcttggagcacgttttcaaagatgctttcttattttaatggttcaaacatttcggttggggttatcgacttggattatatcaacaatactagtgtactggaaacgtggttgtgaatttatggtgctcttatcatccaaactagctgggtggtccgctcaattgcgcggctagcacctaaacaaaatcatatactttttagtatgatttaacttaaaatttattaaatagctatctcattgtcttaagactttgaaagaccaaaccttatcatcatcgtgtttctaattatatagtttttaaaagtcacaccagttgctaccccttatgtcatctcattatttatttgcttgctcgatctaccactatttctattcattcttcttggaacctttaaaaattggattttatagtttttagagtttattgtcacgttgggtttcatttttataatttctagatatcccgtcaaacgttgctattatactcctttacggcccgtccactgtctcttctctttattgttattgagattttaaaaataaaaaataattattgtttgggtttatttttactttctagaagtcctgccaaaccgttagcggctttgccattatactcatctatggctcgctcgctgccttccttctttattgtcattgagattttaaaatcgaacatgattatcattgggtttttttttactttttagaagttccgaacctttaaaaattttgtagttttattttttttataatttttagaagtcccatcatacgatgccactatgcccctctacagcccgtccaccgcctactctttattgtcattgtgattctaaaaatcgaacataactatcgttggaattcattttttattttctagaagtcccatcggcgacggctctgcaactatactcttatacaccctgtccactgcttctcctttttattatcattgagattttaaaaatcgaatatgattatcaatggggcctggtttttttttactttctagaagtctcggcaaccgccttattcgtttgcttcacggcatgcatgacgtccctccttttaatcgtcattaagattctatttgatgttttattaataatttttatatgtcgtatcaaccgccaccactctactcctttataggcatgttacttaatttatcttgtcatgtgttttagatggtattttctttcaataatctttatttttataataaattttagttatttataaattgtattcctaattgaaatcttttttttctaattttagatttcttttgctaatttttgatttatttattttgattctgaattttaattaatctcgtattgggttttatacggactcttcttttaatattccttatttttaaatccgaaattcagttatttttaaattgtattcccacttagactctcattttcttttctaattttggattttattttatttttatttctaattttgattaatctcgtattgggttcttatatggaaacttctttcaatattgcttatttgtaattccgaatttcagctatttttaaattgtatttctacttggactctcctttccttttctaattttggattttattttacttttattttgaattttgattaatctcgtattgggttcttatatggaaatttctttcaatattgcttatttttaattctgaattttaactatttttaaattgtatttctacttggactctcctttccttttctaattttggatttattgggttcctatatggacacttctttccatattgtttttggactctcctttccttttctaattttggattttattttatttttatttcgaattttgattaatgccgtattggcttcttatatggactcctctttccatattgcttatttctaatttcgaatttaagttatttttagattgtacttctatttggactctccttttcttttttttatttctctccgattaatgtgggaatttctagctgggtggcccgcgcaactgcgcggctagcttccattcaaaattatttttttacacacatttttctttaaaatttactaaatagtcatctcgttatcttacatattttgaaaatgaaccttatcatcatcattttatagtagtaattcttaaaagtaacactaatcggcaccccacactccttagcctcccctttattttcttatcatgtttatcacgacttctattcatcaccctttggaacctttaaaaacatgtctcgtcaggctttctttttcatagtttttagaagtcctatcaaacttaaccactatactcctttacggcatacccattgtactcctcttaattatcattgggattataaaaattaaacttgattatcattagtttcttttttttactttttagaagtcttatcaaccatcgcgacaatactccttcacagccaccctgtcgcccctcctcttaatcgtcattaggattctaaaaattgaatctaatcatcatttaggtgttgtttcatagtattagatgtcccatcaattgttatcatcctacccctttacggcttgcttgatatcccgttccgtatagtcattttccataatgtcccattctttatcgtcatttgccaccctttatcatagatagactttttttaatattctttattttctattttgtatatgtgctatttataaattatattattactcttattttcttttttcttattcctatttttatttttattttttattccaaattttaattaattttgtgctcctattttctacatggactttttaaattattttttattccaaattttaattgtctccctagttgaactaatatttttatttttataattactgaatttatttatttttatattgaattatacttaatctcgtgtttatgttcgagatggtcttttattttaatattatttattatttattctgaaatttagtttttttatagattttatttctacttgaactcttatttctccttttccattttcgaattgattgtattctttttcctaattttaattaatcttgtattgtattatacatggactatctttaattttaaactcttatattttctctgatcaatgtcaaaatttctagcttccacatacgaagggcctcatcttttcgtttatccttatacttatctgccaaaatttaaattttcaacctttatatatatatatatatataagttttattcacaaattacttttcgtttgcaaatatgccgcgaaacgatggctctggaaatttctgaattgtaatagctaggtggtcctcacattatgctgctagaagccatataaaattatctaacttttttacgcatgattttctttaagttttgttaatcgttgtcttaggatttgaaaaaatcgattatgttttccagccgtgtatgttgagcatcgaacagactccgtgcgtgtgctcaccacaactaacggttgatacatatatacatgcatgtggtttctagttgccaacttgagatttaagctgatcgtctgattttgataaatgcaaaccaagttggttttgcttttcccgttccagaattaatgccgattggtttttttaccataaatggttactttatcgtgactatcgccgagggcaacgatatgatgctagttagggttaacaacctgacacctataatgcctcgagttataggtgacgattgttagcttcaatgcctcgcgagcacgacctcgagtaggaaattcgctatagactgggtaatgcgagatggaaatctaaacctgctatgtcttaatgatgtaaatattttagtgtttcaataatattttgagtcaacgatttatttagggatacaaagggagtaaatgtttgtagttgtatatatacatgcaaggctataatttacatgcaatgagcaatccagatgatactgaatccaatataaatggtacccaggctacataaacatgtatgggtcaacagcttgctagtttgctccatcgcttgtttcatttgtaggtccactggtatgttatgacatgcatgagaatgcttatgtggacagcacatgtacggcagcatgttaatccggctgcaaacatatatgcaatccaactctgcttcggcttgttttatccgattcattctacagcaaaagtgtggggatatttgctgtgtatgattatttctctaactctttatccgtttgtagaaagacagtaatatttctatatattcatagctcaacctgaaccattataatctagacccactacgatctaacggtgtagatatttctttttttcttcgattaatgtgggaatttctagcctccacgatgaacgtgatgtcttcttttcgagctgtcttaataatataatatatagatccgtgaaggttgtcgcagtcccgttggctactgccagaaaagaattctcctgtaaagctgcatttgcatgttacttgtcatagaatttcttttttttccattttttttaagaataggctggagatttacctaagaatatattaaggccatctggatcccctggcttcaagaagcttgggcaagttgctatgtgccgctgtgtaagactgtaaggttattctccctgcagaacaatctgaaaaaaagacttgttcagaattctttgggtgctcaagtgcaaagttagggcctgttcactttgatgccaaaaaaaaaaccttaccaaattttggcattaccaaaattttgacaggatttcttatatagttaccaaaatttggcagcaaactaaatgtagccacttttttggcaactttactaaaatttgataaggttaaaaatgacatcaaagtgaacaggcccttatttttcggagccttataagggcccaattcaccatgatggcccaataaaactatcggtgctgtgcaccccaggcccgccatctctctgggctcctttcttgtcgcgaaatttgtattgggcccaaatcaccattatggctcaaatcaccattacggcccaattcatcttctcttcgcctgctgcccaaaactgtatgtaggccacccagtcgacagccatctgggcttctttacaggctaataattacagcccaacgccctcgccgtcgtcagaggccgaaaggccatcccgatgttcgccgtcgagtagatcacggcttccctatgtacttctatagtctctattcatcctcaacacaactacacaagcgacggcggcgcggtgtagtcgtgagttgtgacgcagccggtgcgccatgcgactttggttggcatcgtcgaagcattttggttggcatcgcgtcctcaggtgcgagtgtgtgacagttgttccgcagcgcgctcatgcccactactgtgaaacgtgaatgccctgcgcccctgcctgctgatcacctgccgcacagtgcccgcactccggtatttcgcgatcgcggtggtagcctgtgcaaaggcagcgagcagcagtactactactcactttgctatagcaaatatagcgcccagtcgtaataacactacactgtaaaaagtcttcctggctaaagaaaacagtaaaaaaattactccctccgttccataatataagggattttaagtttttacttacaacgtttaaccactcgtcttattcaatttttttttttgcaaatataaaaagcgaaaagttgtgcttaaagtgctgtagataataaagtaagtcacaaataaaataaataataatttcaaaaaatattgaataagacgagtggtcaaacgttgcaagcaaaaacttaaaatctcttgtattatagaacggagggagtatgtactagtaggccgtgtttagttccccaaattcctaacttttcatcacattacatcacatcaaaaactttactacacatataaactaccaattttttctccaaactaacaactttcttccagcctctcaactttttcagctctaaacatagccgtagtatcgatgatttgttccctttcctcgatcctgggctggctggacccgaccgctgataccgtaaatcgggacgaaacacgaggcgagctgaccaacgagtatggccatgctttcgctttgcagcacgcagagccaagagaaaggcgacccaccaacgggaggactggcccgcgccgcacacgcacacccaaaccccacatcgtgtcgcggagctcgccgtcacggtcacgtgtcgcgagacgccaaccgctgccagttaccgttggttcagctggccccgccgccccgtcgcgccccgcgcggccggcgatgtctcactacgcgcgccagcaacgttaccacctcccttcatgtgcgcctgcatgtacagtagagattgcgtggctcaaattatacagatgggccgaggcgtctcccggtcgtgtcgcgatccgccgcgcggcgcgcgcgcgcgtcgggctggttccacgtactactactgtactccctctatactcgtaaagaaagttattttggacagcgacacagtcttcaaagcataaatttaacttcttatttatataaaaatatttattgaaaagtggtatatgtatatttttataaaaatatttttcaagacaaatttttacattttcaaactcaacaacttgagttattcatgatttatattcctaaagtttaatttaaacattgttctaaacgattttcttacttagtattagggagtactccggtgtttatcatcggcacgcttgcgtcgctgcctggtacagtcggcgtttgtcgtgacagctaacgcctcgcgggttcgcgtggcgctcttcccagcttgaagacaaaggtttggctctcttcgctttcttcttctgtctttcgtggggtatcgacgcgcaaagccgcaaacggcgcaaatggtgtggttggtggtacgtacattcgcttcttgccccagcagattactccaccaggtgcgactatactactactgctgctacctcgtgatattacttttctatgccaaatatgcgttacctgtcttattccattgttggttttgatttgaatgactgtgccgcagattgcgtaatctgatgggcctgaacccttatgttactcgtgttacatgatagctctttcaccaaagaatccagccaattcatgctaaaaggtttgagtatggaggagtcggtgttgctggtgggttacggattatcaaaggaaccaacttggaaccttggactgaaaaacggggttatgcttgttcacgtgtgtgagttgatgatcgctgcgacattttatatagataagctttgtgattcagggtgctgtctgaaagcaaaatattcccgaatcagcaaggtaattaagggattgttctgaatctgtcacgggcaaacattggccctccctttccggcacattgaccttccatcaacggactgtgacattctagttgcgaaattagatttggaatgtgtttgctttcattggatgatacgtcttcgtcgacatggacgcataacccaccgtatttctcagacccgagttacgttcaagtttccctgtgaggctgttgtcagttgctgaaacaaccgttcttctgtgaagcgacgatggaaaaacatgttatcgtgccgatttaatccagtagtgagattaaaaacctttttcgatacttgcatcgatctgacttcgaagatgggtggtgttgtatggagacattcaagaacgcgaagcgatctcgttgccatcatcaaccggggcaaattcgattcggttacggcaagcagacgatacagcctgcccgcgcgaaagcagatgttagatcgaaatactgacagttcagatacaaatcgccaaggacgcacgtcgccagaaattacctcccccgagctcgaactgccatctcgggctctcagcatccaacagagagaaaagaaaaggcaaaaaaaaataaagaaaactgccgcctcgtaatcatagagtagtgttcctacctggaagtttaatcaccgttagtgctgatgcggttgggcacaaccacacggaaagcaagcatctataatagacttgtagagttctatagtgcagaattaagaatatacattggattagcatatgcatcgttagaaatgtggggtactaatacttccgaaaatcataaaggagaaagtcgaaagtattgaggggccctctgttggaaaggtgtgaccttgatggggacgatgaactgttggcgtgcacgatacaggtgtaaggctgcaagcagaggggagcgcggccggagagccagcgaggaaggccgggaaaattagaccgacgagatgacgatcttcttcagacggatagagagaaagagaaaggaatacgagaaccgcaatttcgctgacacgtcgaattctagaactgctcggccgctttgttggagcacgccgtattatttatcctggatcagaacagaacaaaagtgcagtgctgtgacgatcaacgagctgctggtgaagctctgcgctgacacgttgatgcagcggagcacggcctttggagctgcatggcatgcagtgcatgcattgcccagtggtgtctcggatgcgtcaccgatgcactgcccccataccatcatatctatcctaaacaacacaacaaatcttgggcaactttgcaacacggcctctgcctacgagatcggcgacgacgcgatcaccggccgccggtacgacgggctgaacgaacctggctggcatcctaatcttttcgcgttcccattccccggccgttttcttggtgtttgcattgcaccgccaggcgggcggggggccgcactacggttggtggggacgcgcattgcgggtacgtgatgcagtaaacgcggcaggagcgaccaccacggctaccggtggccataactcacaccaggaaaggagaaggcaacctgccttgactgttgctccgctgcctcgccgcgcggctcggcccggcccccatatcccgtttctgccatttcccatcacaattcacacccccacggcgaggagtccagaagcgtcccttctcctctcctctccacgccgtctagtctcgtctcgtctcgccgaccgacccatccatccatcgatcgatcgatcgctggattgagggttcagttcacgcgcgacaccagcagcctgcctcatcaccttccgctcccgtccccttccgcctctcgcatcatcgccttctacattctccgcgcccctcttgaggcgtgataccttggccttctctgcccgccgatctgcctcgccacgcggttcgtcgtgctgctgcggggcggcgtccggcggagagggggcgcgcggcggggtgtaggtagctatgaagaacggggcgaggaaagacgcgggcggcggcggcggcggagtgttcgtcccgtgcgtcgacatcaagtcgttcgtgctctcgctcgccttcctcacggtgttcgtcgcattgtggcagctccagccgtacggctcgttgctcaccgcggcgcgctccaccgcctctgtctcggcctcgccatgttccctcatcgccacgcccgccgccgccgccgcgagcgcaggcgtcatccggtcggagaactccaccgccgacacggccaagaccgcgccggccgccgttgctagcgcagtccccgcgcggttggctagggcggcgaggccggcgcgggtggaggaccccaacaagcgtgagctccggccgtacggcagcgcggcggcgctgttcgttcagatgggcgcgtaccgcggcgggccgcggacgttcgccatcgtgggattagcgtccaagcccacccatgtgttcagcaacccctacttcaaatgcgagtggctgcccaaccccaccgccggcaacccgtcgccgcgccccgtccgcaccaaggcgtacaagatgctcccggactgggggtacggccgcgtctacaccgtcgtcgtcgtcaactgcaccttcccatccaaccccaacgccgacaacgccggcggcaagctgctcgtccacgcctactactccaccacctcccgccgctacgagcgcttcgtggcgctcgaggaggccccgggctcgtacgacgagtcccgcttcagcccgccgttcccgtacgactacctctactgcggctcgtcgctgtacggcaacctcagcgccagccgcatgcgggagtgggtggcctaccacgcgcacttcttcgggccgaggtcgcacttcgtcttccacgacgccggcggcatcagcccggaggtgaaggcggtgctggatccgtgggtccgcgccggccggctcacggtgcaggacatccgggcgcaggcggagtacgacggctactactacaaccagttcttggtggtgaacgactgcctgcaccggtacaggcacgccgccaattggaccttcttcttcgacgtcgatgagtacatttacctgcccaatgggcagacgctcgaccaggtgctcggcaagctctcgggatactcgcagttcaccatcgagcagaatcccatgtccagcaagctctgcgtgcaggatccaagcaaggattactcaaggtttgtctttttgattcctcgcatgttctaattttggtcctcttcttgcatacctactcccattttatatcgaagaaattccatatctgctattttgtttttcagatttagggggtgcttgaatgtaggatatttgagtacttttgcgtgaattagagcaaatgctgtgaaaattttgcaattttttttgttatagccgttcagtatatcagttttaggctgcagggtgcattctgctgggttcggtagcatttttcttttgggtagtttgttgtctgccatggaatgtgcattgtgttgattaatctatcagacattctagacgaggttaagtaagtcagcggttacttatttgtgcaatttgttgatcagttgggcaatgagctgtagtataatatagtagtagtatttcaacttgcaagtccagactgcagacgttgattgactggtatgttcaagtgtgtaaccatgtcttgtattgtattctgatttctgactggtatgttccttcaagttaactttgcataggcttcggttagttcggtacaaaagatccaattttcttttaagagttggtttgaggtactccatctttattcattgggatgagtaggtgatggacataagtcatcgcaattcatcatctttgccaacataggctgtgtttagatccagggtgaaaagttttggcgtgtcatatcggatatacagacatatatatttgaagtattaaacgtagactaataacaaaacaaattacagattccgcctgtaaactgcgagatgaatttattaagcctaattaatccgtcattagcaaatgtttactgtagcaccacattgtcgaatcatggagcaattaggcttaaaagatctcgcaatttacacacaatctgtgtaattagttattttttttcgtttatatttaatactctatacatgtgtccaaatattcgatgtgagatggtgaaaaattttgccaggggatctaaacaggcccataattgtaggaaactgcaaactaattaaggtcactaaaggaacacaactaatgtctggccaggaaaaagggatgcaattaatgaaattaattgatgtctaaaaactctcaccatgctttgctgaataatactgtatagatttccatgtattacatgaaagtgaaactatctatgtgcaagaaacttctttacggaatattcagagcatcatctattattattatgtaacccctgctaacaaatttgacttcacaactactccctccgtttcacaatataagtcattctagcatttcccacattcatattgatgtctatatatatatatatatatatatatatatatatatatatatatatatatatatatatatatatatatatatatatatatataattttctatagatgctctttctatctgcattcttgatctttgggcaagtcattgcctgtacaagtgctgttgtgaatgttggcgcctgtaaaaggcccaatttttacacaacaaagggctcatgactgttggttcctgaaaaaaaagaccttttttaacaccaaaaggttgaatttttatgctctatcatgcttttatgtctgtttgcaaggaaacaattatagtaactgtttagattggtaggtttgacactgtttgatgctaaaacatattacgtgtgccgttcatatgcagggaatggggttttgagaagcttgtcttccgcaattcaattaccaaagttaggcgagatcgcaaatatgcgatccaggcccgaaacgcatactctgccggcgtacacatgtcacagaatgtctacgggaggacaacccataagacagaaagcctgatcagatactaccactatcacaattcgatcaatgtcatgggagagccttgtcgggaatttgtgccggtgccggtcaatggtagtaagttgatgttcgaggggatcccttacgtatacgatgataacatgaagcgtttggctgggcagatcaagcggtttgagaaggaagcaattggatctgctcatacataggcacatagcaactgaactactgaagactgccggtacataactacagtctacatatatacctgatgatattgtttaggatgcctggttgagagttgagacgggctcacgcttctgctgttgcaagccaccgtgtctggctggtaagcagagggaagagcttgcaagtgggttggtccaagtggtgtaaagttttggttctttttattgacatgccattctctacaggagcactgctgtttttgctccattttctcctttctcttttctccttacccccacatctgttattatagatctgtgtaaactgtaaacttatggccctgcctttttacagtagattctttgatagatctccctccggggttacatgcagtgtttgttgttttgtgtgtaaatctggattgcacattactcttctgtactatccattaggccatcagcaatgggtaccttcgacccgtcccctcacaaacggccgtttccctcccgtcctcttttcggcgtgagccgtctccccagctaggagcgcgtctactccttgggagacgcggctctatgcaaggagcgctcgcttttcgcggagagccggccctcgcccctgcgaggagacccgctgcgaactcccgtctcctcaccgctccccccaaatccccttcctaccctcgccccctcgcctctctcccacggcggcgcccactcgtcgatccgctccaccggccgccatcgaccggcgggcggggaggtccgcgacggcagggaggagctcggcggccttgaagaggaggagggcgagccagtcgtcggcgaggcggcgctgggcggaggtgccgggggcggcagagtcgagggcggagtcgatgtgggagaagagggtgtgggagatggcgatgtggatgaggaagaggagggagagcgggaggacgaaggtggcggcgatgcgggcgaagagagggcggtcggcgacgatgatgatgagcttcgtcggcgacggctggagggagagaggggagcgggaggagggcgaccggcgctgacctcgccggcgagccgccgccgtcgctgcccgaggccagatccggcaagcccaggccggatctggccacctcgccgccactccgacgacgacgaccctgcggtgttctaccttcgcggccggtcggcgcggctcaacttccccgaggagatctccttgctggcttcgccgtcagagggtggcggcgcaggcgagccccgcgagcccgacggcggcacgctgtccgcggcctcgatccggaagaaggccatcgaggtcggctcccatgtcgacgcgctccagaccggcatgatggtcgcgccgacccaccaccgcgagcagcagaagcaccaccaccacccgcacctgcaaccgcacggcgaggagcaacaccaccacgaggattggattagttctaagtatgaagacattcatacttaaaaatctcttgttgatctcttcctctcgcccctgtcttggttggattagttgccatattagagtaagcactaatccatccatacttcttgctcgatcttgatttcgcgtggttaagtaagtcgtattagcctttcaggttaaggaggttgttaaggtttttaagtaagaacctcctgtagcttacttactagtttgtgatgcttgctgtattttcttctagttcttggcttggtcttaaggagtttttgtttgattgtataagctgttttcttagataatggatcgtataagttgttggatggatcagcaagtattaggcctggtccttccttccttgtgtactactattactcccatgtagtactatgtttggttcagttaagcatttttgtgtgtaaactgtgtttgaactctgctttttgatgatgtggaattggaatttgggggagacactgagcgagagagagaacggtcgtcgccgacgccgtgtggtgtgattggtgtcgaattgaaacggcaacgaacgaacccacaggtacggttgggctcgtctcgatcggaattgactagagggttccagggtatttcgggaatttgccacctggggctactgtggactaggacacccactgtggcctgagtacccccacccggttgctttggattttgaagccactgctcagggagataatacatcgtgaggttgttctctatagccactctatgagtgccctcagccactgctcagggggataatacatcgtgaggttgtactctatagccactctatgagtgccctcctcggttaatgaggacactcttctagtagtggctcacattgctgatgcccttagcagtgtgcttctcttctagtagcttgtctggtgagcacttggaacgcaagcaaacatacagtaggctgctactattctgcattgaatactgttgtgctgaatctggaaatgacaaagctgaggtactctctccatcctaaaaaaagacaaactctggttttccgtgttcaactttgactatccgttttatataaattttttttataattcatatttttattgatgttagatgataaaacatgataaatattttatgcgtgacttgtctttttattttttttataatttttttaaataagacggcggttaaatattgggtacggaaactagggtgtctttttttttttggacggagggagtaggcgttttgcacaagtgtagtgcatatgtgtgtggcttcacttacctttgatgagctagctggccttgtgcatgccgagattggctaggcaataagtaggcatttttggggatgtctccaacttttccattagccactatgattggagcatggcctgagatcggacggatataaggtggtgtttagaaaggagggactaaagttcctccaccaccttaagagcaggtacatcaatagactatttcataaaaaagctagctataagtgtattttaagaagataaaagagaaagagaaaagcagcgtgctataaatttatagccagctacagcacggactttaagatataagatacatatgtgtatgataggtaggactagatattaactgtgtagtatatatttataagtaactattgtataaattgactataaatgatttaaagacagtagttggctatactattaaacttgttctaatgagagagcaacaggggggacaggctaaatgataacgcgtgatggctaggcggctccacgtggtcacacgctctacaatggcttttgtgtctggtccaagtaacaacagctgcttaagagcatcgccaacaacatcttcaaattaagctctccaaatactgatatagccaactctctaactgatttgggtagtcaaactaggtattcactccaacaacctctctatttacatctccaaaataaaaaaaagacccactgtcagtctccgttgccttcttcttcctcctctttctctttctcctgcatctgcagcccatcgatggcggcttcccgcgcgcgtgggcagcgacgaggcgggcggcaacggctgcggcggctccccgtgcgcgcgaggagggcgacaacggctgtggcggctccccgtgcgcgcgaggagggcgtgcgcgtgaggcgggcggcgacgatccactgcgatttaggcaaagagaaagatggtaggagtggtgggacccatggatagccagctgaaatgactctccacatttggccagtgactgctatgatttggccagccatatggcttagccaaccaaatatagagactgttggagggtattttttcttcatactctccaaattttagcttggagagccatttggctattctcttagagatgctctaacctagatgcggcaaacgttcagccccatcgtttcgtggaataagcgaaatagcatatttacaaatggaaagtaatttgtgaataaaacttttttatacgtgttcatagcgatctaaaagcaaaggctgaaaaaaatccgataaagaaaatctcaaaatcagtttcaaatttaagattgaaaattcaaaatctgcctaataagcaaaagaatgagcttcagagattttttttttttgtcggtcgggctacgatgaccctttcattatagggttaattagatacatgccattaaaaattcaccggttttgaaatataccattactatttgcgtatttggaacgatgccattgatatttgtttgtaatttcagtagtgccactaagacacgtattttgcatgtattggacaaaaatgccctcatcttctacctctctccctcttctctcatcttcaagctctctctccccgctgcttcaactccggcgccgtcaccgccgctgctgctgccgctgccgcgccgttgctgctcgacgccgctgctgctcgccgctcgtgctgctgctcgctgccgctccgcgtgctgctgccgccgcaccgccgctgccgctcaccgatgccgtcgctccaccgccgctgccgctgctgccgttgttactcgccgccgctccgcacgctgccgccgccgctccgccgctgccgccgccgctccgctgctgccgcccgctccgccactgccgctcgctccatcgctgctgctcgccgctcgctgctaccgccgctgccgctgctgccgttgctgccgccgctgccgctcgccgctcgctccgacgctgccgctgctgccgctcgctccgccgccgcctgttctctgagctgtggaagaaaggagaggggagaaaaagaagcaaaaaagggtaatttggtccaaattttttcgtaaacggtaggtagtggcatatcttgaatatgtgtaaaattgtaatggcatagttccaaatacacgaatactgatggtatatttcaaaactgataaatttttaatggtatgtatctaattaacccttcattatatggtagattaagggtaccttacacaagcatagattagatagaacataactagacctgcaggagcaagcatttatttgcataacagggcattagcttgttcgtatgcacggcctgctataactcgctaatgctttggttcccaggcactaccttaaacattaaaagtataacaccatagcttagtacataaatatcctgggcggctgatgattcatggggacttaaagaggactttatcagcactccccacaatcaccgaaccccgtgagtaaggtacgccctcaaaaagcttggccataggcactactttccaggcctgtagctctgaaatctttccatcaggcctctcacagtgcggtgagctggaccggtgctacacggtgccagcaaggcttttcgcgtgcatggcagatggatgcacgccctagctaagcccctcgcctccaagcaaagccgcgcggaacatggacggcgcgaggagcgcgcaacaccgaaatccccaggcacgcgcgctgtgggcagcgtcgcctcacacgcgcgtgccctagcgccgtgaaatcccagaatcgccctcccaaaatccactcccgccgcagcttccgccacaacactagcgctcccgccacagccactcttcctccggccaccaagtcaagaaaatgcacgaaaaaattcgggattggaagagaagaactcaaagaagacggattcaacaaaacaaatcgagacgtatgtacaccacatgatgaaaaagaaaaaaaaatccgccagatccgccgccgaccaccgcatcagagtcatcttgctgccaaggggagctcggggagaaggagggaggcgtggagcggcgacgtcccccatggcggcgctggaggaggcagggcctcgcgccgacgaccgccgcgtccgccagatccgccaccttggccgggtcgtcgccgagcccgtccacctccttcctggccgcggcccttcgccgccgcctcgaatcgctcgccgctccagggccttgcgccgacgaccgccgcgtctgccagatccgccgccaacaccgccttgcccgggtcatcgccaaggcaacctgtcgtccacccccccgccacggaggatgccgaggtgctgtcggccacggccgcctcatccggcgccgcatccacagacggagccgaggccgcggacgaggaggacgagcggcgagtgcggcggagtgggaagagaagcggagctggcgccggacggggaggacaagcggcgggtacggcggtgcgatgagaggagccggaggggatggaatggataggatcgaatgggcggagtgggaggggaagggtaggtggaggaaattatttcttccactcgcccatgctaaccgcacccaggtcacgcgcactgtaggagtagttgccttgtatagcgtctccatccaattaaggccctgtttgtttcagcttttgattcttataatttagattattaagccagattactataagttggattataataagctggcatagaataagttgtgagttgtttgtttgtctggattattgaaggcatagattattgggtctgaaaggctaaagtctataatgccctcagctatctgttcagttaatgatataggtgggtaatttttctcaagtatgtagaggtagtgggtctttagccactcaataatctgaaaaaagctcctctagagcagcttatcagattataataatctgacttatagattataataatctgctataataatctacttgtttgtttaagcttactcctaataagttagattataataatcctaaactgaatcaaacagggcttaagccacacatatatgggtgcttacactctggggtgagtgtttttgggccaactttttaggctaagggtacgggacccatagcttgcaatgtgagaggcctcagtgaacttgattattccaagtctgcgggacagaccatctctgatagcttccttgttagctctgtccacaaggagcacactgcacacgtctcttgaaggtttcgaagcgctgaaccatctcggcatggtcacgctcctggttgaaagccttgcaccactgcttatacaaggcccacagggcatcatctgaaacaaggtccttctcttctgccacaaagatcaccctaccttcgccgtcgacgtggcaggaaacgcccctaggctaaacgcataggcctaggcaaaattaggcccaaaatccctacagaatgtagactgatcatccggcccattataccaaacgtagccataatccacatggatcatacagaaactacgatccgttttggcccaacacgtttagattagcctgaaattttcatcagaggcctaatccgaaggagatccgacgaaaatatccccccctccggttcgcgtgacctcggttggtggtctccccttctaaaatctcgccgagtccacaagcgcatttaccagcagctccactcccatccatccccgcgaccctcgctgatctcaccaccaccccgacccacccgcaccgccccaccatcacatcgcccgcgtgagattgctacccaaaaatcctcacctccgacgacgaattgaggaggaggggagagagagctcaaaaaccctaggaggaggtttgaggggccagatcgatggagagccccgcgaaggaggaggcgggaggggagctggcgatggagatcgagtccaccgtcacggcggaggactggcgccgggcgctggcactcgtggtgccctccgtcgtcgtcctccgcaccaccgcgccgcgggccttcgacaccgaggtcgccggcgccagctacgccaccggcttcgtcgtcgacaagtccaggggcatcatcctcaccaaccgacacgtcgtcaagccaggtaggggcccgcccgatcccgcccgtttccctccccgggagtttccgtgtgatttgtgcattgactcgtgtgctactggtttgatgctgctgtcgctgtgttcgcagggcctgtcgtcgcggaggcgatgttcgtgaacagggaggagatccccgtgtatcccctgtacagagatcctgtaagtgtttgctttcatttcatttcatttcatttctgttctattctattttgttctccctgtgctaatggcataatgttaatccaaaatttttccccctcttctcgaaacaggtacatgattttggtttttttcgctatgatccaggtgctatcaagttccttaagtatgatgagatcccgctagcacctgaagcagcatctgttggtctggaaatccgggttgtcggcaatgacagcggcgaaaaggttacgtaaaaactagattaacctctttcctagttgatattgtgaactatcatataatgagcaatgtagcacaagaaacttgctaggatttacatctccagaaattctcttatggactatgggacaatcatttttaattgttaggctttaggctttagtttcttatattggccttgtttagttccaaactttttcttcaaacttccaacttttccatcacatcaaaactttcctacacacataaacttccaacttttccgtcgcatcgttccaatttcaaccaaactttcaattttagcgcgaactaaacacacccattgttgagaagcacaatgtagagctcacaaagcaaatgttctgtacatcgtacagttcattgtgggctctattatcacatgatgcagtttggcatttcagcaacagcaagcgaactgtctcttcttgcatctaataaaggctaaaatgatacaattcattgaaacctctatgttccacacatgtagttcactgaaaactatataatcaaatggtacagtttggcatttcagcaagtgaactgtctcctctttcctgtaatattgtgtggtctgtagtgcttataagattttagcatatagggaaaaagacaatgcatacaacatcctattacgggcctttaatcaatatttgttgattcaggagacatctcttcaactagttggctcagaaactgtagatatgtgccaatcaatggtatagatcaaaacatttcacatattaggctggaaagaggcactggaacaaattattttacttcctatttaagtgtggtaattcagattctgttgtgtcctatgtgacatgctttgacgggacaatgatttgtactaacactagatagtgatgcattaatatgtatatacattttctggacctagatgtggaggttaatcacttaatcctttacattccatgggtacacatcagcataataacttcaaaaattatccgatagattgtgtttcatactgcaacggtttctgattttcattcaccgaatgcaggtgtcaattttggcgggaacacttgctcgacttgatagagaagcaccttactacaagaagtatgtctcctttctagttaccataacggcccattacattagtgctattttcttttctcatgattacccctggatctattgttggacatagggatcaaatatatagtacaaaattcatttgttggctactgaacttagaaaatagtaataaaatatagggagatacatatcatagaggatcagagatcatagtttacttgctatgcgaactttatttagtttcagtaagtgaagatacatatggagaaagcggattaaatctcaacctttcgcttcatttttctccaagccttttcaatccaccgaacttgggcaaaaaagactttgtagttcgtattcactctatattctctacccacccaaatggagcagcttgccaccaccagcttctactagataatactatatgattaataatttttatgtgcagccttgctgcatataatcttacgtttaaccttttttttttgacagggatgggtacaacgatttcaacacattctacatgcaggtacttttctcgggctactcaatattacatccatactctcgttctcttctgacttgtcagttgggacattaatacacaccttttaaccattacttatctgaatgatgtgctcatacaatatcgatattaaaatataatgatacccattttaaaaataatgacattaaagtagttctcgtgacaaatatactcttataattttttgcatgacatatttgaatatttttatgtatataataatggccaaaatttctaagtctgactgtatgcattctagaatgaaatctatttgagaatagtatatgtttaattcaaattggtgatgttcatgcatcttctgaaatatcgggcatgttttagtttgatgccgaaaccagccttatcaaattttgttaatgccacaccttatttatttatttttttgggtaaggtaggtatgtggtggtacgtttagtttgaaacctcatctatttgggtgtgatgttaggtcaggaagtttattagctaccaaatattggtatggaaaggtaggtatggttggtttgttgccttgctaaaatttggtaaggttagaaatggtagcaaaccaagcatgcccattatccgtgattttgtcttatagttcaattgcttttatccaatagaggttcactaattttccttttactctctctgtcattttaatgtaatcatatgtttctataggctgcatctggtaccaaaggtggctctagtggttcccctgttgttgattgtcaaggaagagctgtcgccctgaatgctggaagtaaatcttccagtgcttctgcgtttttccttccattagaacgtgtaagttgtttacaaaatgttcattgaaactagctaaatgcatgtgctttgctacggataaaagaaaacgtattaatgtgttacccatcttttttgctatagggaatattcatcttactctaatttaatgtggctatccatttagatttgatattttttaatattaagaagttcagggattaacttgcaaaatttacaatgggagtaggtggggtgacagattcattgccaccaccactaccttcttttaaaggagtatagatatactacttttagcccaggaagcttatgcttttgttctaaaattgcaaggtctcttatttaataagaccaacgaagtggtcctgctagttgaaattgatacgagtcataaaagcacacatgcaattaggttaacatctatactagacatcacaagaagagagagagagagatagaaagaaaaatataatttggcattgaccgacatccgagttcatacaaaaaggaatagcattgctgtttaatattgattaattgtaaggtctcttattgacaggaacaacgaagtggtcctgctagttcaaaatgatgtcattataaagcgcacatgcaattaggctaactttaacatctatactagattagctggcttaatgattttcatcaggtaaaagtatggtatgaagtatcctattatgcactagacatcacaaggagagagagagagaacttatagtttggcactttggcattgaccaaaatccgagatcatacaaataggaatgccattgctgtttaatatttattgattgcccgtggcacccttatgtttattatattgtttgtccaaactgtttccaggttgttagggcacttaatctgatacgtgacagttgggaagcttttggtagcaagcctgaatctgattacattcctcgtggtacacttcaggtgagcatgctgtctgatgatcccattgttctattttttttaccaagacctgctgtgtcattagatgtttatttctattacggtggagctactgaagatgtatggtgaacaagtaaacattttagcacttaattgttcttctttctttgtatgtcagtgataaagtttgtgaatttgcaatgatcagcaccacaagtgtacagagtgctgcagcagccattgtatagtcaattttgctcctctgactgctgtacttttattacagcgatagttaaaaagcacaatctgtccatgagattattagagttaacaaaggctattactcttgtttgtgttgccatttctacctattcttgttgcccccctcctgccagtccttagatcatttcccttttcccttgtttttaaggtgacctttcaacacaaaggatttgaagaaactcggcgtcttggactcaggaatgaaacagaacaggtatttttgtgcatcattgctggtttgctattggctagaatttccaccctctttgcaatttgaatgacatcagtcagcatcagaaaatagt

SEQ ID NO: 67543 - DNA, 6239 bp, Oryza sativa
  unsure (1)..(6239): unsure at all n locations
ttgtcaaatttctcatgccattgcttaggagcttgtttcagaccatacaaagacttcaacaatttacacactttgtcttcttgaccttcaactacaaacccatcaggttgatccatatagatctcctcatccagctcttcattaagaaaagttgtcttaacgtccatttgatgaatgagaagaccatgtgaggctgctagggaaagtagcacacgaattgtggtcaatctagcaacaggtgagtaagtgtcaaagaaatcttcgccttcgttggttttcttgagnaaggtataagaccccttagcaacaagccgagccttgtacttttcaatagtaccgtcaggcctgagcttcttcttgaacacccacttgcaccccacaggtttacacccatagggtcgctctgtcacctcccaagtcccgttagcgataatggaatccatttcactacggacatcctccttccagtagtctgcatcaggagatgcgtatgcttatgaaattgactaaggagtgtcatccacgaggtacacagtgaaatcatcaccaaaagacttagccgtcatttgtcttttgctcctttgaggaggttcactgtcatcctcctcagtaacatgttcatgtgtatgttcagtttgttctggtggtgtgattgaactgggaattatttcagagggttggctagaactactatgtgtatccttcattgggaaaaagctctcaaagaaggtagcatcacgagactccataattgtaccaacatgcatgtcaggtacctcagatttgactattaaaaatctataggcaatgctgtggtgagcatatctcagaaagacacagtccatagtcttaggtccaagtttgcgcttcttcgttattggtacattgactttcgccaagcacccccatgtgcgcaagtaagaaagtgatggttttctcccaaatccatatctcatatggtgtttttgtcctcatttctattaggaactctgtttaacacatgattcaaggtcaacaatgcctccccccaccatgccttaggtaatcccgcggtgtccaacatggcattcaccaagtcggtcagtgtgcggttcttcctttcagcaatcccattagactcgggagaataggggggcgtcctctcatgtataatgccatgttcctcacagaataagtcaaactcgtttgaaaaaaactctctaccacgatcagacctaagtctttttatctttctgtcaagttgattttcaacttctgccttataaattttaaaatagtctagagcctcgtctttcgttttcaacaagtacacatagcaaaatctagtagcatcatcaatcaacgtcataaaatatcgttttccacccttcgtcaacaccccattcatttcacagagatctgagtgtaggagttctagaggtgccaagtttctctcctcagcagccttgtgaggcttgcgaggttgctttgattgcacacaactatggaacttagaacctttgacaatggaaaacttagaaattaaacacatgctggaaagccgagacatcaagccaaaattaatatgacataaacgtgagtgccatacattagccttatcatccacactgccacaaatatggttcacagacttattgcaaaaatcagaaagggaaaagcggaataggcctccgcactcataacctttaccaataaaatatccatgtttagacacgactactttattagactaaaaaaccaacttaaatccgtctctagtcagacgggagccactaacaagattcctgtcgatagaaggtacatgctacacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcaacacaaacatgtacattggcccctgtatcaacccaccaattagtagactgattaactgaaaaaatagtaggtaaattaccatacccgcttccatctccagtgttgccaatggtcacattagcagacttagaggtctgtcctgcaggtgccttcatccccttgcgttgtggacacttcctggccagatggccaggttgaccacacacaaagcaagtcctctcatcctgattaggattgttgtttttcttcttcttattgaagttggtggtctgctgagctttgtatttccccttgctcttgttttgggccttgtgcacaacattggtactggactgcccaccatcgcccttagacgcgacatctttttcccgagctttgtcctcaacatcaagagacgctatcaacccctcaacgaagtattcctgtctcttgtgtttgagtgcagtaccgaaacctctccaagatggagatagtttcgcaataatgcacccggccacaaatttgtcaggtaagacacacttaaggagtttgagttccttagccatggtttgtatcttatgagcctgttcgactacagaacggttgtcagccatcttgtagacatgaaactgctccatgatatacagatcattactagcatcagtagcaccaaatttagtattcagtgcatcccacaactccgtagcgtcggtcatatgcatatacacctcgaccagacgatcgccaagcacgctaagaatgcatcccacaaaaagagtagtggcctcatcgaattctttctgctgatcagcattaagaacgcccataggcttgccagtacttacccagaagcatttcatagctgtcagccacagattgaccctgatctgccatctcttaaagtgcacactggtaaatttatccggcctcagtgcatcggcaaaaccagccatagtaaaatcacagcgtctataataaggtttttggaatgttgcgaatataggcatataatgatttaatatattccataaataaatcatgacattacagatgtatactagcattaacgcatcattagatctacacatgtaaactaagtagtaaaatatgaacagatcaaatatgcgcaacatgtcgaacacgtaccgaggtggcggaaagaccggttgctcggcatgaactacttgcggttgcgagcgtcgacgaaggcgtgcagcacgcgagcggagaggaaggcgaaccgtcgcggttgaacagggagcagtcgcacgaagcgcttcccaaaaaccttattgccgccttctcccggtgcaggacgtcgaaggcagaggttccggagacctgctctcccgatcgccggtgcacgctggcgagcgggatggagtagtccacgagcgacggcgcaacacagaggaggaggcaaaccctagattgatttcgcgtgtgttgcgtgaaggcggtggcacggtttatatagagataggtcacttgatcagggcgcccgcacgatctccactctgcataaccgagccggataagtcgcgcgtaacttatccggactccacgccgttttcacacaccggattttttggaatgttttcaacaacaaaacaaatccgaattttcttgccagcaaaacaaaactgtaaaaggaggctacatctgcgcaagggtgaggagccaatttttcggaccattcgacacgtacatcatgcacacgcgccgcctgccaagcgaggcaatcgagcgcgcgcgtgttgcccctcttctctccaccacacatgcttcaagtggctaggagggcatcctctcttttaaggaggtccccctctcctagaataagcaaggtggtactaaactccacatacatgccatcccatgaggttggcttttgtgattttccaaagaattaattttcgaatgggccttagcccatctattaattccaacagtgaacaatttctttcagcttgttactgagtttcaagaacacactaaaatccactaggccagatagttcatctaagatatcgcccttgtaatagtgaagcacatcttttgttaattctctaagacttctaataacatgggcttttctagtgaagttgtcatcattcagcagggtgtcttccactgactcagtgaatgcactgtcatgaaccccttttaaactctgatacctgatattgctacctgactcattatacgtctagcaataggacgggacgattccatcttgagaaacttagggtgcacaaggtccaagatgttaaacacttccgaaacgtggttctggaaaagtgtaccagacaggaccactttgcgtggtgtctttttagtgatgccagtacatctgtctcccgatttcttggtgtatgaccctcgtctagtataagtaggttgggtaccataagcagcctgtcccagcacgcagctgcaatgtttccatctccatcaccacagatgattcgtgagaactgcttgtatccaagaaatagtatgctcatctgggcttcccaatatttgaggacttccagttgctctactcttttgtcagccttaacagaatagaaatcatatagtggtatgtcctccacttgccaccactgaaactccctcttccaagtacctaatttacaccctacttacacaccacttacaaatgtaaattagtatgtaattttgggacttacatatgtaattttttctgacatcaccctgctcgccaacatagatccagcccttcctattgagaactctaccttgtatcaccggttcgctgtagagtgcctagttgattttttccaaaacctgttttcaagctcttcaatttaaagaaggtaagcaatttctgcaacgtgttcttctcgtagcatatgtaattttaggacttacatatgtaagtttgggacttacattgaaaacactaaaaatacatatgtaatttagggacttacaatgtaaatacatgccgactaatttttgttaaaaaatatggcgccataaatatagctactcccaatccctttcggaagcactacaaggggccttgcagaaggatactttgctaagaagctttgaatgaaacttatgagcataaatgtcttccctgaaccaggagcatgagctagaatgcaacctccaggtttgtctccgactagattcttgaccaggaagctgaatccttccaactgatgtggtctcatttgcttcgcatgtcttggatgaatggcaatatcagagacaatgaaatcttcggaaactttaacagcaccagtatcaatctcatcagcatcctttgaacgtgattcatagtaatttgttcttgtccttgaagcctgatataatgtaagcatgaagttaaattttcttatccacatgaaaatccaacaaactttagaaaactgatgcaagcattccatctttactacaggacccatgctctgaatactgccaaggctcgcagcttagctcatgtacaagccactaaagaaatccatatgatttccaaaacgactattactacatactccaaagtggtatcaatatcaaaagagttgataatgaaaacactcccccattttaggaagtagtatttcagtaaagaaaaggtcccccatagcatgtttttctataaaagaaaccagaatccctagagattcacagtaaatctaacgagcattacaaaaaccgtatgtgtgagaactatatgtcagtaatttttatttcgttcagcatgaatccacaaatttctcttgatcgtgatgcccttccactgcctaaagaccttcaaggtactatgtgccttaatattaatagcatttgtgtaggaagtgaagaaaatgatttttgacatgaacacggcaaagtggatacagctggtgtgtaggtgtggggaggtctactgcgcgaacgcgcgcgagatatggaagacacgaacggattcaaaatttccagttttgtctaccgcgtgcatggagagacagatccaaacttttctgattcggttatcatgtcgtgaaactctagcggcctgtttggttggagggagtttttaggaaggattgggagtttagagggatgaggctattaagtgttttgtttggttgggagatatgagaattttggtgagatggggatggaaaattgaggaaggaactccctccttttcaataactgggtaggggcagtaattgggagggaattcctcctttactttgtctaagcaaatatcagccatccgtttttattaatgacctaatctccaactaaactccctatcaatttttatcatctctaccaaacaagata

SEQ ID NO: 67544 - DNA, 18722 bp, Oryza sativa
acagaaagaaacaaaaatccaattcaagaacaccatgactgaagcagaaaaactattcatttattcattcattcaagaatggttcgaatagctgcactggaaccaaacaaagtagcattaaggttgtgtttagatccaaagtgtggatccaaacttcattccttttctatcacatcaacctgtcatacacacacaatttttcagtcacatcatctctgatttcaatcaaaatccaaactttgcgccgaactaaaaaaaaacacagcataaaggctgcaaatctacactactacagttcacaagcaggggcaaggtctctctgctcgtgaacttgttgtttagtggcatttcaaatacagtatctgacttgttgttgttgctatgtccaaaaccttaatcttgtctgatgctcactgaacagaagaggctttgggggcctcgtcagtgtccccagagaaattctcagaaaaattaaaaatgagagagaaagaaggaatcacgatgacaaggacatcacgtgactgaccacgccctgacaaaacccaattaaccaatcgagctactccactccaacaacatgccatgccaatatgccactgccatcatcatcaagaatgccgacatcttctcaaccaaaatctctccccttaagatgaagtactacctctctatatcaaattgccggtaattaacccttaatcaatgcagtaaaaaaatgtaaaaagtgaattatcttctgtttgattgatttcgttttgtaagagaagatctacagatgcacgtggtggcatgcgacaaccgccagtgacggaaccggtgggtgggccccggaggtgtcaggcaggggatccaatggccggcggccacgtcgccgaccgccgcgccgcaacttgctcccctccggtttggtcacacccgggatcctgggccccacctcccagccacacaaaactaatcccgaaaaagccgagcatactactagtacacacccaacttcaaaattatttcaacttttatctacagaacgagaaataaaataaattattttacaaaaatagacacttttttacgtattccgctcaaaaacaaaaatgatttcatgtaccaaaaaaatatatactaatactagagagaaaacgctgacacgtggggcccttgcttggtccaccgcggcgggcagggcatggtggggcccacgcgggggaacagcaacagaatctcggggaaagcgggcgatccatccatccttccaaccaaaccttgcaaagcaagtcagaagaagaaaccaacggaaaggcctaggcaaacacacacaaattttccacggtttttactccccttcctaccaggaaaatcaaattaactcgaactctggtaggaggacacgagggaacacgtggctggcgcacgtctgacaccgtgggcccacccagtccacgcggagggcccacctcccgaggggaaggcaacgcgcgtgacggcgactcgggagccgctgctactactactactccagttcaacacgaaaccgcctagaaaatttccttatagtttgatttcgaaagaaaaaatttaagggtttgagcaggtttatgactttattcaattattatccataactgaattcttctagaattacaaaatactccgtatagtagaagaaaaatccatacattttttttaaggaagagaagggcccgatggtgataaaatgggggtaaatccaacgacaccggccaccgcggcccggtgcgcagaatccgccgccgtctacagctggcgccgacgcggcggccgctacccaaacgaacaccttttacgccccacgagtccgcatcgaatacccaaacacaaacgaacgcgatatacttttttttcttttttcaggtagaactttcttctttttttttgcctattattacatatacacaaatcgtaacagacaaggaaaactaccactactaaaatgatatagtgaaaaaataaaggaagagcttttttgaacggacctaaaaaatgcttcatcttggcaaataagctgaatttacgggtccaaagtaaatgtttaaatttctgttgagattaaacagataaacactatggtagtacgactatttttttctataataagtgaacaaaagaggtgaaaagcaaacggatttcgtcagaaaaatcgttgcaggcacatctcccatacacaaatcaaatcaaggtggaattttaagtcaaaaaagggaacttgtcgtctgatttcctaacaaaaaatcgttgcgagaatcatcacacaagcaagaacacagatcacaagcaaatcgcccgaggaaggaacttgaagagaaaaataaaagcgaatcgcacgaggaagggactggaagaaagaagatttcagggcacaagaaagagctcaagagttctgaatccaaacggaaacaaaagtaaaagggccaaaaacaaatggggaaaaaagtgggggggactcacctctgctttagccgctgcggcggtctgagcgccgccgccggcgaccaggcacggccgcttctccggtgagctgcacccctcgtcgccgctcgacgaggcgccgccggatccgcccgcccccggcgccgccttccgcttccgcgacgactcgtcgccgctggaggacgcgccggatccggtggtggcggcgtagtccagaggggtctctgggctagacgcctccatggcctccttcgccgccgcgaggaccgtcttgacgtgcgccctctcgacggggcgaggacgcggacgccggtcgccgccggccgtggaaggggcggatccggccgccgcgacgtagtacggcggcgactcgggcatccgcgccgccggcgtcggctcggccttcaccaccgcgcgtggcggcagaggcctcgccacgccatcccggctgaaattcgcgccggatcccgcgccggccccgtactccggcggcgtctccggcccccgcgccgccgtcggctcgtccttgaccttcatcttgaacaacatcttcttcctcgcggggggcgggagcggggccggaatcgacgccgccttctccccgccggaatccctcagctccaggccacacaccaaaatggccggcggcggtttggacttggaagtccgcttccgccggtccttccatcccggcaacttcttctcctcagcggcggcgcccttctcatccggccgcggaacccactccggccaccgcaccagcctcctgttctggaagctgaccagaatctcggcggccgtctccaccgcgtcgtccatcggaaacggaatccacaacaccagccacccgcacgcacgcacgccgccggccgccgcagatgggagactgctcctcctctccgccgcgagcgagagagaaagagagagagagagagagattggtggtttcttggaaagggagaggcgagagaggcgagagaagcatttatagggaggaggaggaggaggaaaaaaaaacctgaaagggacgggcgcttctcggccgccgcgtagaccgggtgttggtagacctcgcacgctgacatgtgggccccacccaccgtctctcacagtccggctcggtgtaaaggcatcggggatccacttcgcactcgggttggtagacccgcatcacttccaggtgggcccgggtctctcgccctgttggagtctgatgcgggtacgtctcgtctcgtcttcgtctgtggattgcgaggaattctcgcttttgagtttgtactgctcctgcgcctactcattcaatggcaggtaggcccggtacgtgatgcttttctttttttttttttggagagagagggaggaaggaagtgggagtgcggcttatggatcaatctccggtaagaaagtgaaaattatggatttgtcgcaaccgaaacatcaactacgaagattagctatttattgtaaatgatttttttatcagttggctttggtgaggtaaaaacaaaggttttcaacaaacccaacctatttctgaatgagttgtttgtttctagatacaaggtaaagacctatgttttaaaaatgaattatacttgggctaataatatttggaataagttagttgtaaagttttgggacaatttcattcttgattcgctgtagatctctttgcatgataaacctaaattttagagagaaaatacaatatagctcgtaggtggcatattcacagtttgaggagaaggggattgggaagatacgcaaaacgaggtgagccattagcacatgattaattaaatattaactattttaaattttaaaatggattaatatgattttttaaagcaactttcctatagaaaatttttgcaaaaaaatacaccgtaaacggtagtttgggaagcgtgcgcgtggaatacgatgtgcatactctccaatcacccaggggcgaatgcaccgtttaggctgtgtgtgtgttcttcccccattttcctaacccgtctctctcgttttccgcacgcatattttttaaactgctaaacagttgatttatgaaaaaactttctatatgaaagttgttttaaaaatcatattaatccattttttaaaaatagttaatacttaatttgtcgatgagtgatactcgcggaccggaagaatagggtattggggtacgttggaacagggatctacgtagtacgacatcaaaacagacaaaagacaaggattatactggttcaggccccttatcaggtaatagccctagtccaatttacatgggattgatgatgatgagaacagattacaaagagagtaaccgaatagacgatgctgatgagatcgtagtcgagggactcgacgagatctcccggcgagttggcttcgtggactccggcttcgtaaactttggtaggtgtgttggcaatgagatgcgataccctttgcctctccctaggggtcccttttatatcgtgggataccttgaccctcaagtaagacttggagatatgtaaaccgacacgatatactagagattttatcttttccgagtatgacttttgcaattccttaacttcgtggagatattttccataatttgaggcgaattcctaacggcgtatatggaaactaaccatatacataaaggtataccttatcggtatattccataagtcgtgggatagagggtatgccttatctgtaaccctgacataattaatcatgcaataatacgagtttcgttttgcgtgccgggaggaggagaacacagccgtagtatacatgagtatttgatgggaccttatggcataattttgtcataccaggaagagttcatatagtaacgtagcatttttatttttattaagactttaattgaaagaattattaagaaggtccaaattggcgcacgtaaaacgagaaaactattaacacataattaattaagtttaattattataaacttaataaattgatatatttgatcttttaaagcaacttatatatagaaagttttcgcacgaaaacgcactgtttagtagcttaaaaagcgtgctaacgaaaatcgagataaaatctgaatcttaatcagaaaagaacaaggcacgacgaataaatcctaccatgccatcgtagggttaacaacattttccctggccacttgccttttttatgggctgcaagtttaccaggcttcctttattcatgagcttccgatgagttgggctggctgagccattgaggaactttcagaattttgatagtaattactgtacaaatacggttaccgacaaaatggtcggaaaaaactccatcacatttccactaccatttccagaagatattaccgtttccatttccaccatcatcagttatcgataccaattgaaatggtcggtgcaaactgaaaacgacagctggaaatctcaaaaatttccgttccattttcaccactaatgccatgtgtttttgtattgtgattggtgccacctattaaggttatgtttttttctccaattttctatttttcactccctcatttttcgtgcacacatttcatgatatgttaaacggtgtgttttttaaaaaaaaatctatatgaacgttgctttaaaaaccatattaataattttatttttttaactaatacttaactaattatgtgttaatataccgcttcattttgcgtgcggaaggaaaaagttctcaagtcccatccattctaaaagaacacaatctaagaccaccatgatgaattgcaattccaaaaatagaaaattataagttataaaatccaatttttacaaatcctcattgactggctactcacgatctgtttttcaaatctcgatatcctccaaacaaagctagatttgctatggcgttaaaggaaacagggtaaaggtccaagaatattgtttctttgtttgttgattaaatgattaccaaatggtttgtactagatatatgtactaccatctatgatcaaatcaataacatatgttggccaatttggtgccgaaatgatatttttcataataagaaaatagctaatcatatgcatgttatcttcatgtctaccaatcaacgctatacttgtatttgatgctatcatgggagaaacgagatactatgcgtggtgatgctacacttttaaaattggtagccaagggtattttatacaattttggatggagtagcacctatcgaattaatcgctataatttacgggatttatattagcttttaattctggtgatcatcttctcagagaagagggaaattgtcccatcactatatttttctctcattttcaattataaaatacaatggatgcatgtctgcttgtaggcagaggtcaaacatgtaaaccatttttattatcttacaaaaatatcaatcatttacaatatatgtacattatgcaaatacaatgtggcaggttcacattgtcttcatgtcctagagcgaccaggccgtgacttcaattgccacgtggatccaacgtggcaccattgacatgccagacgagccgacacggcacggcagtgccaatcagtagaaccatcacacttctgtggtttttgcctgatttacgccaacctttccctaaaaggaagtaaggttatattcgctaattacctcaacatgggacatttatcagctagccatacgtttctacttgtataaaagccggcatggtgctcttttatttgcaacgttacttatagttaaattaatttgtaacagaattgtcgattcatatgtgaccccacgagcagacctttttatcagcacaagcagatcacatttatggagttcatacaactaacatttatacataattaatatatactccatccgtcctaaaatataattttagtattttttagttggatgggacgtattctagtactataaatctggataagcctcctgtccagatttgtaggactatgacacatcccatccaaacaaaaattactaattcgtatattttagaacggagggagtatttgaaattacatatcgataatgctttctcttaaacgtccggagcatatgtttgtgttcaccgaccagcaatttggacccaatatgatactaataaaaaacacacgtatattggtaatgggcaggaagtttcttcaaactggtggtcttagatatagattgatgattaattagtaataagaaaatgtcaactttagttacgtactccgtgccaacatttgaccatttgtattatttgaaaaatttattaaaaaatttaaaaaaatcacacataaaatattgttcatgttttattatctaataacaataaaaatactaatcataaaaacaatttaaataaaacggacagtcaaacgttggacaccgaaacccacaactgcgcttaaaattagacggagggagtacgtaatatccattacataataataaaaaggtaatctttttacgtggtggtgttgatggcaaaatttagtaagatacgtgaagataaggatagatccgaagcggatttgaaggaattaacgtggtttccaaaacagaacggcgcatcagcagaaaactgtattggccgatatagagtcggattcggttagccgatataggcaatttgagttcatatcaaactcaagattaaggtttcaaagatattgcaaaataaggacggagtccgaagaagacaattgaaaacaatccgttttcctttatgtattttagaaatttatgttagagttcacaatgagctagtgtgtttatttttgtaaagtttgaattgtatccgatatggacaagttttgtactacagttataaatacatgcccaggaccttgtaaaaaaaataacagttcaataaactcttggcacatcaccccctttttacttttcgactttctcgacgagttcttgcttcaagttggggcatcggcttcgattttccggcaagaggtatggcatgtcacagtggtttgcattggcggattaggatgtcgttttagatgttctaatctatcttttgcagctactggttatcatatatcctagttaatctaaattgatgattctatttacttgtatcaaccaggcctttttctagggttttgttggtatcgactaaatcgttttgtcactttagattagctaaggtatttgccacactaaaaatcagtcacaaacttaattgtttagactttatgcttcttttcatacttagtattgcatcagttaagtttgatctactaaatcgtacttagaatcataaaaactagcatgcttcttgattaccaataggggtagaattggggtttcagccgatcttccttgatgtaactattttgctatatttaatttcttttaatcatgtttttcatgctatacctaccccttgtataggtatatcactctatttaaatatatcgatcttcttctcgatatatttacctagattgatattcttgtgtaaagctatatcgtagtattacctagattgatattcttatatctgtatcgtagtattagccgatacaatatcctttcttaacctaagtattggatcatcggctataatataaaaacgtgtaatctttagtttatctgatctgatccatactatctcgattaggttcaatctatgccgtttgcttgcacttcagagaaagattgaattagtgattacatgtttgattgcatctaaagctgatggaacatattttaggcttgtttatttttatatatcctataccttacaaccgattcgatcagagaacatcggctatacgatatgtcatcggctcatcggccgattggctatggtgttctaacttgattttactgtttagtcttgttggttacaggatcaaaccaactgacacgtcctgaacccaaaaagcaagatttgaacatacactggagctaagtggaattctcaggccgtcctgttttctcctcaataggtgggtgaatgggatgatgggtgccttttgtttttcaaatttatttatttactcagcactttgtaatgtacacacggtcgtggaaacttgttgtgctcaacatatttgaaatgaaattttaaaaacttttgaacactaatctcttttaaaatatgtagattggacgcatgaagaccatctgtataagtacatctcgtagtattacaactttgccagccattaaatattgtgtactaatacaaaactagcggtcaaaattatgttttttaagattatatcgatgccaatatatatacaacatattttttgtgacagaactataaaaggcaacttactagggtggtaagatgcaccagggatccagttgatttgacaaatatttgtgtattattctgtccaagctttccatttgatcagatgatcaagacgagcaatcttgatttattgttaataacttaattaatacgatctcttgggatattctgtgcgtgtaacagtacactatcactatgtacagatagtgtaaagtctgttgtccgtgatcaagtgaatttaccctcgagaaaagaaattgaggcacgagccctgttccactgcaaactgcaaccaccggatcacaagttacacatgcgacatgacctatacactttccagcagagaaggtgacattggcaactcccgctctcattttattatgttgccaagtaggatatgtacgtggttgatccgtgtatatccaacaatccgcccaaatccttatgccacataatgaatatcacgcttctcaatgatgccgtgcatcatcgtcatccactcatcctcctctgcatagttttttttttatataggtagagcatatccttcttttccagtgagaattatcttctcaagagtgcaattcattagttcatgaatcgatttttgttgccttgcgagagggatgtacagtactagcacagtaaaaaaaaaaaaaaagctcgaggctcgcgagcagcttgagcttggctcatactaggctcgattcgagctcggctcgagctccaaacgagccgagcccgagcctgagaaaaactcgcgagctttaccaaaccgagctcgagcttctactgagcttgtttgtatatagattatattgtatgttcaccttattaatataataaactaatagataaatatatatatatatattaatatttatttacacaataaattagcacgtgttaacacaatatatttatttgaatcatttttctactttttattagtgtgattaactagaaaatattaaacttatcaagagattatcattaaaatatatattatactacttatggccgagctcggctggccgagctcggtagagctcgagctcgaaccgagcttgcctaaaagctcgaaggtgcaacaggctcggctcgagcttgtgtcgagctcgagcttgggcagacaagctcgctcgagctcggctagttgataaccctaaacagtactactacacaaacagcgaaaaggcgtttccgaaatcggttagacgccccatctccccccaattggagattctcacaggtggaccatccaaccgcgtgagaaaaaaaataattattctaaacggatctcttaactcagccgattgtgatactacatatattttcgcaggccactgagttaaacagctcacctggacagaaggtggctaagataaagatttcttgcctatttcaaattaaaatttgaaaatatatctcaaattaaaatttttcagtttttgagtggcattattatgtagtatagtacgataactaggggtagtgtgtaacatataaaaatatatactccctccattaataaatgtttgacgccgttaacttttttaaacatgtttgaccgttcgtcttatttaaaacatttaagtaattattatttcttttcctaccatttgattcattgttaaatatacttttatgtatatatatagttttacatatttcataaaaaaatttgaataagatgaacggtcaagcatatttaaaaaagtcaactgcgtcgaacatttaggaaggagggagtatttgtgtcaacaaatatattggatatgtgtgagttaagacatattaacatatgtttctaaattcgattacaaatgagccatctcggatcgcataacaatagtctcataacatatattatttttttgagtaaatttcacgaagctatggatatattgaccaaactataaaaatgtacatagatttaacacaagatttattgtaatggttagtgataatttggtcaaagtttgaggttagtgataatttggtctaataacaaaataaattacagattccgctagaaaaccaccagatgaatttattaagtctaattaatccgtcattagcgaatgtttattgtagcactatattatcaaattatagcgcagttaggcttaaaagattcgtttcgcaattttctaacgaattttgtaattggttcttttttttgtctatatttaatattatatacatgtgtctaaacatttgatgcgacagcgtgaaaaatttgtttggtaactaaagatgcccttatttcgtcttccggaccttttggcactcagccaacggaaggccctcacgccatctcgcctgatcgcgcccagatctttttcaccgagccggcgcttgcgttttgattggcaagcaacgcgagacctcgagacgctcgtgatcgagctcgtccgcgtcgcctttcccttcccctccgctgctctgctccgcgcgcgcggtgcaccgtgcacgcctctgcagcacgcattactaacgtgcggactcaagggccagaggcagcggcgctgcagcgcatgggcgcgcgaggcgtaaacccccacacccccatcgtcatgtgggcatgggcatggggaccctgcctgcccgtgttgaccttggaggtgcggtagccggtaggtccacaccaccaggccaccgtctcgtactagtactgcaagactgcaagccaagtggtttggactttggagtctggggctaacctgttgctgggctgtacagtagtacgctcagagcctcagatgcaacaaaggccgggagggatggcccacacacaggacggtgggctttcccaacggaataagttcattctaggtcccttaacgtgacgtccaattcaaattccgtccctaaacaacaatacatataacacgtcactcaatttaaaataccggcatactttacgttctagagcagtatagtctcccttttttactgacgtgatggctaagtcaacatagaccccattatcagcggcctaaattttttccactacctcacctctcttcccatctctttaggactccacgctcaacggctccagggctaggagctagtgatgagcggcgcgttccggcgaacggtggcgtgacaaagcaagcatgcaacactgggggcgctgcatccgcgcgtgcaaaggaggaacaaagtaggtagtgctggcgcagcgagcgaacaacaattggacaggcttgcggcggtcggcgggagaggcgcgtggcgggtagaagctcgacagtgacagacgacgaccagcagggagaagggtgtcagctagcgggagagactctcggcggtccccttcctcttccctcgccactagtggtcccttccccttcctcttccctgccctatcgatgggcttgcattactacggctaccacaccaggtctagcccaccccgcatgcccactgctcatgccaaccctcaacaagcccaactctaccccactgcgtgccgccccacgcgctccgccaaagccgatctcgtcacgctacctgttggcggtggctgccgcgtcgccgacctcctccacctcatcctcgacgtcatcatcttcgttcacgtcattgaactactgctccctctctacgcaatgtgtctggtcatccactctcctgccatagcactcgacgtcgcccacccagggcgtggcggtgactgtggcttttggggcgtgacggtggccacgatgcacatcctcttggtgttgttccaaggggagtccttctaccagacgtcgcatgctccccaggccgcgttgtcggtgtcccagccgggaggcgtgggcccatgctggagcgatgaaagagcgtgtcatcaatgctggagctcgagaatatgtggtcacagcaccgatggctgacgacaaagcccaaggtgtcggacctccttgcccactgccttgactacagttgtaccacgaggaatcaaccctgcgtgtcgactgctgtccacctactccggcgttccatggcgttcgactccaccacatccctctccccttcataccactatcctcctcaccacctgccatcaaccttctcctcacacctgcttgccccggtgagatgggaacaagaggaggaagagagagaagtgaagaggccttgacatgtggggctcacgctgactcaacgctgttgacttggatcaaattgccacatcgaacagaatcatcagctatattaccatgggacctatatccaatttttttattaataataaataatattatttaaattaaattattagtaattagaggataacatttaccaaaataagatggccgctactagaaacagcgtccagatgtggacgctattaccattaacgtacagatgtggacgccaattggatcgacgtccaggttggtgcggtcataacctggcgctaatcatcgcgattaggaaaaaagaaaaaagaaaaatcccccaacgctagggcagggtgcctctgccgccgtccaaattgacgccgggagtctgccgccgccgccgtccgcctcaacctctggagtctgttcctccttccgactgagcgtagggactacccacgaggcaaatggcgcggcagcgctaaggcagagggccgccgccaccgccgccgccgtcgtccacctcgacgccgggagtccgccgtcgccgtccaccacctcaggaagaccacgccaccgcctgaatcgacttttgaagttctgagaggtggctgccgtcggccgcttccatccgtagcttgctgtcttccctggaggctgcagctgttgtctgcctcgactcctgccaagtgctgtcatctgttctcatcttggaagcttgcagccaccattgacgtccaagcccagaactcctacagtcaaggtgattcaactaacttattttgttgtagcctatttaataaacattttggaacacaatttatggatggtaattacaggagatgaagaatcaagaaccggcttcacaacttctaaaaaaaaagaaccggcttcaaaaatataacataggttcatcctaataagtctaatgtataatagagatctttataaaatatatgtctactacatcagagttgtcattggagttccaacttcggaactgaaattacatttattcacacagtagaattgaaatactgatttagcttattggttgttaacattttgtgcagctaaaaaatggctgatagtgatcggttcagtgatttactatggatgcctcatgggcagaacaaagtatctaaaatttcagaaaatgtgagttgtctacttagtttggtttcttgtcgatttgtaaatatattcatctaggttcccatgagtaattgtttttatctttgatgtagcctagtagttcaatgaatatacggcaccatcgcgttggaatcccttaccacccattgtgccgatcggctctacaaaatattggtttctatcaaattgcaaagatgaggagtatcaaaattgacaaatatttgatatctgctttggtagaatgttagcggcctgagacaaatagctttcatctactgataggggagatgacaattactttgcaagatatcagttgcctttggggtttgccaatcagtggaaaactaattgtgggccaatctgatggaaattggagtgatatgattgagaggtatcttgggattccaccagaagatcaagaaatgaagaagaaaaagaggaaaaaggaagatgatacatttgcactgagttactcatgatactccataactctgagcaaattgcgtgatcgctttcgtgccatgcccagtaacccaacacaacgggagatcgattggcatagtcgagcacttgtcttagaaattcttggctccattatttttactgattcatctggagatagtgtgcctgcaatgtacctccaatttatggataatttagcgacccgcactgaatacaattggggaggagctgtacttgctatgttatacaggcagttgaataatggtgctgagaaggcaagatcagaaatttttggccctctagtattgttacaattgtggtcatggtcacggttgccattaggtcgtccaaaaaatataattcaaaagacggatgaagtggaggagcaagaaaaaaaagaatcagatggctatcctatatttggggccaaatggtgtagttatcatgaattccccaccccacataattgtggtaatgttttacatatcttttgaattatgtctcattgtagattcttataacaaacaacatatatgtcaacatgcttatctttttatactaatattatacaggcactcaatagtaccgaaaccaaattgacttgattcgagaaggtactgtacaatgacaaccatatgaaggtctcatagagcatatgcctatccaaattcagaatgaccgtacttggtggtttgctagactacctctcatccatttttgggttgtagagttccattatccagaaagggtaatgagacagtttggaagaaaacaattaattacaccaccgcctccacatggtgaggttgagcttcggaagctacgcaaagtgaagcatgtaggaggaaaagggtgcgattggaataaattccatgccaaatatgtgcaacaatatgatgggattgaagcaacaatcgttcaagaggattgtcctttcgacgcagctagcttgaaggagtatagatgttggttccaagcaaatggtatgttcactgtgttttttgattctcaatgcttgggaggacttgaaaactctatcccataccctcgagataacatggagtggactgggtacatgcctagtggtccacccctagctcgcattgtaagttatagatttcttccaattactctttatattgcagtgacaacctagatctgattttaactcataattgcagggattgcgtgagattaaaaatgcagcatggggaatcaaatgttgtattactaatggatgcaagaagataggtaaatctatattgatcacatgtcaggggaatattagggatcttaacttggaatacaaattgcaaaacatgttgtctgaggctgaactaccaattaaggttgaagaaattccatctgatgacgatggcactactgcttgcacgccaagtcctccaaatgaaagttccgttgatgtatttgatgagtggatgatctcaggaaaatgttttagtagatatattgatctaggtgtggaaactactaatagagttcccacaacacaagatgcaagccaagtgactcaatgtttggaaaatgaagatctggtaaaattctaacacttgtgtgtatgcaaattaactttgtaatgtatttaatatatgatatactattgggtgacatgacaggtggcttcaagagaagcatcagctccactgcatcctggtgaaagaacgtcaagtcattcaaaaagttctatccaagtggttgattggactagtactgagaggactcctatgttcaaaaagaacactccaagttaggaagaccatatattctgttggatataattttgtagaacttttggagctatatgttctacatatatgttaactggaaatcagccactccaagttaggaagaccatatattcctgttgacatatatgttcttttcgaccactgtcttatatgggtgctatactatgtaaaatatggtcacgctgtcagtggttgaatggcgtgttactttactttgtactgacttactatattaatggatttttatgttgccaacttacatcccatttgaatgagcgcatgctatttacttcagtttattgccacgatatgtgtgtgctgtagggaacaaatccttgtttaaacatgtgctcagatacatcctacaaatagcagtacagcagcaattctattgtgtaaatcaaatcatacgaaaaattgataaggtaattcaaattgaactgtctgtactctcaaataaatacttcaaaaacaatgttcgttgagctccattcatgttcaaagccaaccagaagaatgtcctattcctggacaactataagctaaattgacactgtaatttatagatagactacacgatgcgtaaaactatatggtgccagagggtccatcaacatgtgttctgctcgacgttgcacctacaaaacaatcaaagagagtcatatatcaagtaaaagttaactaacaattataatgcatataattcccattgtttgctacctaaattgtcgctatctcttgtggaacgggtgtgcctggtgtccaagtcgtcttccttacatttcatccatgtacattggtatcctgttatgctgacgacggcctagatttatctgtctaggatcaggaacaattattggaccagtaaatggtggccattcaatttgatttccataaggaagaaattgtccagcccaggtaatagcaagtgcttgagaagagtagaatggattgatcaactgattttcattaagatttctatgtttgcaaactgccaagacatgagcacatggaacacctgtcaaatttggcttttgacaatcacaagatggtgtgttgttgggttgcaaaactatcttatacttgaagtccctcagtgtgtaaacctcatggtttccttgttgcattgggactaactcttgtcgacctttacctcatatattccaacttcatctccatacgagattacattcatatgtccagccttatttcctcgcttcactaatagcttatcaaccctttgagaccattgcttgccattgttaagtaaattaacaacatttcgccttctctcaacaaaccattctaagcactttgaaaatgtttcctccacaatggctgccaccggtaacctccgagaaaacttaaacacattgttcaatgactcagatccattgcttgtcatcattccccaacaatatcctccatccttgcattgaaataccttctcgggcttttcttgctcatctttatctt

SEQ ID NO: 67545 - DNA, 1117 bp, Oryza sativa
cgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctga

SEQ ID NO: 67546 - DNA, 39865 bp, Oryza sativa
ggggatggggaggaggagggggagggttagggatagggttttcatcaatttggaactgatctgaaccgtcctcggctcagatcgatcgagggtttggaccgtaccacttgggccacacgcgggccggtggtccagcaagtgagaggaggagtatgggagtattaactagacttttacgcttgcgggttaaataagaaaatgggttgaaaaaggcccatagagaaaattgatttttattttgatttttatttagataaatgctgaaatgatatttgtattatgaaaattaccaattaagctatataaattccaagaaaattttaaagagtgtaattaatatagaaaatttaataaaaactaaatccaaccataatattttatttctcacacttactttacttgaaaattaatttaattatatacctaccaacataaaaataccctaatattccagaaaatgtgtatatcatttaattagaatttaatatgttttaatttaattttctctttttttctttccattgcaatgcacgagcacttttgctaaaatttcaaagtgtgtaattaatattgtagaaaatttatatttcattaaattaaaatttaatatgttttaatatagtgttctcgttttttctttccgttgcaacgcacgggcacttttgctaaaccaaaaaacacttttggtcaatctacacactccgtaatcacccggtgcaacgcacgggcacttttgctagtttatactaccaccttaattaataatagtaaaaatatggatggacattattatattaaaaaaataggtacattgagatatatggtctgttcagattatagctaaaataaaccatatcaaattttgctaatttggtaatactgccaagttttggcaggattttttatttatttatcagagtttggtaagaaactaaatagatgcacatatttgaaaactttaccaaaaaatggtatgatttgaaatggatcaatctgaataagcccgtaatcgttatttagcagtgtctataaaaacataatactctctccgtttccgtttcatattacaatgtaaatatactaaaattccacatgtaatttagagacttacaatataatacattctgactatatttcatgaaaaatatgacggcacaaatatatatagtccctttttatatattatgaaatagcatcgcactatattgtttatcaactagcgcacgatacaaagtgcttacatattatcttaactaattaaaatattcaacatttttctatcgtcacataatatgttttagttcgtcggcggtgcgccttcctgccctcacaagtgacgccatcgatctctcatgacgcgtacgatggacaaagattaaaattgaaactgatacgaaatccaatcggataatccctacttagagaacccaaagaaaaggggaaaaaaagaaagaaagaaaaaaatcgcacaaatccaaaagcccacccaatcttagcaggatcacattgtcagtgtctcctaagcctcgatctgcctcacaaaacagaaagctcaatcgatctatctcacaaaacagaaagctcaattcgagtcggctctgttcaaatcacatattgatgaccaaatcaatgcccgcatcatgcccagatggatgcctaaatcaataaaatcattcatttagaactgaataaaataggaaatatgtaaatcattcatgtcttacttagttctcagtcccaacaaagaaactaacatctctaatcaacgatatactgaggtcaccgccgccgccgtgcctcgttgcttgctcgaggccgaggacgaagacgccgccgctcctgctacctgccgaataattaaatataattgaatatattttcataataaaattatattgggttgaaaatattactacttattttctataagcttagtcaaacttaaagcggtttaattttaaccaaagtcaaaatgtcttataacctgaaatggatggagtatctaaaacaacgaatttagataaaatatttcctaaattaatttattttaggacgggaatagaattgtagagaagatcctatatatatacccgcacaaatcgtactcgtagatgacatatgcagaacgtgccggatcacgtcattaaactggtataaaggccgtagcaaccaaaaaagaattgataaaagacagagggcccaccgtatatgcatgtacttatgtgacataaggactatacgtgtcctggaatcaaggtgttacccgatctcttttcaagcgttggccgggtggatcaataatcggtgatcgatgccaccaagcgctatgaccacaccaccgtatctccggcgagtctctccggcggcgagttgctttggctgcgccggcggcgaggcccccaccttggacgacaatgacgtggcgccgctgctggacgtcgagaccggcggcggcgatcggagaggacggccgtcggcggaggagatgaggacaggcaagcagccccgccgcgagccgacgacgacggacgccgagatgatgcacgagtggaacagggccggcgttatggccatcaagtgcgtcgtccgggtaagtgtactgatcgatcgatcgatcgagcccgccgtggatcccaaatttaatcctaatttttatgctctattcattcgaaaatatagcaatgcacgattagacatcagctagtaatacggtgcctattgttaggtcaaagaacaaaggattcagtactgattctttctaacaaaaactagcgttttgtacgattggacatcagctagtaatacggtacccattgttaggtcaaaggattcaacactgattctttctaacaaaaactagcgttttgtacgattggacatcagctagtaatacggtacccattgttaggtcaaaggattcaacactgattctttctaacaaagactagtgttttatgcgattagacatcagccagtaatacggtacccattgttaggtcaaaggatgaaaaagattcaacactgattctttctactaggttgattatttttgggatagagagagtaacaatgactagctagcattttgtacgattagacatcagctagtaatacggtacactgttagatcaaaagatgcaaatgattaaacactgattctttctaccaaagactagcgttttgtattgagccgtctgttaaggatacacctattggagcgtgcgtgtgttgtggtacatatatacatgtatttggagaaaaaaaattatatttttgttgacagaaaacacgatgcctgggagatctgcttaactccagtgcaggtccaaagctcgccttcgggtgtgctagcatgccagttgatttgatcctgtaaccaacaagaagtagaagcaaagaaatcgcggttaaatctataaatgatagccgatcggctaagtgccgatgacacatcatttatctttatctttgagccgatgtcatatgtgtatcgatcggcaatcttgaataagtaagaaagaactaaatctactcgatcagctatagatgttaacgatatatactccttatatcgatatatacttaaatcaagtgattgggatagatcggtcgccatgccgagacagtataaatcacttagaccgaaatatatatattaataacaggactatatatgtctacagcatagccgatcagatagatctagcatgtatcggctaatactccgatactactttatatcaggatattaaaacaggtatagagtatcaagcaaaagcctaatatactcaaatacagcaatatcttggcataaatggcagatttaacatgttaataaagcatataaagcaaatatagttaaatcagataagatcggctgaaactccgatgctaccctaatcggcaacctgaaggcaggctagaggttgatattctaagtacgacttaatagatcaaacttaactgatgcagcattaagtatgaaaagaagaacaatatctagacaatcaaaccactggaagtttcataaagtggtaaatatcttatataatttaggtcaacgtcgctatttaacctggtcggctgccttctaccgacagatgttagccgattgtagattagatagcggtattgccggagattatgtaagatatatgacagctcggcgaattatataaacgagatcagagtatcataaagatggaagcactaatcccgaaaacacaagtcgtcataacaagttttacctcttgttgaagatcgaaaccgatgcagctcaacccgaaaaagaactcgtcgaaaaaaaactaaagtaaaagggtggcgatgcgccgagattgtattgaacgtgtgttaaaagttacatagggctcgggtctatttatacctcgagaattacaagatatgtccataacggacacgactactatctctaacaaactctaagatattataagtctttgcggcagatttttgcccaatcatatctctaaggaaattacataaaacatcctaattaatagatacaattgcctcctcaggactctatccatgtgcggcaatcgccttgaagcacctcaatccaacccgacatcacacatcaagttgtattgctaggatcggctacatcggcttacctagtccgactcaggctcagccgatcttatcgtaaccgatctggactcctgctctatttccgaactcgatctccgcctccgacttcacttcaatctaatcttctttcccaatgccgatattaccaaatttggttgttaacaattttaaatattaaaaaatatcttattacgcattgttcagcctctaaatcagttcgatttgggtaagatttggaaaaaatgccacatgtaaataggacataaatcttttttgcattctctttctaaaaatactaaggccaataaaatttgcctattaccatagcaaatatgcgagtgtcattttcaccatccacatacccgtggatgatatatttgtgaattttatcaaaatttacgtccaaccaaagaggaaatatccaatgaaaacttgtgaaaattatacctagctaaaagttctctaaatttcatgaaaaaattattagagatagatataagcatgaaatacattgataccaaatctcaaattcaaacttaacttactttgagtggaacgataaagacaaattttagatgaatagtcatgtttctatatatatttccctaaaaaaaattttacccctaaagaaaattgaatccgaacttaagattttgtaagaatatatttcatgcctatatatctatttctaataatttttttatgaatttacaaaaaagttatatctgatcatttccctgaatttttatttatttaatacttttcacccgatataccctatctacgatcagtttggaatgttctcattgttctagttcatctagcttgatttagccaggaatctaattaccgttctacagcccctactgccaggagtagaattcaacaatcctttccatctgtttagaacaattctaattggatattttttgcatgcttttgcagggagtattgacagtgttttggctgtatatggtagatttagtgagaagacttttcagtacccacatacttggagccttaatagcgtacgtggtggcaatgttcgtttcgttcacttttggacggtaagcgagtcattggaagagttgcatgtggcaccatttcacactttcatcctacggggagtaagcagcactacgtgaattacaatggaaaattatttttattcctcgagaggttattgtttgcatgtcatttagataaatataaaaaatttgaaaaaaaagagatgatatattaacatgtgatatatcactccacaaacatgtaagttcaaattccaacttatgcatctcgcaaaaaaacaatttattttttctagtcaaatttgttttcgttgcgatatatagaagttgaatttgaacttgtatgtttgtagagtgatatattatatattaatacattttattaaagtttttcataactatttaaatgacatgtaaacaacgagagaatatcctctcgagggatcaaaattaatccactctcaactaatagctatagaattcgcaatctcattattgtgcaacgttgaagccattctacgtgtaagtacatattgcatatctcttctctatctctacttatctctaatgttataaaaattaaagatgtttttgctggtactttggtacgtcatccgtatatgagtcggtttttaagtttgtttgcttttgaaaaaatatatatgtatttgagtcaggttttaagtttgttcgtttttggaaatacagaaggagtcatataaaaaatctttttaaaaaactcgcatgctaatttgagatgagtggactcctaattacagctcatgaattcatgatcttttagagaaatatatatccaagcaaatttcgacagtgattttcaccttaattaaaccatatatcaataataaaattaaaataaccttcacctgttgcaacgtatgggctttttttaagtatataataaaagacaaattgcatatataataatagtccggcagcttctctattttattactccactacggctacatgcacaattggggtttccacacagtcgttattgtttccgttgcaatgcaggtgcagacagtttgcgctgcgttcggttggaacatttgggacctttgccacgcatataaaacggaacgagttattagcactaattaagtattaattaaaaattaaaaatatattagtattattttttaaagtaacttttttgagatttttaacaatgagttgttcagaagttcaggaagtgtttgtgtaaaaataaaggagcagaaattggaaaagttcaggaagtgtttgtgtaaaaataagggagtaaacgttggaaagagcaggaaacgaatgcacccttcagagcaaatagctactagtactattaaagagcacctcaatttatctctagaagtttgaccaaatgcatttgtgaaatatcccatacgttggcaatgtcaatggcttcaacgaatgatgtggctcatcctgattgcactttgtgattcacttttactaggtaagatatggatgtatttagtttgttaccaaatattggtaatgcttagagaattttggcaacaatacatttggcctattctaaaagaatgacaatattaccaacttgtttgttaaattttgaaaatgtttatttaacagtaatcctaacaggcccaactagaaagtctctcacgctgggccttgttgaccggccagttagccatgcgttctgggccaccgttgcctttcctcgtcgccaactcacctgcccggtggctcgcaacgtcactctcgccgccttgaactcgtccgtcaaggcctcccacctccacgcacggacccaacaagaattcgaacaagctcaactgaacaaagcccagtgcaacaagaattcatgcactcgcctcgtgagggctgtcaaaaatgctcaaaactcgcgagctgctcgagctcggctcgtctaggctcgattcaagctcggctcgagcttcagacaaactaagcctgagcctctccttaagctcgcgagttttatcgagccaagcttgagcttccaacgagtctagtaatatatatttttttgttatttaataaattatgagatcaaatatgttatttgtatgccttatattaatatcatatatttattttattcttttttcctcttctattaatacgatgcactagaaattaattgttttttaaaagattatatttgaaatatatattgttttacttaaaaattaagctcggtagtcgagcttgtcagaaagctcgaatattttatagactcggctggagcttgtatcgagttcgagcctagacaaacgagctcgagcgagctcgttgacagcccttgccctcgtctgcgtctggccgtctggtacacatgtaggagtagtactgtttcacaggaagacaacacaaataagtactacaggctacagagttgctgagactgacgatggcctcaggattggtagcagtaaatcgtgcgtgcattttgtaccttctaggagtaaaaaaggagtactactcctagcagatggtataaacttgatgtcttgtactgtacttaagtgatcgagtgaaatacagtaatctaggtctagatacccctacattaaccatgaacaacagtacatcttggatgtcacccaagggactgattcacatcatcaaatgacgctactatctggcatctgcagcaaaacacaggggacccaacttaacccaaagcattcaagcccccatcatcaatctgaagcaagccaaaaagaacagaaacaatcaaacgagagcagtagtagcacaaccaaaaaaaccaggaggcatcaaagagtggcaggcaagtactatcagattgatccatttattattttctcccatttgctgacaaccttgtatcgagataccattattctgattccacgtcgtaaagcattttctctgctttttgtagacagcctgttgaacatgatgttcgcgctgtcgtacagttcgaaaaggttcgtcatccttcccttttttttcgttctttctttctttcttttcttcacctgaattttataaatgttgtcacggggatcgccgtggccaacatggagcagggatcctttcctttctcgtttgcaacgtaccaacagctagtgtaactagacaaccgagtcatctggagaaaaagattgagagccaaataagtgagacaggcttgtaaaaagctcatgtcatttggctgctcgctcagcggtttttgcatctctctgacgtttggctatgcatctgtcggcgttgttcgatagcgcatcctagaaagaaaaaggtttcttgtacagttgtactcaaaaggacagggtttgttggttctgtttgtgtgatttttattcacgctgtatacaaacaaattataatactccatagtgactatggctgtgttcggatgcctgagttcccaactctaatagtgcgcacgaaaaacggagcgatccattagcacgtgattaattaagtattagctaatttatttttcaaaaatagatcaatatgttttttaggcaacttacgtatagaaactttttataaaaaaacgatccgtttaacagtttgaaaaacatgcacgcgaaaaacgagaggagagtgttgggaacttagagttccgaacacagcctatgtttttttaagtgtagtacgtatgctggtactggcaccaaacttacatgttactctatttgttgatgtattccaagcagggctcataaaactgatgaaaacctcccggttttggcacaatttttaggtttagagccaccttgagctgataaaccgctctgataagaaaaattcaaagtgcatttcaatttttttttacaggacttacttgaaattcatcagatttcaatgcttttcatgaaaacaggtaaaaccgcttaggagcattttcttattagataaaacctgatttcaagttggtcattggacctcaaatccttcagtggtgaattttgtgctcccaacttatgagcttaggaattaaggatttaatgtgtgcacacgcacgtgcgggtgagggttcaaaaatcatttgctcgccaaatactgcactagcctccacagcaattttgacggtttttgtgaatagtatctaacaaatttgtcgaagattgaatttcagcttatttttttaaaaaaagaatcgtcagtttatcagtttgtttcttgatgcgagctgaagcgaacttgttctttatttccacgtattagaccatcatggaattatctctgctattataaaaattgaagatgtttccgcggtccgtcattcatgtttaagtcggttataaaaattgaagatgtttccgcggttcgtcatccgtgtttgagtcggttttaatttttatgatttggttttaatctatatctcttctctactgttataaaaattgaagatgtttttgccggtattttggtacgtgtcatccgtgtatgagtcggtttttaagttcgtttgcttttggaaatacatatccgtatttgagtcagtttttaagattgtttacttttggtaatacagaaggaatcatataagaaatatgtttgaaaaactcgcatgctaacttgagatgatcaggctcctaactgcagctcatgattttctatatatatatatatatatatatatatatatatatatatatatatactagaaaaaatgcccgtgcgttgcaacgggtaaactaaaattataccaaatataaaagtattagatgattagggtttagttttacatgatatgagctttttaagaaaatctattcctaatgaaataaaaacaattcaacttaagggacctcaagtgaacttattctgtgcgtgcacgcggcccatgaggcgggctacagtgtgggcggcctgagaacatattcggggacgactttagggacataaagtaaatgtattctctgaggagattacaagcggcccaatagtgtgggcagcctgggaacgctggagaagctgagccgtccgatctgatggacggtcttgattgatcacgacctatataaaagttcaatgatccaaaccctaaccctaaaaacatttcccctccctccctctccctctccctcagtggcggcgcctctccccctccccggcggcgcctctcctccctccccggtggtgccgctccccctcgcctccctcgcgtgacagatccggcgacggtggtgtcggcgacgaccgtgggtggatccagccgcggtggtggcggccgaggacagatccggcggcggcggctccctccgactcctctcgcctccctcccgcgacggatcttacggcggtggtagcgtcgacggcgaccgcatgtgggctcggtggctgttgctccccctccccggtgtggcgacgtggccaggagcggtggtgggctcgggagcggcggcgggcttgggaaccggtcacagtggaaggctacgatgccgacaacggcggcgacggcggcggacgacggacgacggcgacgaccacgaggagggtggctctgggagatggctagggttaggatttggattttatttttgatttggaatgttgattttgtggggattcttggttttgatttgggattgcaattgagtgattctgtgattcttgggaattgggggcaaaggggttgggaggctgatctgctcggggattttttttaaaaaagacggacttggacttacacgacgatgacggacgaaacggacgatcggaggccttacatgttttgaagtaggtatagagttataaaaccaaacgagaccattatgtcgcatgcatgaccgtaaatgcattaggtggtatgttttaacttaacgaagagaacaaaaaagaaatcaatggaagagcatcttttaacttaactaccgtaatagagagaaaaaaaattaacgggagggaaggctactcccatggaacagaatgggaaacaacgtttgaaacgcatgcgtccaaatgcgaaacggaaagggacgacgtaccaaaaacccatggtaaaaataagttaaacttttataatagtagagatatatccaagcgagctctcacagtgaatttcatcttaactaaaccatctaacaataataagattaaaatatacttcacccgttgcaacgcacgggtattttttctaatcaattaaaaaagtctaagtctaacttatttttaagctttctcattgtctgctaattagtttatcagatgcaacttaattttaaatattttaaatttaattttaaatttatagccgattttatgtttttctgtatttttcccagcaatgaattttaaaccgctaataacataatataaaagtttttataaaatatgtgttggttgttttgctccttttctatggcttatcaaatatcagccgtaacttaaacgatgagagcattagtttgagcgattgggtctagttgcctgtcatcaaaccatctcacaagctaactttacatgccttttcaagtttaaaaataaaactccacatgccttttgaaagcctgatcaaagcgagcgaaatatgctgcaaattttaatctctcaaacaaacacaagacattaaacaaaaccaaatggaggaaaaaatgtctggcagagaatgattgatgaacatgaagcgagatcgacaaaacaagttgcattttctttttctttcttttctagtaataacaaagagagaatagagagagaagagatacccatatcgaggagacacgatgcgcatacggtacgccgtgtacagtgtacagcctcccgagacaaaattcccaacacaccctggcgcctcggcgtactacgctgtaaagaagagagaacgggaactcccgttctcttgtccaacaaaagttggataaaaattaacaaaagttggataaaaattaacatttttatggcacgttttttaaactgctaaacgatgtgtttcgtgtgaacactttctatatgaaagctgctctaaaatatcatattaatctattttttaagtttgtaataaattaaactcaatcaatcatatgttttgcgtaaaaaacttaatctttattttcatctttattttcagtagaaaataactccaccgtaagagagaacgaaagaaaacgagaggccgcgccgccgccgcgcgccatacatgtggccattaattcccgggtggccccatacgtcagccacgtacatcgcggtggggactggggagcggggtgcatttagcatattttatcccgtcgcgctacgcatagcgaatattcgaaaccccccaatcccaacaggcgacagctcgtcccatgacgaaactctggcacgcgattttacgtaactgccctcgcctggacaaagcatttcaccggaattatctgcaaagctgcgtcatcactcgattgggtgaaagcttatgttacgtttaactgcttcatgttttcttgggcaactgaaagccaaaaactgatttggtcgaccagccaaggtcgtgacaaacaagacgtctttgtatatatcttgtgtgtttgcttaacctacttttagtgttctcctgcatatcttaattcaatcaaacttttcttgctttagtcaacttataatctagtaaatcggcaatgaggtgttagagacttagagttggttacctaagattgtgacatggaaaaacttttgtatggcttcgcctgggggcttaaataaagacaggacggcgtacaaaccaagcaagtcagccattgtacttgcttataagtattcggtattttgtttgccaggtagaagggtaatgtttgtttggtacgtaaacctgaggattgaaaatgacgcgactggtcacggtgtcactataaatttatagaccttctattaaaaaataaaataaccttgtttcgtgacattacatatgtatagatttgttatactccactagataatatcacacaccattatagattcgtttatttcggagacagataaggtataggtttactctcttcaatttgttaagaaaacaactgttatcaactagtattaaattagtattatgtaagtgtgagcgtctatgtatatctcggcacataaaaatataaaatgtgagtataatatttgtttatcttcgagaggagagaagaccatcacacaaaatcgactatactagtgtataatagattgttttctctgattacatatgctgatacacatcatcacatacgggcaatacacacaataccgatgataataaaatgcactcacatatgtacaagtagggttcaaatctattaacagataaacgactaggggcggaggatcaagtaagactagcatgaggggctaaacaatctgtccaaagttatagcctcctttttttaagtaaatactccctccgtttcagactataagatattttaacttttgtcaaaatcaaactgttttaaatttaactaagtttgtagacaaatatagtaatatttataatattaaaataatttcatcaaatcaataattgaatatattttcataataaaattgtcttgggttgaaaatgtttctactttttttcaataaacttggtcaaacgtaaagcagtttaactttgaccaaagttaaaacgtcttataacctgaaacgagggagtatatggcaaaaaaaaaagatagacggtttaatggaaactcctataattttaacgctgataataagggcttgagacccgtggtctccatggcatgcagatccactattgtagacaacccacatttttttagcttgtacccgatcattttggttccattagaggaagtaaaaaaacagtgttgtgcagaaactgaagaactaaaaaagacataccaccttgttaacacgttcctaaagtttcctgattttctagcaacgcccagaatcaaccaataataaagctcctttaacacggattattttgcacacgtagaaagtttaggccctccagtgccagccactcaggctgctgcattgcatagtgtactactagtcgttaaacctataaaatggccaatgctagtccagtactacctctggttctataataattaacgctttggacaagtttcaggtcaaatttttataaatttgatcatcaataactttaaaaatatttagtttaaagaaactagaacaacatatatatatttatctttaaagcactataataaaagtaaacatatatttatttattgtatatattataatagaaaaataagatcaaagatatattttgtagaccgtgttattgtccaaaacataaattaaaataaaaccggagggagtatctctgtcaaaataatagtccaatgagaggagaccagttcggacactcaaaatgatcatcacgtcatcaaaaagcggccgtccagggacgagggggggtaccgtggtcatttgccgcaccgcacgctcccctcgcgaagcgccaccgcttttcagccagccgccccacgtgaaattacccctctaccccccacgctccctctctcctcctcttcccctctctctctctcctcccccgctgtcccgcagcctttcccaaatctagccgcacgacgcaccaacccacgcccgagccagagccaggtcgccgcgccacctcttcggcttcgccgcgccgccgcgagcgggcggggagactccccacccccggtgagtgcccgcccgcgcagatccgcgcggttctttatatttgggaacagtccggcggggggtttcttgcggttcttggggttggcgggaattagggtttcgttggtggggttttttcatggtggctagggtttttggtcagatggagcttcggttggtgatttgggtgtttctttgttcggaattgcagggagggagagggcggttcgtttattggatgagccgtgaggaaattgggaggaagaaggcgtgatgtttactccgcaggggaaggggtggaccgggtggtcgacgccggctccggcgaaccagcggagcggtggcggcgctcccgccgcgtcggcgccccttggcaaggggaaagggactactctgcgggtcgccgaactggaacaagaggtgtttttttttaacccaaatcctggcttttctttctgttcgtggatgtagcttttgaattccaatctagggccatgtttctttgctcaccaaatgcaatgtgcggtttttcatggcatgctatcagtcgatgagaagtggaagcagtgaaattgagtgaaaaaaaatattagtgtgcctcgtgatttcattttgaaccgtaaatcatttgaacattccaattttcatttatttgtgcgaggccatttctgcacttgctaatgatttaaataacgtggtttcttatgaactgcttaagaaacagagcgctgcctagggtgctacattacattggtgtcattcttatgtccttttaataactcttcagtcatgttaatctattatttgaatataaaataggcttgtagaaactactgtaacaagtagttaggcatgcaaatacctacggaaggtggaatgttttatgtgattgacttctatgttccattataagcattcgatctaatatatatttttcttcagttcttatctctctcacgctggcttcctaaatcatatttactacagttgcacatccattttcttgtttgatcataccattagtagttattttcttttgtgttcatgtccgcagttacatgaatatcagtacaatatggggctgcttttgattgagaaaaaagagtggacagccaaacttgatgaaatcaatcaagcgctgacacagaaagaagagattttaaagcgggaacaagctgcccatttgaatgccatatcagaatacgaaaggcgggaggaaagcatgcggaaagcattgggtgttgagaagcaatgcgtaacagatgtatgttattctctaataatttcttactcttgctgtttatcagtatttcctaatattcgtaatgctgttaactgttgatgactaagcagttttttgaatactatactgcatatactggtgatatcatatactggtgatatgtaaattttatcacagtcatgaatcatgatgtaataatatctaatggtcaaatgaattggttgaataatttctaggttatggtttctccagccaatagtttttaacactgcattgtccttatgtttatgtttaacaaaagttctatgtatctgagcacacagcacttgtcatctgcagtcctttagccttcggaccatgtacttttgaacgcttcattcttgtttcttatcacttcatatttctgaactttgcagctcgaaaaggcactgcgtgaaattcgtggagagatagccgaggttaagtttatgtctgagaaaaagataactgatgctcaatcccttgaggctagtttggaggaaaaaaggttggagatcgagggtaagcttcatgctgcagatgcgaagcttgctgaggcaaaccgtaagaaatctcaggctgacagggatttagaggaggtagaagctcgtcagcgtaggctggagaaggagaagctatattttgaaaatgagtatggcattcttgcccgttttcctttgtctgtgtgctctctactgtgccaagcaattgattattgtatgtcattgatatgtttaggaggaaggcaggggaggaccggatcaagcgtcaggaggattcattacgtgactgggacaaaaagcttaaggaaagtcagaatagaattcttgatttgcagagatccctaaatgatcgagaggagagagcaaacgagaatgacaaacttttcaagataaagcaagaagagttggaggaagcaaaaaaagctctggagcatactaaagctacactcaaaattaaagaggacgacattaacaaacgactagctgaattacatttacaagaaaaggtaatccatatatcactgaatgccttttcctttatcctcatttcacattattacaaattgatagtggaattaaaatacatatcctgtttctattcgattataggaagctgaatcaaagaacaggaaattagaagaaagagagaaaaaaatagctgaaagggaagaaaaagtcagtgcaagggaaaaagtaagtatgataggctaatattgtgtttcttcttcaatatagttatacacttgatagcaatgtctagaccatgttggattgttggttgtgttttgttctaggtaccgtttggtaaactcgattttgtgttaaatatgtgggtttgatgttttatgttctctgttattcagcttgttccctgttttatgcattcactattgcataaagttgcttatcaattggtgcttttatctcttttgtgatctcttctttcaatataagtagcatcatgtccgtgtgttgcaatgactcctaaataaatatactatactctttcatataattgtaccaaccaattctgttgcaggttgggcttcagaagcttcttgaagatcataatgtgaagcttgaatccaaaagacgagattttgatttacaactggagaatgagaagaaatcatttgatgcaatgttggtacagaaggaagctgatttggtgcagagggaaaaagatgtcagatcttcggaggagaagctttcgaaaaaagaacaagtattaaatgaaagtaagaaaaaattggaagaatggcaaaatgatcttgatacaaaatcgaatgctctgaagaagtgggaggaatcactacaaaatgatgagaaacagttatcggaacaaaagctgcagattgaaaatgaaagaaagcaggctgagatgtacaaattggagcttgagagtttgaaagccacagtggttgctgaaaaggagaaaatattgcaagagcagaacaatttgaaacttacagaggaagagaggcaagagcacatcatgcttacagcacaactgaagaaagagattgatgaatacagaatgcgaagcaactctctttctgaggaaactgaagatttgaggaagcagcgtcagaaatttgaagaagagtgggagcagctggatgaaaaaagaactcacttggaagaggaagccaagaaactgaacaatgaaaagaagaatctagaaaggtggcatgacaatgaagaaaaaaggctaaaggatagagaggatgagttggacataaaatacaaggagcagggggaaaatctcgcacttaaggaaaaatccttgatcgataatatagaccatcagcgtttggaaaatgaggaattgctaaagagagagcgtgctgatcttcaacgaaatttgcagctccatcggcatgaattggagatggagatggagaaaaaacaagcgagcaaagagagagaacttgaagagaaggaaaatgagttaaataggaagatggactttgtagaaaatgagctcaaacgtgcagccgaattgaatgaatcaaagattcagaagatactattggagaaaaaacagctgcagaaggaaaaggaagttcttgtggaggataggcaaaaactggaaactgacaaggcagatatcagaagggacattgatagtctgaacactctcagcaagagtctgaaagagcgtagagaagcatataacagggacaggaataacctcatcgatatatttgaaaagtacaaggtgtgcaaaaattgcggggttattatttttgagggcttggatgccctagctcttaaagatagcactgatatagaatatcctagtcttgctgttgaggcggatgatcgttcccccaatcctgacaccttagcccaagagaccggagcacttgttaattcaggtggccgtttatcattgttgcagaagtgttcaaggattttcaagttttctcctaggaagaaggctgagcaatcatctgaacagcaagcagtgaagaacacagactttggtgcaagactagaggaagcatcgcagagcgatgatgattatgagccaactcctgtctatcaggtagcctataactcatttgatgctgaggatctcccatctgagagtggggcatttgagaatgaagaatctgaaaggcaagatatagcagatgacgtccagatggagtcttctcttggagttgcagataattgtgtagatattcatggaactcaatcatttgatggcaacacggacatggtggtggacacaactattgtggatgttgaccaaaacgggaaggactcggcagtgcttcccgttgtagatttggagcctgaaacatcaaaacaaggacggcgccaacaaaacaggaagggtagagcaaaaggtggtgtaaaacggacacggtctgttcttgcggtagttgaagatgctaaagaaatacttggtgagaatttagaagtaaaaaaggatgatggccagggagattcagttactgtgggtggtacacggaagcggcgctttgctggagccacaatcagtgagcaagatgaggacagtgaagctcattctgaaagtgtttcacttggagggcagcgccgcaagaggcgccaaacagctgcagcagttacgcaagccccaggagaaaaacgctacaacctcaggcgcaccacagtgtaagtttctgtatttatcccacgtttaatttctactcaaggttatcatcctttttttaactgacttgtggagtaaattgatttcctttttgctttattttgttggaaagtgcaaatgcggcaactgcagcccaaaccaacaaaaagaaagctgcgaaaaagggaagtaaacagacagtagaggctaccgcagatgacacagaaggaacctcaaaggctgaggaacctgccactgggagcaaaggggcctcccaatcagctgatgatgcatctcaattacccgagtactcgcaggtaagatccattctgcattgtttgctattctgtattttatgtaatactttgaaaggctttcagtatcttggatgcatgcctttctgggttgaggccaagctttctttttgggtttgtgtggcatatacattcaggatcacagctaactcgaaacttgctcttgttaggctgaagctggtgacacacatggccctgtagaggtcactagtgcagagggggtagatattgtggatggtatagatgcagcaccagatgcgatgcctatgacaccatcaggaagtgaacttggagctgaacaggatgatgaggaggacgatgactccgaaaggcggaaccaatcaattgggaaaaagctatggtctttcttcactacatgacaattgcagagggctactgaataggttatttctagcgtttctgttttcgattcatgacatgccattcttggaactctaggttgtgtgcttggtgatgatgatgatgtactagtagattttcccacttcaattatgttctccccctgtaattgaaatatatttgtagtagacatagctttgatgggcgctcacagaagttagcttttgagaatgtacaatggcgcgatgcctgtaactgtcaagggttgaggcttgtaattgttgttcattttgttccaggatcagtttacgtggttgaccaccttgcgaagtttgtggcatttgtcaacgcgggaagcttttttttttctcgtccagacgaccagattgtcttccatgtctttgtgcatcttgaattataggactttgttgactggcagttcttcagcttgtgaaatagggggctcaacagtggcatccaggatcagttacatgcaaagtttgtggcatttgttgacgctggaagcatttcctttttctcgtccagatgaccggattgtctagcatgttcttgtgcctcttgaattagaaggcccttctgttgactggtagttgtgcagcttgtgcaatgtcttatcagtgctacctccatccctcccagtaatacctctattccagatttttaggggtaaacatgattattaaaaaaatatatgtagatttaaatggagatgttgtgattggatgagaagtataatagatagaattaaatagagtaagtttgtgattgtatgcgaaatggaaatatatggtgtaattgaacggcgtagagccacgagttgggaagagaatgttagtgaaaaaaatattatattttaaaataaattttaaagattaaaaattgctatatttggcaggagtagtgtatttttggcttgtatatacgtcagctgtctgggccttccaatggacgtctgcttcgatgcaagcaatcgccggtcttctggcttacgcggctaaggaatatctatgctggactctttgcctttgtccctaaggcatgctgttctgttctgttgtgatattttctttttctttcgagacggtttgtttgcagcatgtgctcactttcatttggcgtatctacgctagcctaaagcaaatgcatgtatgtcatacccacaagtaactacaaattctcttgacttcaccttgcagtatactaaataaaaaaaattgtctgtatttccagccataaattttgcataaacaaatcatatttaccttctaaaaaagaatagtatttccagaaggaaagcacatagtacttcaccaatcttttgcccaaaaaaaaaacaattgagagcaactcggtgtcccagtctagtagctttgtttcttgtggctactttggaacgcaaaaaatctcacaaaaaaatatttttcatataaatcagtttaatacctaaagaaccccagggggaattcctcaggagtacgcctaaaaatacatatgcattgttccaatatttatacgtgttaataaaataaaataaaataaaaatacgtgttaaatatctcattatcccatgattcttaccaggttataggactccgtatagcactttcgtatggtgttgtaatcgcttcattgtccaattttatttagacgtaagcaggcagtactacttatgtacaggtgcggagagttgcatcgggagaaaaagcctactatatgataattcgacggatttgctgttaaatccgagttaaccaaacagaagccgatcagagaccctaccctccgccgatgcgtcgagaagaagcctccgccgccgccgccgccgccgaggctgggaccccgcgctcaccggacctccacgacctctccgacgactccgactacgccgccgccgccgccgcgtcctccagtcactcggtgcgcctctctcccccaccactcgtgtgcttcctgccgttccccgttcgcctcgcctcgcttgctcccgacgcgagcgcgcgattcggtcgcggcgcgagcgaattcgctcgattaggtcgatgatttttgttgggaggttttggggggatttgggatcccgctgctcatcagatgttgttggggcatcggggttcgggggtagtgctctagttccgcacgtaactagttcggcagctgtcacctcttcctccgtacattgattggttttattggttgggtgggtgtgtgcgtgctatggatggcgatgaatgatagcctatgttgagttcccaatttggattgaattgacgttcgtttggttgggtgaactgaatttggtgtttgtttggtgatcgaaggcgatgcggagcgatctggtggatcaagggtcgggcgagacggcgaaggtggatgtggtgtacgagaaggagcgtgtgacgatccacccgacgcagtatggctccggccggatcagcgggaagctgcgcctctacttgcagcagggctccctgttcctggtgagttagaaccccagttagtctgaattgttgattgttcatgaatttgtggtaggttttgatattattgttaccacatttgctgtgaggattgaaccatggtccttttggcttgatggccagggcattcgtgttgctacttgaattatatgttggttggcttatatatctttgcttatcattgtactccatatatgctaatgatacaatatgctactattcctgcatagacgttccttccacattttctgctaaatgtctgatattagaacaagagaactgaaattgaaaatccatatgattgttgttggttggcacctgaatatggttttgttacacatgacatgttatcatattggtacccaagttgcttaattttcttcttcatttgcttatgtctttgttcaaatctgtgtgacagagttgggagccaaatgagggagttgattctttatcaagcaattcagctaccatggaaatagaaaaatgtaggaacaacacaatatatttcttttgtcatacttggtaattgaagtgcagcagtgattacacttgactctttctttacttgcctgactatgtacagatagaaacctgtacactataaaggccttgccattaagtgatgtacgcttcatccgtaagcacaccccgacatttggattcgagtacataatcattgttctctcatcaggtgaagtgctcttctagttgtttgctttcttgtggttagtttgaaactttttggaatttctatagtcacggtgatcactgatcacattagcttttaggtactttatcttacaggctcattgcatttctgcttcttctagctacataatacacatgctgacaaaaatgaaaaaaaatgatttattgtattgatgtatcttttcaagttttgcaggattggcttttcctccattctatttctacaatggtgggcttcgtgaattgtttgcgacactaaagaagcatgtttttattatcaggttttctttctgggttcactctaattaaataattagtcaagctgtcccttgtttgttagtgcctaaattgctcattcctggaaatgcaaaaattgctatctggattatgagtggactataagtgaaatctacatacaacaaatctaccaagtatatccataactggattttcaaagcacttttttttccttctatatgataggatactgtcataaatatttaatatttatgatctaattaacctacacttgggaagatgcttcactggacatttcaacatatctaggagcgtttagtaactcagcctacagaaaactaattaagtaatggagcattagagtgtcatactacaaccaatcaaatgtttacagaagtatcttttgctgcatatatgattggattttctctactctatctcaaggtcggacgatgatcctaatgtatttcttgtcaacgactttcaagatcctctacaggtatgttattatactttcttgtagccagacccataatttctttaagaccaccatgccctcaatagaaactttactgtccttgggaatatgcaaaacaatccttttagtaggagtcccttgtaaagctatatagtcatctttgtttagaagtccatgttctggcctatgtcttgcataagtttaacttagaacgattacttacccatgaacctcaaatccactttatttgatgccttatagaaaagtttgtcatcactggagcttcctggtgttgccaccgtagcaaatgccatgtcacgacagaactcactcagtttcactagttcagttgatgaagccagacatgggagtgatgccaaacatggggcatcttctagcatgactgaatatgtctcaaagcaaaagcacagatcgaatgatccgggtcgtgatctttctatccaagtactggagaaattttctctggttacaaagtttgcacgagataccacgtcaagtctttttcgggaaaaccacagtagtggtggtcatacttatggaaggcagcagcaagaatatgttttggacaacagagcaaatgataagtacaaagatcagcaaataacaccagataaggattctttgctgtcagattcaatggaggtaaccatatctttttttctattgttctttgttattcgtccactacaaattttggaagagagcaacaacagaacaactttttgaagcactcacaagtcatggagacaagcctttaaattttactgttatggttaattcatttttattctaattttttttgtctgaaaacagtaggggatgcacctgcgatatatataaaagaataagtaatacatacagagagagtaaaactaaaatacaatttcatattcacaattaggattaaggccatctgtaatgagaagaaacctaagctaaactagtattatcttctgtcatctgctcatgttcaaaaccattatctgccaacttcctttctattactagaggtagtattagatgtatcttctatgtattatttagcacatatttgttgtcactttagttggaaaacttaaaaaaaaagattttttaaataaaaaatagtcagtttttttcttctgacccctggtactgtccaaagctattacaattttgcatactgcaatgtgtgtaacatcagtttccttgatcttggcagtctaataaaattctagcgtggggaaaaccaagagaacaaccgttgagtgttgatgaggtattgaattctctgagcacttattttacatatctgtccccttatgttcaagtgctctatggtgctaaaattccatgtgctattattctgcttagcgttgcagttcaaataattactagatctgtaactcaatccacaagatacatcagttgtctaacctctaacatacaattggatgagttcaacatttgatttcggatgtatttactatcacagtaaagtattatgatcctcaagacagtcatacttctgttcaatcttgtgacctttgatatttaaacctcttgtttcttggagtcattatgtctttggctcagactctaggcatatgccttggggcttcaagcaagctaagaaatcctgcaggattttagtggaactcaggaactgttgcctcataatttgcaagccatgcttctcctggcaggagaattagcctttagcagatactgtatatttgatactaacaacttgttttctggaggtataaatagattgaaagggatagttacatggaaaattattccttttatccagtaaacatctagttatctgatcatgtcaagcagaggagcattgtgctggatacacacatgaaatattgtgctgcacacacttccattagtgaaaagatttgttttaccaaatggtagtttgacctttttcttcaactcaacggaaggctaagatttagtctggcattttacattaattaagaactgtatgagtttacgctgcacataatgtctttagtttcatggatcttctccaccaaccatctaataattatcatgtattgatcatgttgtaccactgttcctctcagaaacgtcttatgtttgtctgaaatttttattgcacagtggagatccttcttagatcctgaaggtagagttatggattcgaaggcgctgaggaaaaaggttttctatggagggattgaccatgttctgagaaaagaggttttatacttaactttgatttgctataaccactcaacaaggcattcttgtacatgagttttgatgtttaatatgtaggtctggaaattcctgttggggtatcatgaatacgattcaacatatgccgagagggaatatcttgctgtcatgaaaagaacagaatatgaagccataaaatcccagtggaaggtcagtcaaggttcataggttcaatgtgctgcaattcagtgtgcttattaatgctggctaggacatgctactaccatatatattgagtatatttttaaagtagagctcaagtgatgtagactgtcatttgcttttgctcagttttgttagatctgcggtatgtgattttgcttgatgggagcaatgtttctggacatatgattatccatttgctgttctctttatccctaagatcatgctgatagtttgcagtagtaacattacaaatgttaagacactttcagctgttcgtcataacaacaattcatgattcttttacattatggcatacattactcatcttttacatgactattcatgaatcatgattcttcttgatatattatttgcagagtatttcgtccacacaagctaaaagatttaccaagtttagggaaagaaaaggccttatcgacaaagatgtggtatgaatttgtctacttttttttctatctgaacttttcctccttatttccattttagcttcctctctgaccactttttatttttaactgatatccaaactgatcacttgttttaactgttttttggatatcaaggtgaggacagatagatcagttccatattatgaaggagatgacaatcaaaatgttcttgtgctacgggatatcctgttgacgtattccttctataatttcgaccttggctattgccaagtaagtttgcacgttctattacccttcacccgcaattatccaacatcagctgatgaagaaaactgcctgccagtttaagtcatttaagtgaaaaacactgcatttgctagaaagcttccactagatcacataaccctgattcttgttaaatataaggaatgtatacatgctgaatcacaaggcactgcagaatattcatttgttttgtagccatattattacaagtgacagggttaatcatgctacactaaatatttagacctataaagcatgaaatttcgttgtctaggtttctttgtttgtttgctcatgcagcgagcgctctttcttccagggaatgagtgattttctggcacctatactttatgtgatggaggatgagtctgagtcattttggtgctttgcaattttgatggaacgactaggagccaattttaaccgtgatcagaatggcatgcatgctcagttacttgcattatccaaggtattttagaattttccattcttcgagtagataagcagtatcatagtatcacaatagaatttttgttaatccgcatatcctgtgcaaatcttgcaaaaccgttgtgcttaagtcatatcgattgattatgtgtgtatcatttgttatatggcttcattaattgccttcaatcatgcgatgtggccttcgatattatgccaaaaatacatattatatagattgtaaaaaaatgttcaagtgacaagcagttcatgtttatacttcttaaacggcataaaaaaaatcccctctttagttttcataacttttcattattccttattactgccttcaatccttaccatgttatgattatccattatacaaatgtgtctgacaaacactgccagcttaggtgtcagaataactacttttatcaatataggagtattatactttttgtgactgcacaatactaaatttatgtgaaattttctatgtacctcatgcagctcgtggagcttcttgatcctcagttacataactattttcggaagaacgactgcttaaactactttttctgttttcgttgggttcttatacaattcaaaaggtaatatttctatctttccctatttgagttgtatgcattttgcaccttaaacagaaaatctaagttttcgtctttagctttgtaacactatattgctatgttctagttccctgcagagcccattatcttatatagaatccataaaaaatattgaaatctagatgatgaattaatgaaattctctgtagctccaatatttagctacattaagcaaatctaattcctccaaaatgttctcccgaaaatggaggtgcattttgtgtctaagaattagtgacacggattttcaccaaagattttgcctagaagcatgtttcattgttcacacctgttgggctgtatacagactgtatgatagtacgctgctgtcacgtatatcgggtaaaaaccacaggctagtaggaccagtaccttcaagttaccttattagttggtcggttggtccaatggcatcaatcatcgcgcaacaattttgaaagtttatgagctattcctacctttattaacaacaaactgcttatgagctggtgctcaactgaaacctgtaaacttttgacatgaattcaaacctgggttaacctgcaataccagcaccagtggtaacttgtctagaagttaattatcttctgctatctactatacgattttaattacattagtttgctaagaaattttacactgcatcattaatgcagtactccccacccaagcacttgtagaggaaaatgcagcctgcactccatcccctctaatagtctaattaagttactccaatttcttatggattgcagggagttcagtttcgatcaaatcatgctgctgtgggaagttctgtggacacattattggtcagaacatttccacctctacttatgcgtcgcgatcctgaaaaggtaccggtcgcggataataggagagcagatggatttcgacacccttctcaagttcatcaatgagctcagtggcgagataaatcttgaccgggcaattcaggacgcggaggcattatgtgatcaggcaggccctaacggggctgcctgcattcctcctggaaccccgccttctatgcccatcgagacggacggtggcctctacgtacaagaagacgaggtcatgtgagataccggcgattcagtggtcacctcatacgacaactgccatagaaagcattgcactggtttccataattccattgggtgcttggtacgttggtatatataaattatgaaggtgatcaaaataatgaaatctggctgttgtatatatgtacgttgaaatatcagttctcgatgaacccaacaatagttaacacaagtctcttttttttgcttaatggaaatggattgtcttttagacgcctatgtttggcttcactgcgtaaatatataatattatgtcacgtgatacttatcaactggcaaagttttgcagttgggtatttggataccagtaaaatcgactgtctgagtacgatttatagccttcaaggctgtttggactgaagtgatgttgagcacgtaattcgtttgtttcacatatcctccagttctctgctcaactataatccagcaaacctgcgagctgaatgaacacaaagcgaccttgtgaatttgtgatattaacggccattaattttatgtggctctgtgtagcttagcctgcataaaaccgtgatgatattgttttcgtacgtgtcttcctctcgcgtgataatcactctgttgggaaacaccacatccacacgttggaattctaaattcgtttcctttgcatcattgcacgaattgggatcacatgcagtttcattgcactaatctttataatttgtgctttgctctataagaccaccctatgtttgatatgaataaataaaagacccaacaaaacacacaaagtaacataggctagaggtcaacactaataacgcgataatgaaatcgtggatgtgggactgcacccactatagaatctttttaaggatgtgttagagacaacctgtttttttcttaaagataatgtaagttttttttgaactcagtcaattacattaagattaaggtgatataatttttttagaacactttcagcctttgcattactaaaatgcacaaagccgagcatataaaaccacactcaaaaagaaaaaaaatgacatagagcgttgagaataaagaaattcttggagctatcattttcctctagcattaataaaattcattggtgttaagaaaaaacttcttgtgggaaggttggctagagatttcttagaaaaagaccagcccctgcaaaggcaacagtctagaacgaggaatgagtggaggcgagcccggatccagagatagatggatgaatggtgtcgattcaagggttttttctattaattgagaattaaaatgtaactaaatagtcgagtgctattgagggccatcaattcaaagactaaatcgtcacccatgaacaactccttggccccctccttcaaaaggtcggagtattaagagccaccaatccttacgactagatcgtcattcatatccctaggtaaaaaactacttgaccaccttctccaaatgtagacatgccgcaaccacatccaaacacaccgcagtcactagatccgctgcatatggtaggtgttagtgtgtcttcggtgcatttttttttaaaaaaaaaagagaggaaaagaacacaaactgtggggaaatatgttgcgtcaaatgattttttttcttctaagttcaaacatgcaaagaaagatcaacaatatcaagaaactgaaattgccctcaaaactcgtgaaacattgctagccccacatccacacgagctaaacgcttcgcttgcctttaggaacaaagcggaatcttaggttggatctctcggtctgttcaaggggctacactgtaaccatctatccatccatgaacccccgacaagcaatcacgcagaagttcagtgtccgggcaagattttatcaccctgccccacaaaacattctttctcctcttcttgtcatggcaatgcacaccttttctcgagaaattcatctccctttccctcttgtcgccgtcgtcagatgagctgaaattcagagctttttttcaggggaaatttcagagttcgttcagagtaaattgctggtggctggatatgtaatgtgttgtgacgacgcactatgactatgctgtttaaaaatgagaatcgtggactatataatggcgaataattagaggtttgattgtgagcttccagctcggaaggcaactgacaacttattaaagaatttccttttgggaggaactaacttgttaaaccaaagacatctcaagcagcagcagtattaaactattagttaagaactgtggataagttagctgcacattccaaggtagtccttaatccaagggttgaggtcccatgtagtcgtgcacaggctctaataactgaatcacactttctgaagaaagacgattaccatacttgtacaacttgtactaaaaggtgtagttctacaggtaattataagggcaagttttatagtagaggtgactaccacatccaatttcatgcataacatatatcattaaattaagaggtaacatgtattataggttacctctatcatacaatccccaatatctctaacactctcacatgtttattgaagtttgtgtaggggttgccccttgtatgagaggtaactatttctctctcatatttcttctctcctccacctcattatttactcctatgtggcatcttggggcttatgcttagatgcccatagtacttgccctaagggcaagttttataaaagaggtggatgttgcatctaatcttgaccacatcatcaactaataaatgtagaggtaacatgtacaatatatcacatctatactaattctaatacactagccccaatgtttgtttgcccaatctactcttatcctctctccttttgtcttgaattttgtctggtggttgcctcttgcatgagaggtggctgcttatctctctcatctcttctctcctccacctcactattttagcttatatggcatttagaagattgtacttggatacctatagtacttgtcctaaccattgttcttttggcgtactgtgtagtattcagtattatgaatttgccaacttttgtctcctggagagcagaatcgtcagccttttcacttcatgagcaccagattagggtaatcaagacaccaggttagtactagtattataatacctgcatgtagaggatgatttgtaattgtgttagtacaaatggacattagaattttaagggtacaaagtgaatgtttgtgaaggacatcatgagtgaaacttgatgggaatactggaatatttccactctttgtatgtgaaatcctgaggcaggattggacatcgggctatgacgttccctgcatgtgcagaattccacttctgaaaaagagatactccagtaaaagtcatgagattaatcagtggctactgccactagcttagcttagcagcgcttttgtctttaagctgtggctaggctatgacgcgaggcctaaccctgattagaggttcggacactaacacggtcggccatgataatctgttccgagcctctgtgatttctgtatcctgaagcatcacttccttttgtttcaatcggttcatttgcagatgtaggtagtttcagtctcgttgcagaacctttccccctcggatgaacatacaaaagcctataatgcgtcctcggagacctaagcttacaaaaaattgcaagttgcatactgcccgctgccctcatatatgcgaatatgcgatagattgtccaattgaaaagacattttttttcgaagatacattggagatttggagataggcgcatagcttaattagcatggagccaaagaaattttcagagcctgggcaagttgtcattcattgtacatagatgcatcgtaccaagattttgaatacatgtttcactgaaaattccggtgttgcaaagtgaatgtagctattctcaactgtgtagatttttttagtgggatctgtccatccggattcaactcctacatttagcataaacacgtagggatagtatgtatgcataccttatgagggtgtgcacagtgtgcatgtgagtgcaaaagaatattgccgcttttttcttagcactacgtcattgatactaagggctcattctaaactacggtttggataagctaataccttgatttcgttagcaagtttttcaaactaataaacaacatgtttcgtgtgaaaacttcctatatagaaattacttttaaaataatcaaataaattcattttgcaaatttttaataattagtattcaataaatcatatactaatgctcctcgctttacatgcaactaataatcaaaaaccaactcctcaaaggtttcgtggtgttcttttctcctgatgaagataagataaagtgttttacataaaacaaggttgtattaacatatgattaattgagttttaattattacaaattaaaaaaatagattaatctgatattttaaagcaactttcatatataaaatttttccacgaaacgtaccgtttagcagcttaaaaaatatgccactgagtatccaaattttcatccacttttttcaaaaccggttaccgacggccgacggggttaccatgctgtctcacaaaggcgtgagctaactaacttctttgtcaatccgacaaccgcgcatgcgcggccggctcatccattccccagctcaccgccgtccccacccctcccgttccgttcctaaacacaacacaacaccacggtggccccccaccacggccggccgaaaaaccagctcgccgccgccgcccggccagccggagtggcgtgcaagcgacggctttcccctctccgccgcagcaaaatcctggccgtaacagcagtagtgcagtacagtgcacactccagtatggcccaaacagcaacctgggcctcctcatgacgtctactctctctgtcccataatatagcagcctagtactggatgtgacattttatagtacaatgaatctagacatcctcctgtccagattcattatactatgaaatatcccatccgatactaggttgctatattatgggacggagggagtattcatttgattgggccatgctcctgggtagacctggtccaccgccctggtccatgaaccatgatgcttttgcacagccaacaagagaataaagttttttttttttttagatcagcaggagaataaagttggcatggatgaagggaaagaagtagtaaaagaagaggaaaggcagaaggaaaagggaaaggatagttccactcttaaaaaccctaatgatgaggaataagtgggcttatgagataaacaaatggctaaggccactttcagttgtgtgacttgtgtcttagctttgggacaaaagaaaattagagagagaaatgttttggtcccacgttgttgagagtatttaattagtgatggaggaccatggtttggaatatatagttgcaaaacattggttgtaatgaaagagatctcacttagtacaggcctttgtgatctgccaaaaatatttttcagatgtcatttgcgaatttggtactatgtttaatttttttgcagagtggccgcgctgataatcattggttatgcttagtgagttcggatgatgataaagaaggtttaaacaaagacaaaataatatagcattacattttcataacaaggacaatcatgattcggaaatgggaatctactaattaaaggttccatccgttaggtttggtacatcaaaatctctgtagtttattgcaggttatcttcaagtgagtaaaccttcagtcttcttgctcccaattaaaagaagatgcagaaaaaggcgatatatgtatcttaccatctggtttacttcgctatcacttgttcatagtttaggacaaatacgaccaagtactaatttggttatcttttcttttttttgaaagaactcagcaagctggttttatattatagaagaagtgagagaaactgtacagaacagaaggcaggggagacgttcccggaggaattcttcctgcctgcactccctaaaaaacaaaagcctaatctcttaatataatacacttcactcccttggcacctgccatttcccacaaacgaagctcatctatgatcttgctagcaagtgccgatggtgtagattctttccctctgaagatgcgattattcctttccatccaaatctcccaaagcgtggtcaagactgctgaacgtagccctttctgttgcaacttttctgcctcatctgtttgctcgcgctgccaattgaggagagtgttgtctgtggtcacatgtaggaaacattgcggtctgaatttgcgaccaatgtcccgccatacctgctgcatgaaggggcactccatgaagaggtgctataccgtttcgagatttctgaaacagagttggcagaaatagttatttggccagcccctgcattgcaaacgatctgccgtccatattctattttgtgccagcagccacgcgaagaatttgtgtttccctggtgcccaagtttccatacaagctcagcagaatccgaaaacgttttgcccatgaactgcatgacatatgctgattttgccgtatacaagccactggccgaccacctccagaggattgtgtcctcagccccttcatggatcacctctcctgcgttgtggagcacttcccatacgcatatatattcctgaagcagctgtattgtcacccctccgcggatgtcttcgatccaagcatcattagttattgcctcaagaaccgacctgtttttccttttggagtgtttgaagaggtttggggctaggtatttcagcggctgatctcctatccagttggattcccaaaatttcgcctttcgtccatctccgaccgatactttggtggcagcagcaaacagagcacgatcggtgtcatcacagggcggcggggttcctatccatgtttttttccgggcttgtccactcataccagagccaacgtagcctcagcgatcgtgagaacttctccaaacaaggtatgcccaatccaccatgtattgtcggagaacatacttgctgccaattcactttacattttccgcccaaactttcttggtctccggcccaaagaaattttcgttgcgctttgtcaacatcatttaggaatccttttggtggtttaagaacggtcagcaagtaggttggaatggcattgagaactgattgcacaagaaccttccgcccgctttgataaaccagcttgtttttccagccccccatccttgctctgattttgtccattaccggctgcaaatggacccgctttaacttccccgtagtaagaggcagtccaaggtaggtttggggaaaagcacccagctgcccatcgaagttttgagaaatatcttggagatctatgtcgttgcatcgaattggcgtgattgaactctttgttgtgtttacctgcaggcccgtggcatccccgaatttgttcaggattcccaatagggtttgcacttcttggcgtgaaggatttaggaacactgctgcatcatctgcatagagagaggttctgaattttagtgcccgcggggctacgcttgactaatttggttatcatttcaaaagaacagaaatgaatggagataagttaaaagtagaatgtttatctcacaactgacactaaaactgttacttattttggttggccatgagttgtaattcctccatagtattatacttgctctgagatgctcttcaatgagctaataaagtgttccgacggcaaaacactatcttcagtagacagtgacacttaactgaaaattattgagcatccttgtaactggccgtcagctactagtattatatactggactaaggtaaggtgaacgcataaaagtgcatagtattttttaagatgcatgaatttattagccatcagccaatgaaccaaagtttcagcatagattagcaaagacattatgaattagtcctgaagcacacagacgtgaaatgtctcacaaacagatagtacagcagcatcagtgcatcacaccaatgtttaccagattgatatattaagccccccccaagtgatcagtaatactgtacacaccttgacacccttcaaattacatgaaacccaagaaagtaattaacacaagccaaactatgcatgcatggatggatggattacgtacaattaattgcaaacatcaagatgatttcttctctcattttttcttttcgattttgctccatgatagtatgatccatggtcagactctgagcaggtagatgctgagctccgggccgccgctgccgtcagggttcatcatgtagaacgcctccgagtccctcgacccgaccacccgctcgaacctcgcgcgcatgtacatcaggtcgccctcctcggcggcggcggcggcggcggcgtcgtcggggagaacgccggcgccgacggacaccggctcgacggcgccaagaaccctccactcgtcggcgccgcactccctgcgcaccgcgaagccgcactttcggccgttgcagtaggcccgccacgtcggctcctccagcagcgcccgccgcttctcgcctgtacatggtgcaacgcaacgaacgtcgccggtggccgacaggccggccgtcgtggtgttagtgctcgccggcgctgaagaggatgaaggttgattaattcgtgtgtgtgcgtgtgtgtgtacctgggttgattggttgcttctcgcactcgagcgcgaggcggacgaggccggaggacatctccctgacgagcgcgccggtggagtaggcggccatctccaccagcagcaccggcggcgagcgggtgtccgtctgcagcgcgacgtgaacgcggccgcggcgccgcccgaagatggtgcccgtcaggctcgaccccagctgccgccgccgccgccggtgcgtgatcgccgccaggaacgccgcccgcagcctcgccagcgcgtccgcgcgcttcctcgacgacgacgacgactgcacctcagcaggctccgcggacgacgtcgcggagaaccgcgcggccctcgtcgtcgtccccatccccgccgcctcatctccacctccctccctctcctgtccacctcgccgctgcggcgacggcggcttggcgcccagccgcttcctgctcagccacgggaagttcccgcctccgcctccgccggtgccaccgctcgccgcggccgccctggagctggaggacggcagcggcagcggcgaggccgcgcggaacgctctcgccatggcaagccacacctccaaagcaaccaagcaagctaagctagctagctctccctcgacttgtcccctgcgcgcgcgcgcgtgcgtcccgttaataatgggcttttgctgctggctccaagcccaccagtatttggtagggggtttttaagcgggttagaacaggtacaatagcagactataagctagctgtaaacatagtttaagaagataaataagaagagagaaaaacatcgggctatagatttgtagccagctatagcacagactttaagatgcagggtgtgtatgacaggtgagaccaggtattaatagtgtattatataaatattgtatgaatgagttattagattagctgtatatgaattggagttagtaggtggctataatattaaacttgctcttagccgagcagcgcgtctcgctctcgctcccgcgcttttgcaggtggctcgcggccgcgcgcgtgcgctgtcgggtgttgttgggggggggggggggggggg

SEQ ID NO: 67547 - DNA, 41620 bp, Oryza sativa
cgcgtacgtgttcccgctctactcgcacgccatcaaggaggcgctggggtacaaccagaaggcgctcaccatgctcggcgtcgccaacgacgtcggcgagaacgtggggctcgtccccggggtgctcgccaaccgcctcccgccgtggctcatcctccttatcggctccgcctgcgccctgctcgggttcggcacgctctggctcgccgtcaccaagaccctcgtcatgccgtactgggtggtacgtagcctcccgccctcgccctttcagtgattgtgtgctcgtcttggcttttgcttgtttgcgtggggatttcttgctgtttttgcctgatttgagctcctcatcggggaggagattgagggatgatgatgaacagttttttattgagggacctaaaattttagcacatacgaagtagctctcaaattcccaattttatctttttttaaaaaaaaagcgattattgtccttttggagcgtaatttctggatatggcttggttgactgaacgaatgtcgaaggtgatgatcgactagcggcatctgtagaatgttgaaagatgtgcgagttttttaactgtatgattgacaacaacgccggtagatattttcctagaataagcgtgaaaccaaatgtggcatatgtagttctttacttcctgccattcggtagaacatgtcagactttggtccattctttaggtgaataattgttgactatttaaacaatcatgcttgcaaatggggcacaattggttccggtactgagagccacagcaaacctagaactttaatttcgcaaatctgccaactcgagctggtgacctggtgtattcgcatccctacaacttcttatatagttttaagtgttggtgacagattttggcaagttaatgccctaaagttattttcaagaagcagtaaggctgactttaatcagttcaaaattctggttttagtaaattgcataaaaatatcacatgtaaagacatttactgttcagttttacatgagttttctgttgcagcagcaacagaaaactatattatctgtgtgtgccacatatataaagattatgccataaatgaggaggtcaaaatataagtagtaaggcatgcttagtagtgctatctaggttgtctcttatgattgccatgttatatatattaaaaaaaaagtaggtggcagagaaagggggtgaagtgagagaacgtgtcatctcttatacaagagacgatatgagagaggacaccgacacacaagactgagagttctgaggtgagtatgcgattaaaagaaggggaattataatggcatttatgatagagacaaactgttagagatcatataggttgtacgtgaggttattcttgaatcttgatgagtcagatttgtaggagattacattaggggtctctttattttacatggtctaagttcgtattacttgattgaagcattggctgacacccaaatacccaatacaacatgattgagattcctgaatgtgatggttgctcaacttttggtgattttcaactttgaatagccatctgacctgcaacgcctggggatgtcattcattggtgtttgtgaccactggaaggttattgctgaagttggtatgaacacaatttttgttgggactttttccattacaaaatacattgacaatgtaaaagcaagccaaagaaaaacagtgaagttcatgcatccttagctttatacacttactggtaaacatgttctggtcttgtgttgtgtagctgtttattattattatatttgcttgtgtgttgcttttttgtgaccctgaatgtctaaactctaaaatgccagcccattctgtatatattaatgttttcacaatttagagacatacattagacctactgtattgcttttttgcattcgtatcgtattgttttagggaaaaaatgtttgttgttttgagccaagatttaatcaatccaacaagatattggtattacactgtaactttttaatcactgtaaataattttttgccaaaatgatatggaattcctagtcgacatttgatactttttttaagttcagagctcactagaatttccatagaaacaccagtcactttacaatcagtgtcttcatcttcaaaatctcagccgctgaatgaacttcttggacaaaattagtccctttttagtttcatgatcgtcctgatatgttcaacatactcaattcatgaatcaagatactccattaaccgcatagtttttccaacaaagtagaattgtctcacaaagaagccactattaaggcacttattttctttgaatgttgcaagaatttcctgtaattgtaaatgttctgaatctccaaagatccaaaaaaatcgatcatcatgtctcttttccctttttatgtactagtaaatgtaaatcaggcgagcagtacacgtgcatgctatccttatggagagatctgataaagaaaataaattatgcacacgcttagaaggcaattggttgtttaccataaatattttatctgtaatgttggcaagtacgaaaatgctgactagtgttacgtgcatagaacttttatatctgtaatgttggcaagtacgaaaatgctgactaatgttggcaagtacgaaaatgctgactagtgttaaatgctgactagcttcctaaatcatggaaccgcatcttggtaaaattctgtctcaaatgcctgatgagttgtccatatctgatatttcttgctcatgttgtagctcatactttcaagcgagtctttttatatttagcatattttgttggatgcctcttgcagttgtgcatagccttatgtattggcacaaacagcagcgcatggttgggcaccgctgcacttgtgaccaatatgaggaactttcctctcagccggggaactgttgctggtctgatcaagggctatgttgctgtgagtgctgctgtctacacagaaacatttaatggaatgcttcagaactctcccacaaaccttttgctgttgcttgctttggggatccccaccgcatgtgttctggtgatgtattttgttaggccttgcactccatcactggatgaggacaacgcagcagagcacagtcatttcatgttcacacagatctctagtgtggttctcggtgtatatcttatggtagctacaattctcggtgatactttaaaactaagtgacgctattacctaccttttgtttggtataatgatacttttgctcctttctccactggcaataccaataaaaatgactatttatccaaacaaaccaaaaagggaaaagactagcacccttgcactgtcttattcgactgatagtttgtctggtccggatcaagagaattcagaaccacttcttggtggcacttcaacatttgtcactggagccaacgattctgatgaggctactgatgtggatcttcttttggccgagggtgagggagccgtgaatttgaaaaagaaaagagggcctagaaggggggacgatttcacattccgagaagcattggttaaggcagacttttggctactatttattgtgtacttttgtggagttggaactggtgtcactgttctgaacaacctagctcaggttgggatggctgttggtgctgatgatactactatcttgttgtgcctcttcggcttctgcaactttgttggccgtatccttggtgggtctgtctctgaatatttcgtaaggtcagctccctttaaccactttgcaattactttattcattcaatttctatcattgcatagctgacatatatagcaactaacataagccaaagacataacattttctgttcttgcctactgtgatgtactgatattactccatatgaccatatgaggccaaaagccactatcacctcagcacttcctgtgaaatcctggcagactactcagatgagctggccgctgatatttatctcctgcagactggcaatcactttgcatattcctagtcatccacaatcctatgattttttctttactcttgttgttaagctacatgcttgataactattagttgctgcttctgtaaaatgattcgagtaaaacctgattgcaggtcaagaatgcttcctcgccctttctggatgatgtgcacacaaataatcatggtgataaccttcctccttttcgcaactggccttcatagcttgatttatgtgtcaacaacatttctgggcatatgttacggtgtccaatttgctgtcatgatcccgacagtctcagaactttttgggttgaaggactttgggttgatgtacaacttcatgttgttagtgaatcccctaggtgcattcttcttctcagctcttctcgctggttatatctatgacaaggaagcggcgaagcagcagccaggcgtgttggaaccttcaacctgccttgggcctgactgtttcaggcttaccttctacgtttgtgccatcgtttgttgctgtggaaccctagtgagtgtggttttcatagcgaggataaagccagtttatcagatgctctatgcaagcggatcgttcagacatcctcggagtcaacaactccattgatggcacgcgcatgaacacagactattttggagagaattatcagctcggtgtgtatagttggctttcttatcacttcatatcccagtgctgtattgtcctactgttgcttggtccgtccccgttggatcggagagttattttgatttcatctgtacctgttctgtaaagcttgtgatcagtagcagactagcagttaccagcatacagccggctgtcgaagggatgaaacttgggggcgcgtatacatggtggggccgttcttgtgcttgtacatcaagtttgagaatgttgtacaatatcttcttcatcccactgacgctgttaataccatgagtgcaatgagcctggttatgtgtcttcttttttttttcccatggaaactgattatgtgtatgtgtcttgttttctatggtctgaacatctgaatttcagtagatgtgtcccaagccaactcccaacttgcaattactcctaaaaacgatacatcaaaagttcttacaaatacctatgaatgtaaactaacacaacgtgatgagcataacatggagcgacacttccgtcccttaatataagggattttaacattttgcttgcactgtttgaccattcatcttattcaaaaaaaaaataatagaattattatttattttatttatggcttactttattacctaaagtactttaagcacaacttttcgttttttatatttgcacaaattttttgaataagacgagtggtcaaacagtgtaagcaaaatatcaaaatcccttatattaggggacggatggagcatatgatttcttcgattttctgcctggaatatgggtctctccgagtctgtgtctaaattaggaaaaaagagcacctaagttatgatattatcgtaaaggcacatgtagtaagtggtaaggccgcaaactaggccatatcaaataacctgaacatgagggtacatgaaatccaacttcctactccgtcagtcaaaaaaaaaaaaaagacaaaaaagacaagggactatctacagcagaatttttttgtgaaaccgatctccagcagaattttcatccactgaaatgcgcaagtaacagccaaagcactcaagtggtgccaccgtgatgagctgatttgcaacttgcaagttggcgtactttgctccgtcctcctcgtggatgacttgattgccatgttgatgacagtgttgggagggagaccagatccaacgcaatttatcttaagcaggaaccaccgtgcaggcgtgcactccgtgcagggttcaggctcgctcgactggacgttgcgatgggcgtccagttggttggatccgagtggccacggaaccaaatcgcacctgaaattggctgcatcttccagaaccgtgggccgttttgcggtggttgcagcgctccggtgggcgccccgcgtcccccctcccgggcaaaaccaccggcgccgcggcgcccggcgacgttgacgctgttacaggtgggccccgggtgccatgttgtgaagcgttgggacctaccgacagagacgggatcagaattcaatttcttccgtaggacgcgggaaccgtcaacgctggccggtggcacctggaccctgaggccagtttctcccaattcccaagatttaatcttgcacgcaaatcattggcccctcagggagacttgtggaacgcaaaaaagaaaaaaaaaacggtggtaacggcctacggtcaatgcaattgggtcccgccctactccctccgttctggacaagagctgattttttactactgtattgtactaggagaagtagcatctccatcttttttttaaaaacggagtaaacatgaatttatcggagagaagatgaatatgtagtcagggcaagtaaaataagaaaatcattaacacatacattaattgatttctaattattacaaactcaaaatttgatttatttgatattttaaatcaacttctatatagaaagtttttgcataaagcataccatattgaaaaacgtgctaacgtaattcaatgaaaaatctgcatcttgagaagaaaagaccaccactgtgttttttatgtaatccctctgtcaaaaggtaaaattaaaggagaggacaacaatcaaaatattcctcattaatagcagtgaactactccctttctcacaatttgatcatcatttgaggtttctgaggtcttcccaaaatgatcatcttataataagtgctctttgtttatttgtaaagagtaaatatgtatcattaaatatgctacatgtaaccaaccatgattaatttttattggtgccactccatgcaatattttaaacatgatgcaatccacggggcatgaagtgtcacaatagtttaaccgatgatgattaatttcatacggatgaaggaggtttttattgtctttagtctctgcgctccttacttgtcccttctatcccaatataattcaagctaggataggatgtaatatatgatagtacgatgaatttagacatgcatttattcagatttgttgtattagaatatatcacaacatattctttataggttaagttattttaagacagagtgagtaggtaactattaaattgggatagatagagtagtactattggtagtaggtaggtaggcgacattaaagaaataaaaaaaattttgatttgtaaatcaagtgtagataaaaatgtagaagttaatttattttaagataaaatttgaacatcaaagagttgatttatttttgaataaagggtatattccactccatgctaacaccgtgagtagctgtatctcccaacattattgcttgtctatgttgatcattaactatcccaacttattgagggaacacatcgccatctatctctaagagctaaactctagctactacagcttattttaaaattagaatctccccaaacattttagcttttggtttagattctaagggcctgtttagatccatttggaatggcaaatggcaaatggtaaaagttttggtggcaaaagtactagttagtgtttagatgcatgttaaagttttgccattctagcactaaagtgaaagagagaaagagatggggagtggtcccaaagcactttttggcacaatttgctactatggactttttggcacaatttgctactatggactagcaaatgccaaatgtcaaattgccaacttttgctactagtgtttagatctaaaatgacaaaaagtgctacaaaatgacaaaacttttgccattttggaggatctaaacagggcctaagaagctgtacttgtagaagccattaactgggaacccaattttttaaaattctcagaaaccgcctataaactaggttggatatgtaacacatgctaatacaaggaatctggaaagacttcttgtctagattcgttgtaataggatatgtcacatccaactaaaatcccttatatttagggacggatagagtattttttaaaattttaagctcacaaacaatcctttctgaatgtaagcacctttctgacgtatatataccatataaactttccgtataaaccagaccgctgactaaaaaattgcaacgactccaatccgtgtgcagaccattgtattgatgtatactaggagaagctttttcagaaagtacagtagtaccaagtgcaaagcgagatgcttcttcgtgtgcacagcataacagcttttccgctgtggacgtagcaaaaaaaaaaaaaagaaagaaaaaccgcaaagtcaagtaaacttcatcaccacaacaaaaacgaggcccacccgcacccactcgcccccgacccgcattttattttctcctcgtctcctctcctctcctcctatcctccgccggacgcgcacgcacacgcacacctacgcatcgccgcctcctcctcttcctcccactccgcggaagcgcgtaaccaccacctcgttcgttcttatctccaaagccgaagacccaccgagccgatcccgacgcttcccccatggctcctccgctcctcccccgcggcgcggccctcctcctcctcctccgctccgccgcccgacggccggcggcggcgtcctcccgcggcttcctgtcgagcgctgcggcgggaggccgcgagggggcgctggccgccgccgcggtggcggtggtggggtccggcctgggtctgtggctggtgcccccctcgctcgcggactccggcgaggcggtggccgacgccccggcggtacagatctcggtaggctccggctccggcgcggtaggcgccgtggaggagcgaggccggaagaggaggttcctcctcggaggtgagcttcgcttttgcttcttatcccccctccgcgatttgcttcccgcttcacgattgatctcgcgattgttctcatggagtgcgtccgatcggtttgcgcgtcgccgccgccgccgccgttgtcccgtgatgcttgtttcctttacttctctactaagctttacggacgctttgtcatgttctctgatttctctcccgtaaacagtttgcgtccgtagcgtcgctgctacttttccgatcgtctttttagcactttaattgctgggatgagctggtggtgatctgcgatccgtacgacgatttctttgctgcgctgatctatctgcagataagcgataagtgacaaacatccgaagagaaaatccaaactagatgatgcggccgtttgtagtgttaggaaagtctttggcgctttctgcttctgtctgagtgcgttaatgcttctcactaccattatatttgcgcgttgaactcaactgctcagtgaagttgtagaatggtttaatgattttaattgcttttcttccacagactcgttccgcagaagggtgttcttcaattacgagaaacggatacggctgctcagccctcctgaaaaggtaattaatttggttcattaagtgtaaaacccgcttaatttgtgttggtcggcttgtggtatcctaattcaggtgtttctgcgagtagatctttgaatatttcgcgtctgtgcggaacccggaaggggaagtattcatgttgcctgctgacttgatgagagcagtagttcctgttttccctccatcggagtcgaacatagttcgggagggaagattaaggggggaacgcaatcctggagagttgcactgtgctccatcggagttcttcatgctgtttgacacaaacggtgataggctcatctcctttgccgagtaagtgtattttatccacactaggtgtaatacttaaatcacttgagtgttttcagaatgtttcaattaaagggttttaactttttcctaaatactgccgctgggatctttgcatgattccctttgagacttatagatgaagatcccttgggtcaatatcataaatatttgcaccctattttatcattggcttaggttcaatttctaagtaggcttgatgctgattatgcttatggtggttttctaggtacatcttttttgtgacattgctcagcatccctgagtcaagtttcagtgcggccttcaaaatgtttgacgttgaccacagcgggtgagttctatttctactatcgcacttgttctagcaacatgtcttgctgtcagaatgatatgcatctgctcggtacctcatattgccctgtttctagtattactagtcttggtctagtaatatgaccctgctgctagaatgatgatatgcatctgccatataactgttctttaattaataaacctgatatgtttgcatgtttaacaacatcaccacatctgttagttaatggtaaaaacaataggttactgtatataccatttttggtggtttagttcagcattccttttcttttcatgtgtacaccttttattactgaagctgctaaaggtatgtttccttttgtgctcttggatttgtgcataaacaaggacacgtttaaatattgcctttgtttgtgctatattgttgtttacctgtgaccattcgcatgcagttaatttctcttctcgtccagaaaagaccagctctttatgagcatctgacttgttagttgatggtaaaagaagggtatgaacaaattttggccagcttattctctgttattttgttgtccttatctgttacttgtcattttcagggagatagacaaagaagagttcaagaaagtaatggcactgatgcgatcctataacagacaaggagccaaccatagagatggcttacgtactggactaaaagttggtcagcctgtggaaaatggtggagtggttgaatacttctttggtaatgatgggaacgaacctctacactatgacaagtttacaaattttttgaaaggattgcatgacgaggtgattcatttcttctgttcttcaatttctgtaagaatttagtccaatgacttgtcatgaatacccattctaataactgtcttacgactcaattaaactgagagtctgagaccgtatttgcattgtgaaatgtataacacacatctccatatgttttacatgtttctgaactaaaaacacctaactttatcatatatgaccaaaggttccaacgtagcatattgtgtctgcgtgccctcatcgtctctatacttgctgaaactttgtatcctcattccttttggtaggaatatatcactatatcagtaagctagctagtggtacatactacatactgatgttattgatcaacgtacataaaagaacaaaagaatctgtacaattatttgttagtagatgtttcctatgcgcaattctgaatctctcttaatccattcacctgcagatcattcgtctggaattcagtcactatgacgtcaagtcatctaatactatcccagcaaaggatttcgcattatccatggttgcttctgctgacatgaatcacatcaacaagctacttgatagagttgataatttaggcaatgatcctgatctcaaaggagtgcgcatcaccttcgaggtttgacttttgcatgatcccaagctgtacttttctttaaaattctttttccttgtttgatccttagttcattgctgatattccttggggtctttaggagtttaaatcctttgctgatttgcgacgaagattggagccactggcgatggctatctttacttatgggaaagtaaatgggctgttgacaaagcaggatctcaagcgtgcagcgcaccatgtaagtttggctactaagttcatcgtacttaaattcgatatctccaagcaaaagaattgattttgaggcttttcttgatcaaataaatggtctccatggtttttttgttatcttaatgctcacttactaaactgataactcctgctgctcaatacttgattactatcaccattgtgcatccactaagcgattccattccctttttggtttgtgatgtaggtttgtggtgttgacttaactgacagagtagttgacatcattttccatgtgtttgatacaaatcatgatgggaacttgagctcggaggaatttgtgagagcattacaaagacgagaaactgatgttcgtcagccagcgacaccaggctctatggggctgttgtcttactggctaaacttcaacaagtgttcttcgcttacacagatgctgctcaagtagattgttttgatccttgctagattcttcttggttggatttccgtcacggtaagcacatcaaatttacctaccgttaacttcttccgtctgaacatgctatccgtttctgacgctgttcccattgatttcaggagatgccgaagcgattttgctgtaaatatcgtgtgggttgtcaaagggtgccctgtcacatagcagctgtaaatattttatagcgcctttcttgcaggggtagattaatcattcttgtaaattaaggcctatgcaaaatgtaactgatactctgataagacttttgaaaggttaaaaccaactttatcgccgtggttcgtattatgtgtttatactgtgattttttttgaacgatcagcagcaccagaccgagcgatgattcgttgaatagagtaggaaaaaattacaaaggtgctgtgtgctatctgtaggttttaaacctcaaactaggaacaggacggtcaacggcaacaatgcgcatcacaaactctatgcgactatgcaagatatagctgtacgcaggagacgcgccatagttcagggcaaaagttgggggaagacaagatcacaagagaggcagcaacatgtaaggttgggcctgcagtttggccatcatttcctggcgcagcgtatgcatgctgcacaaatcgctgtggagtataaattggctttgcattgcgcggccactctgcccatgtccaatgatagagctggctctccatctactagcttgtaccacctgactgcctgccgcctgcctgccggattgttctgctataaggccaacggatggaatgcttggctggtgactgggatccaattcttgcctcagcgagactatgcaatccttgcccagctaagcctcagccggagaaccacacaggcccgcagttacccaacgatcggcgcctagctgcaattccatatagttgcaagcaaaggggtcagcagtttcagaagatgatagtgcgaagtataacataagtaacggtagggctgtcaaaaaaactcgaagctcgcaagctgcttgagcttgattcgttataggcttgattcgagctcggctcgaatactagacaagccaagctcaagcctaggctaaggctcgcaagcctagtaagctcgagctcgaatagctcggcatggcttgattagcataagatacattgcatgtaggaagatgttcttaatgggtcaatgtatacttatcatcgtgcttgacctgctcaagtctcaagacctcatcaatgcttcttaataaagcaattatccggttgctagtaatagtactactattcctattagatgtagtagctagcttttgttaattgcaatgtttcaaatccatgaattcatgagaaaagctgcagaggcttcattcaagacaagtagcactcattaattttgactaccgataatttgcattaatatctcttatacaagagtaaattctttggagtttcaccaagtcaagctgtcaagctcgagtaggcacgaagctcgcttgagctcgaactcgagctcactcccaagctcgatcaatatccaggctcggctcgagctcggctcgagttcatgtcaagctcaagcctacatagccaaactcgctcgagctcggctcgttgacagccctaagtaacggcgctccgtcactccgtcccaggggcgacgcgggcggcgaaaacgccgccgcctctctcttcccctcctctctcccaccttgcagccgccggcaaagccaggcggctgcaaagacggctgcggcggggctcctcttctccctcgccctggtgcaacggttggggcaccgcgagaccggatgacgggagcacggcgccggcgtcgacgcccagatccagcgccggcgagccgggattcgaccctcccttggccggatctgggctgggacggcgacgacgacacgagggcagcgcaacggcggcggcaacttcggagcgagggccgcgcggccggtcagacggtggcgcgactccccgacggcggctggaggcgcgggctgccgggccggcggcgactgcggctgaaggtggcgcggctgcggtgcgtcggctgcagctgaggctgcacggcgtcggcgtcgacgacactggaagcggtggcgccggtgccggatgcggtgcagcggccgggatgctggacacatttgccggaggcgtagaggcggctggaggcgtgaccgaagacactgggcggcccgggtggccgttggtgggcggtgaggtggcggcggagtagtggcttcggtgaggccgctattgggcttggcggcggggtagaggacgctgacgacaaggtcatcttccttgtggttggccacgcgttcactgtgtttggggagctcctccccttctttgtggggagcttttaggcacggtggaggtgttggctggcatacagggaagactcaggttgctaaggcgaggttgttcctggtccggtcccataggtcggattcgacgtagaggccgacgagcgacgtggaggcggcctgggtcagcgtgctagggagtggcggcagggtagaaggcgctggcggcagggttgtcttccatgccgtcggccaggctaaccctgtttggggagctcctccccttctctgtgggaagcttcttggcaggctagaggcggtggtcagtccataaggaaaactcaggttgctgaggcaatgttgttccctacccagactcccttaggtcggattcgacagggaagccggcgggcggcgcggtggaggcggcctaggtcagcgcgctggcaaaggtgatgggtgttgtggaagtcttgtcgttggcaggactggaagccggctgacggaggggcgtcgatcgagtgtggcagaagccatgtgtcgccgatgtttagttgctggtttcgaattgggcgacgaaccatagcgatagggattctgagcgaaagcttagcccaatctttgggccaacagtgactacattttcaggcgtggtaaccctcctaagggaattgttgagcagttgaggtacccctcctccctccgcaaggagctctgggtgaaaaccttgtccctttttgggacggatgatgatggcgtctcgcgttgcaaccctcgcgagggcgtcgttttagagtctttgcgccgaggtggtgttgttggcccgatggcgatcggtctcgcatagcgacggccggttcggtgctcggcttccctctctgtatcgtgtgtttgggcggttggcacatggttcgaggtgtgtgctttggtgcactttcttcctcgacagtaaacaactcatagggcacaattaagcctgcaggtaaatatcacacagttgatgaatgcaaggacgcacagaaatcaactccgcacatggaaatcgaccaaaaatgagaactgcaataactcggattcatctgatcacatttatctacatatcaaaatcctgtggggctacttcagagcacaaattcaggaatgaccactgtaaatgttccttctcctcacaggacaacagattatgatggcatatatatatattcatccttattattgccggagaaaactaccaactcaagaggaggcacctactactaagctagtactagtaactagtagtaatacatgcatcaagaggggtaattaaggacataaaaatgaagacaaggaccaacagtgacccctccttccctgtgctgtgcacactgcacagagaaaaattaaagatcgatccatccatctctaatagtctccactaattttaatttaattcttcttctttgagaaccaagggaggaggaaatccaggtgacagatcaacggggagaaagaacaaatcaagaaaccagtgaaaaaaagaacacttgaagctgttgctgcatccgtgtcctcctgcttctccttgcgacagcagtagagcttcaacggcgccatggtgagggggtgtgatgcggtggcgtcccccaccacgcctgcaactgccgtgcaccattgccaccaccaccgcagtagtgcgcgttcaagaaaccctaactttggaagaaaagggagagtggaaggggaggaactcaccggggagaaggtggccaccggagaagacagctacccacggagagcgtgtgttgttgccgctgcgtccgggttgcgccgcgccgcgccgcgccacgccatccccgccgcagcagcgccccctctcgttgtgccgccgctgcgttgcacgccctcgagagggttttttcctcgccaccagagaagctgaatatttcccggcctattacacggggaaaacaccccgtgggccgggataaaatctcgcatgggcttaaccgaacgcctattcttgcgtgggccggtattcttcccacgccgggttgatccacggggatcgggccctgatcccggccgttcccggcccaaccgaacatggcctaaagaagaaaaaaatcatcacactccaaatttgatctcctgaatgtttagattccttcatcaagttcatcttcgcctataaaaatgaaatgaaatcagtattgtttaaaacatgcccaaaagcatcccctaacactgaagtaactgttcagattatgctcatatggtattcaccgctttatgcttcatttgtatatggagtaatagaagaaaacaatattcaagacatgttagctatgtgaccttgttaaggcgatacatatgattggaacaatagatttctgatctaaaataggtaagtgggatttacgtcagaaaagaaaaaagctagattatgcactttgagaaatgcatatagctttttgcacaataaatacatatatttaacatgatagcaaatcagcatgtcccagactaactttctttgccggcaaggttttctgccaggaacttgatccgttttggatcaatcaggtggagaactggtgtgctctcaataacactaagcacaacttccttaacatcaataacattatagcgatcctctttgcagagaaactcaagagcaacctggaagccattcagaaagaaaaatccttcactttctctcacctctccaagatcagcagcattataggctttggatctatcttcactaacttcagcctgacagagttccggagaatatgaagtgaatcatgaatgtctttgtacagctaagagtcacccaaagaaaaacaagagtcccacatttgctatcattttgtagaactttcaacgtagaatggactttggcagccatgtgatcatttctattttgcagattaatgttaaagccaagtgatggtccatgccagtctggctattaaatctttattctttgatcttgcaatatggtagttagtaatggaattaaagatttggaatatagctggcagcttagtgatgcccgcattgcaataaaatcatattatcagccttgtaaagctctcaaagttgacatgtaccaaaagttaacttattttactatcggaaggatccaaaaagaagaatgacaatatagcatggcatgcaaagggattatagtgaaggccaatcagcaatattgattaacatgatatgatagcaaatatcatagcagcaatatggaagcataagggtagatgaagcactcactcttaaatccaactttttaacttgttcattgcagaattgtttgagccaagtgataacactgggatctagagcttgattaatagcaactccactttcacagatccaaggatgtcctgatatatatatatgtatatatatatatatatatatgtatatatatatatatacatatatatatgtatatatatatacatatacatatatacctacatatacatatacatatatatgtatatgtagagcttgattaatagcaactccactttcacagatccaaggatgtcctgatatatatatatatatatatatatatatatgtatatatatatatatatatcacatatatatatatatatatgtgtgtgtgtgtgtgtgtgtgtgtgtgtatgtatgtatatatgtatgcatacatatatgtatatatatatgtatatatatatatatgtatatatatatatatatgtatatatatatacatacatatatatatacatacatatatacatacatatatatatatatacatatatacatatatacatacatatatatatcagtcaacaaatcaaaaggtttgtggctcttaaataattagtgaaaattaaaattatgtatcaaaatatgttatgaacaatgtatagctactcagcaatatggacaggcaatgaaacaaaagggcaactaatttaggtgaagaaataggtcaattatacttacttagcagttagcacttcatggcccttcaaagttcaaatgctctgaagaatattgagagagcattttccctatatgatacttctcattgtcagatatctttagaactgattgaaaatcaatgagacccttcagaactgcatcaaatattttccttgttgtgtctctggaaaaaggataggatgtgatcactttagcaattccagaatatattagattcaaatttacaacacataaggttttagataactcacctgcccaaaatggtggcactccactcatcaaaacgttaagtaccactgtagctgaccacacatcagattttggtccataagtgcagtacctaagattctggtctataacatatctgtgcagtacctcgggagcaacataatatggactcccaatcaactcggtgaaacctgacctgcaaattgtaaaatggaaaatttaagataaaagttaaaaactaatttatatatccacaacacttcacacatgagctgacacatacagtgccagaactgtcaaggaagatggataaacaacagaatatagttaggatgctcttgattatgttggcgtgcaaatactatccacacatatacagcaaagcagacaaatactctctaaaattattctgtggagtacatattatgttgatctgttactctctaaaattaaaaataaaccactacacatgcattaaaatgtagcataagaacaccacctggtttgaagaacacggatgtctatcgccttaattgacagaccatcgtctttaatctctgcagcctacggatgtctatcgccttaattgacagaccatcgtctttaatctctgcagcctttcgctcgttataatgcccctcctcctgaatcttgtccaagagctcaccaacaatgaagagctccatcacaatgtgcaccgctcggccatcctcacatacatccttgattgcaacaatattgaagggaggaggagagcgcctcgccgttgtcggagctcgtagctgccgcccagctcctacccacctgcgcgccaccatcgacctcctcacccccatccagcgacaaggagaagggggcatcggttggccgaacctgcgctgccgctgcagccagctcgaggagttctgtcgccgtgccgccaccaagcttaaggggaggggcgacgccggcggcggagctcgtcgctgccggagagctgctccccaatctccgcacgcggtcaccgtgttcctcgccccgtcatcgagatcctcggccccatccagcgacgacgaggaggagatggcggctcgccggcgcgtggaaggagagggttcgcggtgatctcactggggtcatggagggaggcgtgccaaagtggtgcagatggagaggagcggcaccagcggggacatggaaaaggaggcggaggcggcggccatggcggggtggaagagaaggcggcgccgcggcggcgtcgttgggagcgcgagagaagagagatggacatatagggattgaacgtttttgccaaaaagacgctaagctcccgtatattacacaagtccaccacatcgattactcatcgtagattatcgatccgtttccgttgccgaatcggaacaaaagacttacttccctcgctgaatcgtaacagaagatcacgccagccctcttatacaaaagggccggcctcgacgggggaggacgtacagaacccatcattaatctcatcgatcctctagttagctttgtaaatatctatggtctcctttggtgacgagggagcaacacgcttgtttccaaagccttctcctccggtgaggaggagaataatacggttgtttccatagcgtacgacgaggggactatagcctcctcctccggtgacgagggaagcaacacgcatgtttccaaagccttttcctctggtgacgaggggagtaacatggttgtttcatgacctgcaacacgcatgtttccaaagccttctcctccggtgacaaggggagtaacatggttgttttcatggcctgtgacgaggggagaaaccaagctggtggtggtcttccccacggcgggactactgcatcggaaacgccggatctgggcactcctcctgactccaacaacgagactagtggtatgtaggaaactgcggcggctgcaagcaaagacgtacccaccatccactttgtgcacgcgagctccggcgacatggatcaccattgttcatcgttgttttcccctcccgcttactgcaattcctactatcccccgttgccgccgcagcccgggagcctggcgaccaaccagatagtggcgaggttgatggctcagatgaactacgaggagggcaccggcctcggcaagtacggccacgggattatcgatcccatcaacccgaccaaaaagtacgggaaaggaggcgttggcaaattcgagtcgtcgtacgatagcgattcagattacaacacagggccgcctgtagagcccaagctcgagcggggcaccggcaaagcagagccgaaggctgttgtcaatgccgaggaggtccgcgccatggacacgctgcagagagaacgcaaagcctatgccgccgcgcgggcgcgggagcggcgccacgagaaggttcgggcctataacatgcgctggcaacgcccaccgaaacatgacgccgccgccgacgacgactgggaagtgtaacatcccggcctagggcttaataggattaatagaatactcatatcaacaaagttgcaacttcttttccagaagccaatctccaaagaactctagggttaagcgtgcttggcctggagcaagttgggatgggtgaccgaccgggaaattcttcccgggtgcacacgagtgaggacaaagtgtgcagaaaagatatgtgttggtctgtgagggcagtctatgacctatgaaagctatcagatgtaagcgggggcgagggcagtttatgacctatgaaagctatcagatgtaagcgggggcctgggggaaggcgggacgttacaggaggggataacctccgggtatacggccatggcagtctatgacctatgaaagctatcagatgtaagcgggcccggcctaggggaaggcgggacgtgataacctccgggtacacggccatcaagcgcgtcttgaaggtggtcctggagcagagcgagtcggggaagctcacattgggcggccatggcagtctatgacctatgaaagctatcagatgtaagcgggcccggcctgggggaaggcgggacgttacaggaggggataacctccgggtacacctccgggtacacggccatcaagcgcgccttgaaggtggtcctggagcagagcgagtcggggaagctcacattgggcggccatggcagtctatgacctatgaaagctatcagatgtaagcaggcccggcctgggggaaggcgggacgttacaggaggggataacctccgggtacacggccatcaagcgcgccttgaaggtggtccgggagcagagcgagtcggggaagctcacattgggcggcctgatccatgagttcgcgggagtgaaggcgaagttcccggaggagtacaggacgaacagtatgccgtacaaggcgatcagcttcgcggcgccgctgctccactcgcagctgagccggcagtacagcgcaggtgagtatggaggcacggagccgttgctgaaccgtacacttgtcatggtagaagcgctcaaggacacgctgggagcggacgcatcagcggcgtaccctcgcctgatccacgacctcgtgatggcacctcccttggatgcgtggtggtggagcgctgcctccttctgcaagctaccatggattccatcctggatgaggtcatcttgcccacgctggtagccgcggcggacgtgtttaggctgacgacgtggtcgagtaagccgagcgtttgcgtgggcatgtggattcctcatctcggccacgcccgcctacgaatagtgtacatcattataagcaggcggctcagagatcacctgtgcggcgggatctctgactatgactacaagcttgcattgccatggaaaaaggtgttcgatccagcaagctaggacgaacacattgagcggcacgtgctgcctcttctgaggaaggctctccatgatcttgagatctcagtaagaatgacttggctacaaaataaaaacttcttccctcttgtaatgaggtgggcatccatcgtgccggtgaagtacatggtgccgcttttgatacaagggttctttaagaaatggatgtactccaactatcggtatctaatgggagagaggccccggctggatgaggcgatggcttggtatgaagtgtggaaaggacttttcacaccggaattgctcgcggagaagtgtgtggtcgtgtagctcgaggctggcctcgacatgatcaaccgtgcgatgcaaggactagagataagcgtgtcagaacattagtaacataaactgctgaggcctatgcgagttcgagatgctgagcccctactagtaagaagcttgtatgtgttatagatattgtgtttaccgaggccaattcatgtatgccatctactatcatgtaatcgtgatatgaagcttaagttcagtttttgcctctttgcttgttatatctatactatgtctatgaatgccatttttactggcttttgatttgaaaatgaatatgaaatgatttttaggagacgttttgccagaaactaatcgtaaaattctgaaatagtacgtagttagcaatcaggaaagcatgcaagttgtacttgtagatagagcagcatataacatttgacaacagagttgtttaattttggtttctaatgaaaatcaatcaagacggcatttgatattcccttttctaatggttcctttttggaacctcaaaatgtgaaaccgtctagggtggagaactgaagaaatttggaaagatttcaaacagtacgtcatcacacgtcgccaacgtctatattccctcttcctcgctcgcattatcttcttcccaccagcctgggttatcctgtacgcttttgaatggcttcctgtttcggtgtttctttccaaatcagctgcttgttagggttgccagtttgccacacagccacagctgtggcgttggcgccgccccattgacctgagccagcttaattacatttcgggatgtaagacttttcttgtaaccttttcttccaatcttaattacattgaatgacctcttagcaagcaaaggcaaatgtaaaatacatctagatctcatggttcataagcttaactctctttactgtatgtaaacaaggacgagcttataatataatcgcgtaacctgagcaaagataccaggtacataagcagaacataactgtatgtcagagtcacagtgcggagggacgcttcctcgcgcaaagcggcgtaaagtaccacctgtgctgggagatcggcttctcgcaagcccgcaattgcacgaatcagagtaccaggtagcagctggcgttcgcttaaaccggcttaaaattcagttgacgaaaggagtatggactatgataccatcagccatcaggggaaaaggtcaagcaacaataccagttcattaacacgataacacgaaacattacataacatcgaaaatgcagaggaagcacgccatatttacagttgttccttcccatcagcaccgctacatatttacacggcctaaatacgtgccagcccttcaccactaggccatccatcagacccttcagcaccagggcgaccagacacaccgatacaagcaggactgacgtacagatcactcgagcttgttcttgtgggaatatgtacatttgtcctgctctaagcaggtggatatttacatgtggacacatgtgcagctaccagattactcgggccgcacactgacgagattgggcagggcagccaactggagcttcttgatctcaatcgcggtcaccttgcaggactccagagacaaggacctcaggttctggagtggcttcagatggtggagcccagaattcgacacccgagagttcgacacgttcagggagaccaaggcagtgaggcctgtacacatggaagatatgcaaataaatagataaattgtgtgttgaatgctttcattcctgacgagcgcaaaagacatacgggaaatcagctctaaggatttgtcagtgaggttgccattttgagataggttaagcagcgtcagagctttgaggtctttgatattcttcactccagcatctgtaattaacccaccgcagacctcaagggactgtagattcttgaaatctgaagaatgcattagcaaacagatttaagtgctacgtgatattttgatgcataaaaataacgagaatcccccaaatttccaagggaataataatttcccagtaaaatatgcaccaagatgctgtcatattcaatgctaataatagcaggggttgagaaaaaaaaagttccacagaatgctaggttaataggatttgctttatgtgtgcacaatgataagctcggtgctacacaagtgcaaaaaggcccaacgtgccattatcttaactcttatagtaaactagcttgttccgataatccaaaatcaccagactagtaaacagaaccttagcatggaccaactttttatgtgcacacttacatttcaagcagtttgtcccagcatcagttatacgagctccaaatagatcaaggtgtgtcaacccagtgagacctgcattaaacaaatgtcacttcaaggcaaaatacaaccaaaggactacacaacgatacagaactggagaattcagacgataaccttgtagccaaattcttactcctactacaatgcacaacaatcaccatttgattaaagcgaaacatcaaaccttgagaggaaaggaacaccatcctaaacagacataaaaaagaccaacactctacatgccccaaaaaataacgtagcacccaatcatgccatatccaattaaattgctaaaatgggtaagataccatgtctaatgcataacaggaaacccaatcatgcacgccagtattaaacaatgtaattttaccaaaaatgaggacatacatgtaagagctgccaaaccattatctgtgatttggcgattatcaagattaagggatctgagtgaattcaggccagaaattttcttcaagccaatgtccgtaaccaatgtaaaagagagattgatgctctgcaaattccgtaggcctgaggagatatattagttgaagaactgttgtgagtaataactaaaaactgaaaccgcttgaactattcaaacatcatatattttttttaaaaaaaataaagtcaatggcactagcatttgtgcagaagattaaacaaaccagagagatgacgaagtccattgctcccaacttctgtgtctgaaagttccaagcttcttagtttcagaagtcctacagcacagagagatgtacaccaatgatttgagaccccaaaaaaaaagaatgtaaccagtaatacaaacaattaaaccaattaagaattccataaggaacaaagtatacttagtcaatgctaaactgacaattgcggactagtctggtacaaagcactaatactatatgccattaaacaaaagtaaactacgacttactgcatgaggcttattgtgtgattctccgccttcagtgttttatgaaatactagcaaaatgccagtattttaaagcccataaaaagttattcctattgtctaatatattgtcatcatgcaacttatgttgtcactttctagctttgtgcctgataagctagctgtagaaataggcaaagtcttatttcactgttggtgggtcccacactaccatctttcgtataagtatagacaagataacaggaaaaacaaagaaaagacatgacaactaagaaactcacctttcaaatgtgctagcccctcgtcaccaatcttgcatgagtccaagttcaaacactccaaattgatcagttctacaagaacagaagaacatcaggaaagctccccacttcatgtgttaattagcatatatagtatataatgatgtcagacttctgacatgtttccagaaaaatcaatacaatcaagtgggtacaccttccacttggtgcggcgtaaacatatatattgaacaaaaacaacatggcaaaagtgaaacaaaagcgtattctggtatgcatctagtctcatatcatcggcaattttaatgacagaaacaagagaatactggtatattaagaaaatataagtgttatttcttgagtaatagtgatcaaattctatggattttcacagcagtgctttaccaaatttcaggactcacttgtcacttagatcacagcgcttcaaatttggatgctagaatgctaatttttaaacattattctacattgatgtcaaatatcatatgaagataaataatgaagagtctatttaccttttagatgaaccaagcaggcatctgtaatatagttgaaccctaaattgagaaccttcaacttgacaagacctgcaaggcaagaccaccgacaacgctaagaagaagtgcaaccatgtatgatgaagaaacagaacttaatatggacagcttacacaacgagacataaagtggcatatgttcctatttgtagatcacaaaacatcttaactattgttgaaaaaaaatggtaggtgaactgactagacgtacactgagaattaaccaatttataactacttagtttgtcatctgcatacaaagggcataatttcctatttgtagacaaaaaacaatgcgctctgcaaataatagagaattgtgttcgccaaaaagtcaacgaccagaggttataatattaccttccaaatgctcacagccttcgtcatatactccacatctactaagattcaacaataccaatgaagccaatcctgtaataacatcactattaatgaaaacttttttgagaatacgcacaaaagccttgtgcatcttttgtattaagagaaagggagtttttaaaactttacaatcttccgctgaaaggaaaacaagcaaatgagaaagaaagaaaacacaaaaggcgtggggctatatctcgcaacaagtttggcaaccgtttagtgagcggtggctcagatgggcaggccagccacacgccagaccgctgcttcttcctccatggccgcgcttattaccccccccccccccccccccgcccgatttcctctcgttgttgaacaccttattgtttctattaatgaaaatatgatctcaccaaacagggagcttgttaagtgttcatgtaatcatgaaatagattacatcaaagagcagtacaccagagttgtcaaacatactgtacgctgagtacagagaaatatcttaggcaactaaagagttctataaaccagcattctaatcgctagctgcgcaacagtaatatggtaagcttacgcttcacagagaaatataggactgaaaaaagaagaagaaaatgtgcctcaagtcaacaatgaatttcctttgaaaataataaaatgaaattccattaccatctataagcaccaaaagtaataaaaaaatctctcatttacaagaagcagcataatagtcctatagtacttcctccgtttcacaatgtaagtcattctagcatttcccacattcatgttgatgttaatgaatctagataaatatatatgtctagattcattaacattaatatgaatatgggaaatgctaaaatgacttacattgtgaaacggagggagtagaagcaagacactctcaagttacctagccactttgtcattctcattcaacttgcaaagggaatttctaaaactttcatgtcaaatccaccagaagagatttctctggggataaatccatgaggtagttgactatatatagaatgagaaccaaaagaaatgtgtgaaatttcatgacatgcacttcttcaggtccctaaatatccatttttggtaatgaatttaatggattattctacatgagttctggcagatgtggcaccctttcaacagtcaaattaaattaccccaaggacttccctagaataaatgtaagacattttcatggaagcgtgaactgataacatagcactcgtatggaaaagatgcaaaacctgaaataacctccaaacaagcagcagttactgcacagccctccaggtttaggtgagctagcttcgatagacctgtaaagaacaaatacaaaatatgaaacagaggctaactttagatgaaacttcatgtcattatattaatagaaacaacgaattaatcagaatattacagatacaaatggatgtagctttaggtagataaggttccactggaaaaggaagaaatttatttctgggatacctcttagataagaaacaccaagatcacttattttgcagcaagaaagttgaagctctctcaaatttgtaagatctacaaggaaaagggtatttattagacgtgcagatcagtatgtgtgataacatacactgcttgacactagatggtcaacataaaggtgttacctgataaatgtttcatatcagaatctgtgatgccattacaatacctcaaatttagcttttccagttttctcaagcctgaaaaagaaagttattattggatctgacagaagtataattaaaatgtattcacgattgagtagcgtttgaacaaataggtagcatgccagtcttccctgtatttattacaaagaaagatatataaaagctctggatgataaatatatctctgtttcattggggtgtagggtgcggggaacacatggtaaatgataaaattagatcatgcatttataataaataagttggctgtggttacattgtgatgatatattaatgaaatagcaggaaaccttttaaatgaacaagtccaccatgaatcttcggacatcgctcaaggtccaagctacccaaattaaccatgtttgcaaaggctttagctccttcagcagtaacagcagaacattttttaaagctcagggatgtcacatttgagaggcctgcagaattaaaaagcaataccataaatgacaggaacagaatatctagtgatcaggaacattgacaccactcttatcatagagatggaagaaaactcaactctcaggctatcagaaaatcactaacctgacaatgttttaagtccatgctccgatatctgatcacagtaattgcatgacaaactttgcaagttgatgcaatccttgagttgattcagtccaccatcagtcacatcagagcaagagatatcaacagataacaatgattgcccttgagaagccgctacttccatccaagcatccctcaccccagggtagtctgccaaacagatgtcctgagaccaagtagaagaatagcataggaggtcaatatctagtctcagagtaacttatcccagaaacaagaaatactccaaatttggtcctttctttatgtggcacacaagtaaagcgattgcttggcttgcttgtagcaggaagatagaagcatcatctgagttacacagaataagatagcagctgtgcacgtgagctcaactggtctattagtatcagtacccagtggaggcttccttgagtggattttcctcaattgcttacaggataaattttaccaacacattttagtttactttcctgagttagcttataaaaataagctataaaatcgtttacaacatagtaagaattgttccaacaagatgcctttattcgttccctgatactacattgaaagttagaaactgctacaagggaatgtcaggattgcattccatagagtttgcaataattccatattgattttccttgtttagaattgagtcatttttttcgcgaacgtgtttagagctcagtcataattacgtgccaaacaagatcaagcacttcacctgcaatgcacaatcacgaaaagctccaagcaactcttcagtgagaatgttccactccaccagttcattaaatacctgctgactaagatctctaggcagcagcgagaaatcagaatacttcccaatatcctgaaatcacccctcatcaagtcaggcaacaatacacacagaaaactcaatcatccaaggccacaagcactacctcgcggactttggccacacagagctccattagcgatgggcaccgcacaggcactggtccctgcaccttcctgtgtacatcagagccgctgcggggcaaggtgtgcagtagccacttgaagctgctgctcttggagaaccttgcactgtagagatcttcctcatcaacaagcagctggcctcttttcctagagcaagcactttccatggcgacgatgcgagcaccgatcacaaaccaatcacttttcttgatggactaaaaagcgcatatcattctagctcgtgactgtgtgattctttgtcatccattcccagcacgattacgacttggcatagacttcgctctctttggccccattctgcacatcaaacaatcgtgtaaattgacttaaaattatcagattatatacagatactgccaaacaatactaaaccccacgagtcctcagtttttggtgggtgtgttcatctttcacgcaacctaggctcttacaataattacggattgctgccaatcctaagtgcaatccaggaaaactaacagatgacactagctcaagaaaaatgaaccatgtcttacgaatcaaagcatcaaccctatctacgtattatcaaatcccccaaacccctaatagttcagtcactgtaccctactttcgattgttccacaccctgttctgcaaatcactccatcaagggagaagaaaccgtaaaattaaaaaaaatgcccaaaattccaacccagaataacacataagcatcgagagagtacgagttgggcagatcaacacgacaaccaaccaacccacccacccaataaaatcgcaacagaattacacagaatacggtggtggagaattacccgattggatatggaaattctcacagggacgcaaatccaccaaaccctaggccaagcaaactcccggattagagttaaaccaatctatcgcgattaaattacctctaatcacacagccaatcctcgccgagaaagagagaggggggaggagagggactcgagaaggggaaggaaaggtggagaagaaatggtttatagcgagagatggagcaacgtgggagctccacgtgtcgccccggaggcccgagctggtacgcctgccccgcagactctgtcactgacatgtggggtaggggtaaaggtggccaacgttgtcagtgggtggagtgggtaagaaggttggtggcgctgtgggggttggggggatgggggccacaggggagtggaagggataaggcaaaagagtaccgggcgggcgctcggcatcccccggattgtgctgccggttttgtgggcccgcgactgttggtccgttctgcggcctacacgtgggccccgcggttttacttctactggtggttgattaataagtggttgttactccggtttaagggcggttcagattgacgttattttcgatcatattatttttttaaagttgctaaaaaaatatcttagtttgtgctaaacttggtaaatatataagaaattttgctaaaattttagcaatattactaatttgccataaattagtaaggtttatttttgcaacaatttgaacaggctttagctgggaaggagtggtcttgtaatacaagttaagagttgttactatgggctggtttggtttgtggtctaaattggccttaccaatttttatcaatgtcaaattttgtcaacttttggcatggctaattttggcaaaggtaaaattgtgtttggattgaaaccaaaatagcctaaattaactgttgaaatggcctattttcttaggcatgccaaaatttggctccaaaccaaatagacaataaacactattgaaattgacaaatattggtaaggccaatttaggcctcaaaccaagccagctctatattaggagagattatattagaagaggtcgcatacccatctagattgaggtcgtgtttagttcaccctcaactaccccaaactttcaactttacatcacatccaaaactttcttacacacataaactttcaacttttttttttccaaacgttcaactttccccaaactttcaacttttttcaggaactaaacaaagcctgagtaattttgggatggagggagtatgtctgaaaataactttattcttattttcctttttaccactggtttgtatttttctattactttagtgctctttaccaatcccttgcctcttacctattcaccattaatcctatcattttattaatatatgcttgcttcgttcataaagaactaagtataatatgtgacgcatcctattaattaagaaagggagactaccttatcgaggacggtattgtttctcggagtaaaagaaagctagtctcggggaaggtatggttgcttggagtaaaagaaatatagtagcaaaggatagttggttttgtgcgaagaaatagtgttttctattttcaagtgagagaaggactaccttaccttggatatgttaggatttctcttagggtgtgtttagttcacgttaaaattagaaatttaattgaaattggaacgatgtgacggaaaagttggaagtttatgtgtgtacgaaagttttcatgtaatagaaaagttggaagtttgaagaaaaaattgggaactaaaccaggcctgagtaaaaaaaaaaaagcacggtgctacgaggagtggccttgtttagttcccaaaaactttttcccaaaaatatcacatcgaatatttggacacatgcatagagtattaaatatagataaaatgaaaaactgattgtatagtttatatggaaatcgcgagacgaatcttttgaacctaattagtccatgattagccacaagtgctacggtaacccacatgtgctaatgatggattaattaggcttaataaattcgtctcgcagtttctagacgagttatgaaattagttttttcattcgtgtccggaaaccctttccgatatccggtcaaacgttcgatgtgacactcaaaaattttcttttcgcgaactaaacaaggccttagagtcacacccaaaatcgaaatgaagctattttgggatagagggagtaaataaactccatagatgttgcctcttatttcggggtattttggtttagggtagtgctaaaacttttggtagttttccggacgtgtttatagagaatgagcgtgtgcttataaaggtgagtgagagcatgtgtgtgtatgactatttgtacttatactatgttttgaaaagaaaaacagtggtgttaaatcttaaataagtttttgcattatcaatatttttggtatggtggagtagctttactcgaattgattgacaacttttgatatcatgcttgtttactttattgccaacaaagtaaaactgatcatttgtgagtaagacgtaagccaaagattggtaatgctattgttaaggacgtatctacaacgagaccgttctctatatagtcataaccaactaactcaatctcatatctaattgctactagtatactcaaaagtgcatgtatttttttttcttatgaaattttctcttagattagtcatccgatttacgatccaattacaccattatgttcataacaattaaatctttataacaagatctcacatgactatatttttatgaaaaaatacaaattacttttataatatatgtaaattacttttagattacattaaattacttcttagtcataaaagtaatttacctatatatagaagtaacttaaaaaaagtaaagtaacttgttacgacattaaaagaaatatatacattcataatgttattcataatattgtgagttgtttgttttacaatcatttttagtcagtgacgtaatttgtgccggttaaatttaatttctatatagactcatgtttttacctccataacggatttaattttgatgtcgtgataaagttactttctttctgttttaagttacttttataatttatgtaaattacttttagactttactaaatttactataatatgtctaagtagtaatttaatgaaatccaaaagtaatttagatatattataaaagtaatttataatttttcatcaaaatataatcatgtgagatcttgttataaagatttaattattacgaacacaatcacgtaatcggatcatagatcggataagttatttaagagaaaatttaatttgaagtataagtggttcctatttgcttgaaacataggggataaactactctctctctctctagcgtagtagagtgcgtcacatgctttccgatttggtctgttctggccttcttggcaatatcggcatgtggaacagatcagacgactacaccagcgtgtgggatcggacggtcctagatgcgtcgcgtgataagaccagatcgagaggcctctcgacttagattttatgtattgttaagttccgacaaggttaaaaaagtaaattaaaggtggtgttgagtcttatatcttattaaattttggtgtagtttcgagagtaaaaagggtatggaattaccaaattttgattgaggttaataacgttgcaatagtaaaatctcttgggtgtgttctcaacttcttctctctcgttttcacacatagcttcctaaactgctaaatgacgtgttttatttaaaaaaatatattaattcatttttatatacaagagagaagttcgtaactttgtatcccgaacacaattagacaatggagcgaacaagcacatcaatccaaaatgtagaccattctattaatgctattatattttaggaatgttggattcaaaccaaatagccttcaccgttgacccagtcgggaacccaatagcacacaaccaccatcaacgtatatacggtatattcgacccgtcatcatgataaaagagatcattagtctggcatttacgtaagtattttttattagaggaagtaacatacattggtggagaaaccatctttggtcggtcaaccaaaattcataatagtcccggttccactaaaaactgaaactaaagatgatctttagtcccggttccactaaaaaccgggactaaagatcgtatgttgtcaggggctgtcaggccctcccgtgatctttactcccgattggtaacggtgatctttactcccggttggtgttaccaactgggactaaagttaggatttttagtcccggttaccaccggtaaaacaaaacctctatccacgcgcacatgcaaagtctcctattaattccatcattatctctcctctcccatccagccatctccatcttatcttcttctctcttcctctcctcctatccttctcttccttcttttctcaccccatctcctcctcccctctctcctccccctcctcccctccggcgggcggtgggatggaggccgccgccggcggcccgacgcagggcggcgagatggaggcggcggcggccggcgccggtcgggaagcggcggctggctgcgtcgggcgcgagacggcgagatggggccggttgagagggcggcggccggctgcgttgggggtggccggcgccggtcgggagggcggcggtcggcgctggtcgggatggcggcggccgacgctggtcaggaggcggcggcaggagaacttttttttctcttctctgtgctatctgatgaatgctgaagatattgtagatgtgaactttctttttcctttctttgttctctgtgatgaatgctctctgtgatgagatgttgtagatctgaacaagtgtaaacaatatggatgctttgttgtttgattttattcattcgatctatgatttaggctttgtcgttgattttattcattcgatccacgagcgaaagctaaagaacaataaaaaaggaaaaaggccaatcggatgaaaggaaaaggaaaaaaaaaaaccaaaactttttagtcccggttggtaacaacaaccgggaccatatttttagtcctggttggtagactaaaaatcaatctttagtctcggttatttgaaccgggactaaagatcgcacactaaccgggactaaaaatcaatctttagtctcggttatttgaaccgggactaaagattgcgatctttagtcccggattcgtagtcccggttgaaaaatcgggactacaaatgattaccaatcgggacaacaaagcgtttctccaccagtgatagaccatgcttacatttgtcatacgttccatcataatctactaacgaattaacggagaaaacacaactatcagtaaaccaatttatagtgttttggcacaatttgattttcttctcgatgcaagggttagatacagatttgaatcaatatttatatattactaactttttaaataacgttttaccatttatcttatttaaaaaattagtgtaaatttgctaaactataagtagtacttaaattttctataatgataaaagatatcacaacaaaataagtaatattatataaaatattttaataaaatgaatgataaataaagttaacgatattatctattaaaaatggtaggagcagtacttgggccctgatcttttctaaccctaaacttcaatttcctcccttttgtttttcatgtttcttaaacggtttaattgatgtgtttttaaaaatattatatagaagttgtttaaaaaattaaattaatttattttaaaatttataatagttaatacttaaggtttacgcatgtagaaaattttccttatatttaaagcaacgaacggggcttaagaagacaagaacctccatgccattatttgttgaagaatttcccaataactttcagaggaaaacaaaaacgatgaaatttcccatttttcacgcttttctaggtgatgactgatgagtagtgcagagcacctgaacggaaatctcccccatatggtccggtcccgatcatctttctgaagactgtaggcgctgccgctgacccggacggcgcggtctccggcggtcgattcgccgccacgcaacgcaaccctccctccctccctccgccgccggtcaaacctccgccccgccgccccccacccgagcagcggctcacgcacacacatcctcctcaccaacccacccgcaccgccgctgacgcgtgggcccccgagcccacctgccagcagaggccggtggcgccaacgatatactagtataaaatatattcagctcgtcggcgtcgtcgtttaccagtcgcctcgcctctcggcgtcccggtcgtcggtctccgctgcctctctctcttctctcttgccctactctactactactaccagcagcacacggtttccgtgaccggagcgcgcagcagccgcccacctaaaggctaaagatccgatcaaatcgaagagacttaatataccttctttttttttcttgagaggaatatttttttttcgctttaccatttcttcgtccctgggggattttcggggggattctgaggagcaagaagcattcggccgcggcgggggtccggcgctaagctcgagagattcttctccggtgagtccttttgctttcttggagctctatcctgacgcgtggtgtttctgtggtggtttggtgtaatcgttattgcttgtttacgcggttagattgcttcatctaaaacaaggatggttttcttgcttgatggtgtggatggcaaaccgtaggaggtttgtcgcatcaccgatcgcagatgattctaccgttgtgttcttgggacatcgccatgggagcctctgtggtagtactagctttcttgatggttaccctgtgccgtcttgtatgcatttttctataatggacagtcacctcgcgttaagattgcgtgttagactttctgaagctctaattttgctataatagcgaggggaagaggggaatacctcgtttggtgctgttctccatttgcgggatagctcaaagtcaactctcagtcaactcatttctttgcctgctttctgtacacatgtgttcgtctatgttataatgatttggttgttcaacaagttcattaattgggaccttatcggtggtgatgtgtgtagtaggagtgctatgcgtactacatagcacgattttgcttttgtaatctgcattcttgttgcatgcattgctcagttgctcaacaagatactcgctataaatatgtagaggtcaaagactggcacttaaaatgcattgtgcaaggcatacgccaaaaggaagtctacctatggtttgggagataattcattcatacaaagtgtaactaatattgcaaaatagcatggatgtctagaaccgaattattcttctactagatggtaaattgttgttccactcattatgaatcttctgattacacgtggagaagctgagagttctcctttcttgattgatcggtgcatattttggtgacaaatatgtctatttctgctattcattttgtactaatgtactacccgggactcatgttatcgctcctcgtatatcttttagtggcattctttccaaaatgctaaactgaatgcttcgatctttttgcagtttggattgcacttgtcagagtaaaagggcttaggacactatgctaatttaagacatctcatccaaatgaggcgcaccacacttctttgttggcaaactgaaatcagatagcattctggtagccactaaacctacagggatgtttcttgtgtgttttgaagccatgtgcccctgttttggttcaagaaggaaggatgggagcgaagaccctgttcttggaagggatggaaattcctgtaagttaaatagcaagctttcatctattggtgatctaatctgttaacacaatgaaacaatgtagatgtcacgtttggaagtataaatgaccatcatgaattgtgacacattccttcatccttgtttttccagtgaattcttctgagctgaggtcaatgtctgatagagttcctccaagccctcttcgagtacctgcaagtccatctagattttcattgtcttcatcaccaagtagaaatgagccattgaacctgagtcttgaacaagttattaaactgacacataactttgcaccagacctgatgattggtgaaggttattttggaaaggtctacagagcacagctgcgagatggccacattgtggcaattaaaagggcaaaaatggtaggttttattttttatttttatttttttaataaaaagcagtgttggcgcaatgatagtggctgtcaacaagcagctatactagagatttctctatttagaatgactgaggtgttttttttcaagtagtctcgctggttgatccatttttgtgtagatcagtacggtaatgaaacagtaatgcactggtaaagcatgtactcacattgcattctttgcaccagtagttgtggatagttattataatttggtgtttttcaccgcttgatcttgttggtcactagtcaaatttcttttgcaatttatatttattcaaaaggtcctgataaagtattaaagttgctgatagaaactctgcttcctacatgtgatttttcttacaagtgaatcgcagttttcatccggtttctttatgcaggaacattttgcctctttacgggccgaattcagtaatgaaattgcattactaaaaaaaattgaacacaggaatttggtccaattacttggttatatcgacaaaagaaatgaacgaatcgtcataactgagtatgttccaaacggcactcttagggagcatctagatggtaaactgcatactaagattctcttttgttgaattccatatagaacaatcagtaattttcaaattatctttcaggtcaacgtgggcttgttttaagctttaatcagcggcttgaaatagctatagatgttgctcatgggttaacttatctgcatctatatgcaggtatgctttgtcacatgtttctgttgctgagcataaaaacagtttaaaaaaacaactgactgttatttttatttttattttcataccaagtcatgcatcggggtattgtcactaagtaatgcaagaactgtaaaccagtattttaactatattttccccctctaaaggttggtccattggctcataatctgctaataaatgctagtatcagatatcctgactgtaatgttctgtagttcggaaattgtttgtggctgtgcatcaataaaggttgtgaaatgagcctaacaaccaagttgaataaaccatgaaaattagccatgtaatcagatgtgtatctgattttaattctttgatcttcaagctttaaagtagcttacagagattctagtttgactattcctattggcaatttgcatatgtattttatttatttgttctgtacttttatgcttttagagaagcccataatacacagggatgtgaagtcatcaaacattctactaaatgaaggcttcagggccaaagtggccgactttggatttgcaaggactggtcctacagagccagaccagtcacagattcagactgatgtgagaggaacagctggctatgtagatccagagtatctcaggacaaaccatctgacagtcaagagtgatgtattctcttatggagttttgctcctggaaattctttctggtcgtcgtcctattgaggtcaggagagctgcaagagaaaggatcaccgtgagatgggtatgtcttcacttccctactttgtgtttacattggtttagacttttgtttctttccattgttttttctagataactatttaggagcaatttacctttgttctggttattttcttgcccccctgacccctcttgcccctgcatacgctcttgcttttctttctcgagcagttatctgcacatgaattcattttctttgtcgacaatttgcaatcccatcacaagttaaaccatacaacatgtaaacttccagtg

SEQ ID NO: 67548 - DNA, 17459 bp, Oryza sativa
ttccgtggattcagcttctttggattcagattccgaagagtcagttttctctttgttagcagactcttcttccttgggaggtttcttttctatcttgggttttggtttaggtatcctattgacactagaaacctgcagacaaagatgaatccccaatgttttgagagcggtgaaacatgtgcatattattctagaatcttaatatgaacttcctaaccttatcttgtaggtccagaactttttcgtagacttcttcagatgtgaaagcaggtggactgtagacaggggtgctgcaatatgataaatgggagttagacacatatacacatttaaatgtagaactcgcgaaattgtgttggctctagactcagcataccttttctgtatggcttccttctcctccaaccaagtttttactttctctgcttcacttacaacctagacccagatagcatcacaaccaataaaatgagaatcacatcataaccagaatgaatttatcgaacttcattaagctcactggtttacctcatctaccctcttttttggaagccacggtttgttcgagtcccagttcttaacaatctgcaagaccagaaagtgttacagatgagaatagagtagcacaacaatcatgaagttgagcagcaacaaaaacattgtttggtcttctgtatagataccttttgcaactcagcaagatacaatctagcattttcacaagccgttggccgggcttttagctcactcaatctgggcaataaagaaaaaaaaaatcaatgtcagtcaatgacctatatgaacctaagtggatacagagcaagttacctgaaaagaattgggtcaccgatggccttaagttggtcaaggcgttccttgaattcatttgcttgagcatcttcaccatccatatacaaccaatcttgtacctgcacttaaacaatctcagcatgaggattcaacagacaaatgaaacccaccagaagattattattgaacagacctcattaagtttctctgcaaaagattccctctcctgttcagttgagacggtcaaaatttctgtgttctcttccagctgtgatgtgccaaataacagaaaacaagtagtcaacaaacataagtatagcacctagtaaataataactgtgctaaacgttatgaaacttttctgtgtttttctagatttatgtagacaatggagttcctattatcagtgcaaagctgaagttctgaggaatataataccctcaaagatttcagatatatcaagaaacaagaggggtcatgtgaatggcagtaacatgttttatgctattaacactgaaggtagaagagaacagaaggtaccttctccttcatagagtatatgtaagactccaggttatttttcagttcagcagttctcctcctttcagcatccttcttatcaagcgcctctaacctagtttttgcttcagaatacaactccttcgaaagaattgatccagcaccagccatcttttccacaacctgccattggacaacatatttattaagtcatgttctgtcaatattaacaccagatttatgaccttctatctttacctttaacgggaccctgaatgttcttttcttgagcaccttctctgtaacaatatcttgtgcattactctcatctattggagcactggacttatttgcatccccatcagaactcacattctccttactgtcagatgtgtcattagctgctcctccttccgaagacaaagtctgactggtggaattactctctagagttaaattcttctttggaacttcaacccattcagttatctcaatcactgcttctgccctatcaagagaaataattccgctcctactcaaagaaaaatgtagatttgccttgatgggtgcagataaattgcggctactgtacctgtttgaaataaccacatggttaaattcatgcagtgaaattaaacacatacaaattgccaatggcaatggtgttgagatattatttagaaatagaataaacatatgtactgcagcctcgaagatggaatgttccgcccccaaaaaaatagcagttgaaataaaggtactctatgttcagcttgttataagcagtaccatgacacaaaaaaagtacataagatgatatgcattatgcatgcttacttttcgcttgcatctgtcaggcctgatacagaatactccacaaatttgtgtgatgtaacacctggaggcagttcagaagctttttcatagctgatagaaacatcgaagtctttagtatgtctaatggacctgaacatctgtagacaacaaaacaattgcaagctagattattttttaaaaaaaacttttttttttgcatataatcaaaaggaaacaagaaaggtgcattataaccttaattcccaattttttcatccttggcaccagtaattgatcagtgctttcatctttgacataatctgggccatttatttcaaacacaaaaccataagtagaaccatcaatcatccctaacttacggttcaacttaattccatcacttaagttagctgcatgcagtgaggcacccagaacaattgcttcatctgcatcaagatgcttatccaggtcacttcttcccaggaattcctgcagcttagcctgtaccaggagaatggaattttattacaaaaataacaaggtgaatgatggaagcacaactgtttcagaagtacagttaagtcatctgcatagtaggttaccgtggttaacaaatgcctttgagatatgatagcaaatttttaagatgttaactaaaagtaatggattgtattaaacttatgatgagaatcaagtgacaagagagaaataaaaacatggcagtcatgtgcctgaatgccattagagccccacaatacaaggtcaaacataaaaacgagttcagtttaatcacctgcaattttggtactcgagtagctcctcctattaattctacagcatagatatcatcaatcttcattccagaatgtgcaagcacttctttaactggagttagagcctgctcccataattcttcacaaagttcttcaaatttttcacgtgtaatggtactcctgtaacaagaagcgaccattaattcaacaagtagaacctagaaaattgtcctgactcctgatcatgatttaaaactagaaaaagtttactttgtacagaaagaaatcaagaaaagatgaaaggaaggcagaacatcaaccattatagaacaatacagtaaggaagaagggtcgactatgcttgcaaagtattaatattggcaactactgtatagattaagaagccagtgtgtttcactatcttccaggttccgatgttccgtgcaatcaatggatatgcaaagtattaatattggtacctactgtatagattaagaagccagtgtgtttcactatcttccaggttccgatgttctgtacaatcaatggatatgcaaagtattaatattggcaactactgtatagattaagaagccagtgtgtttcactatcttccaggttccgacgttccgtacaatcaatggatatgcaacaaaggccaatgcagaacatcaatggagtagctacacttcaggccacagtaaacaacctttgtagctcttaacgaatttgttctaatggaattgcattcatgtaattcaaagataacaaggtgattgatttaattgaaacaccggtcaggtcattttagcagataagagacaaagcaccagccacctagcatgcatgctactccagcatagtaagttgctatgcaagaatttgccaggctgacaagcatctctaattttcaacaaagtttcaattgttcataaccaattaaactcgagagcgttatcttgaaggcttgaacagagaatccaaaaatgttaagtaaatttccatttatgaatttataaatatcggtccatattacatgtgtgaagattatgcaagtggtgaggacgcacctgaaatcgagatcattatatagtgattcaactgaaattggagcagcagtatttgcactcagaatttctttggtacgcttaacttgcttcttcaacttagccatcgccttgggagactggcggatatcaactccattaccgagttgtttattaaattgatcagcaaaatagtttaccaggcgcatttccatttcaaggcctccaagtttggagtcccatctaacatccttaacctgtagataattagctgaagaaattagtaatagattctggcattctgtatctctgtaatgtaggcatttagcaagctcaatttttcatatatttgtcagatcttccatcgcttaggcatgtgaaagatgatgtaaaaaaaggggttttcagtggacttttgagtaagcatacgacggacaaaattgaacaactaaaagaccttgggcaagatcgaattgtacctggaactggttcaccgataccgtcttcccaaactccttggccttgtaagctgagtagtacaccagcgcggcgtaggtactacctgcgcccatgtcatagaagataacatgcctcgactcgttcgagaaatccttgtcgatcccgtactgcaacgctgccccggcgtgctcattgatgagcgcgaggacgttaactccggcaagctgcgccgcctgcgtcaaggcccggcgttcggcctgcccaaagtagggcggaacggcgacgacggcgtcacgcacaggagcgccgacgtgcgcatccgcgagcccagcggcgtagtggagcaccatcgcgacgatctcctcgacggtgtagacctgcccgtcgtccgcgcggaccgcggcggcgccgcgcgcgtcggggacgaggtcgtaggggaggaagagcgcctccgcgacggaccgcacgtaggggaagggcttcgcgaggaggtcccgcgcgcgggcgaacaccttggacgggtggcgcgcggtgatgccggacgcctcctcgccggcgagccggttgccgtcggcgagcgcggcgagcgccggggacttgcgcttcgacatctcgttgatggccaccgcgatcgggacgcgtccgggggcgaggtgcacggcggccaccttgagccactccgaccccaggtcgatgctcgccaccgccgcctccgccggcgggacgaggacgacggcggcggccgcgacgaccgcggcgaggaggaggaggagacccgatgtgcggggcggcgccatgacgagcggcggctagtagaatggcatgcggggtgggggggttagggtttggagatctgggactagtgtggcggatgcagcacacacggtggaaggggagaggagagagcagcgaaggaggggagggggagaacgatctcgacggggaggaggaggaggagaagggcgtgtgctatatttgcaatttttgtgattgtttttcttgcgttcggagttttttcgattatgaccctgaaaggttttttctgatttcgagttgtgcgttgctgctgaaggtgctttggattcttggtgaatatgtagaaaaaattgagggctcatgtgaaaaaggtgagaagaagaccgtggcaggaacgtcacgaattgagtcaccagtccaatgaaaatacgacacgtggaaaaagatccacatggcacgccttggctagcgtggtgcgctggaagagcgagaggagcgtgtgctagaccgcacgtggaagtctcgtgcggcgactaccgagtttatcgagcgtcacgtcacatcaaacatgccagtaccgtcatggcgggaagcttgtacagtaaaaacgtaggagtagtgctagtgtgtttgtgcagtttaaactgtgccatgataaataaggaaatcattcaaattggcgaaagcatttttgggatgataatgaaattatgttactgatttttttttcatctatcactggtcaggtattgctaaaaaaagtgtttgataaaatactactagtagtaacttgcaatcttgccagcatctgaaaaaggattgttcacctgcaccgcacaagccagaatgcaaaagctttgcccaatgagcactacaacgctgttcagtgtcacactctcactgcactgtctgctcagtaaagatcacaggtcaatctccaagaatgcacagcggttgtctcatgctgagctcaacttttagtcctggaaattgtgcaaggtcgttgcttgttcccaaaacgttctgccacaaaaaagctacttttaaaaacatgaacaaataagttatatactacagtgatagaagagttgtctgatcattaatagcaacacgaattggggtttagcaaatgaacttacaagtgcagcaagatgagcttcttgtagaatactgccatcaatctccagtctagctattggaaactctggaagatgccctgactgtttcttgccgagtagatcaccagggccacgcagtagcaggtcggcgttagccaagtagaatccatcggatgacttctcaagcaccttcaaccttggcagcgcgctaggagtggagcataggaacacacatctggatttcctttcgccacgccctacccgaccccttaactggtgcagctgagacattccaaatctctcagcattcatgacaaccatcatggaagcatcaggaacatcgactccaatctcaatcacttgtgttgagaggagaatacgtgtttccccggatctaaaactgctgagggctccatccttctcatcgctcctcatgcgaccgtgcaacagcccacagggataaccttcaaatttttgctttatggaatcaaactcggcttttgctgcatgaagttgtggtagctgctctgattcttctatgataggatatacgaggtagaccttgcctccatcaaccagttcatcactcatcatcttcaagccataagtatttaaaaatgataagcaaattgatcccaaccatatccaagtgcagattgggacagaaaaggaaaacaacaaagatctgaaacaaaaagaaaaaatattgaatgaagtcatgtcatcacctggaagacagattcaaaaccagcatcatttccttcaagagcaagagtttctataggttgtcttcctggaggcaagtccgtgatctataagaaacgtggatcacaattgtaaagatttgaaatagctgtgaaaaatgaaagaccctactagttgttaaagtaacaggtcctggaacatgaaaaatgaaaaatgcaagaacatttttgcactatatcctatccaatatgtgaagtcataaagtagcggatcctggaaaacaacagggtggactactagttgttaaagatataattgtgctagcctagaattagtccctcgatgtatgtagttttcaccctgtgccccacatagtacgcgatatgacattttacttccaatgagtaagtatttggaatactcaatttaggctatgttcttttcttcaactcaaaacttcaacttcctcgttttctgttagcatgttttttaaactattaaatgctgtgtttttataaaagttttctatataggagttgtttaaaaaatcaaagaaaaccatttttcaagtttataatagttaaaacttaattaatcatgtactaatgagctttctcgtttggcgtgtgcagaaaatcaactaccaaacagaagaaacgaacgaagccttatatgccataagcctgtaaaatacctgtgtaagggacatgtccccatacagagcaagagccaacgttcttgggattggagtagcggacatagcaagaacatggggagccataaatatttcagaagcggaattctcgtctgagattgtatcatcatcactcgatttcgtggaaggggtatatagctgtaatgaatggcagtaatttgtattaacaaacaaatgttaactatgttaaatttgaaaccaaaataagaaagacatgaattatgcaacgaggtttggatatcaaatactcaagtgtaagtaccagatacattatcttttgttttggacaattaggcagccttgagaactacagcacactccttgaaggctttcaccatagcattttatataatcactagcatattacccattgaattgggatttttattaaataaaattatcattaacccgttattaccatcattttctgcaatgatatgctagctattgtaataacagcaagaatagcaaattgtaatgatgggtcattttctgcagtgatatgctagtttgtaagaacagaaagaagaaaaaagtcagtaggaacgctctggcccatcttaccacaaaataagatacacgaacatggaaatccagaggcatacttcttactccctaagccccaaaatataagcacttctagagtttttcatggagattaaggagagaggtgaaattaaatgagagatggttaggattggttttgatgaggaagtaggtggggaaattaaatgagagatggttgtgattggttcagatgatgaagtacatggagaagttgctatgttttgggacaaattttgaacgctaaaagctgctatgttttaggatggaaggagtagtaattagcaattttctttctaagtttgccaacaaagtttacagaatgggtgacaatcctggagcaaagtaagtaaacgaaggatgtgtgtgattttattcaacaacaaggtttacagaatgagtgacaatgcaggagcaaagtaacagtcaaaaagtccccgcaaaaaaagtaacagtcaaaaaggacgtgtatggtttttattcaatgtaaatagcaaatgctcagcaaattaccttactattaaaccttcctctttgaacaacaccaaagcgctgctgctcatctataacagagatgcgcaaagctgagaattcggttttatcaccaattaagctgtgtgttccaatgaccattgctatttctcctgtcttgagaccctgccatagaataacaataacacataaatatatgaatctatgcgtatgggaacttgagagtctagaaagaatgcttgcatttcgaataatccttgattccctcgtggaagttgaaccagttagtaaagcaatgtttggtttgcattcatctccatcaaacttctccagcaatgaagttagatgttcataatgctggagggcaagaacctccgttggaaccatgaaagcagcctagaaataattttacaaggtatatgttagactaacatctcattaatgaagaactgaagagtacaactaggaggaagataatcatttttcgtgtatatcctatttggattaagcatctagtttgcttcagtaagctgtccttttagttgataaaatccttttatatacagtacataaggcaaggatgttggtttgtagtatagatacctgaaatcctgagctaatgacctccatgcatgcaaggaaagcaactacggttttaccacaaccaacatcaccctgtcaaagaaagaaggctttcaagtcttcagcaagatgcatataagccccaatagttgttatttgaagaacaccaattatatataaaaaggaaaacagaatcattaattcactatgtaataccacagccagaacctgtaacttggtacttaagattttcttcccccatatgaggtatacccccatgttccatttccccaagaaaaatggaatgctacatccagtcaattgcaagtttcttgtccacgaacttggtgcttaagaatggtagaaaatagtttggttcaaatatttttgcttaagatcgaaacatttgaaataaactggccaaaataaaacaacgcaatagtagaccagtgatattagagccaagatatactagagttgattacagaggagcatcaagcaactgactggtaaacaagtccagactccagaaacaagagcaagaaagttaatgaaccaagaaatgtgcaattaatagttacttgcaagagtctgttcataggaactggtcttctgagatcccatataatctctttaacagcattcaattgactaggagtaagcaaataaggaagaacttttaacaatttccttgcaagaggagaccactcgtcagcaccaacagcatttagctcatgatttttgcacttcaataacaattcttccttctcaacccgtgtaccaacagcttcaagcatttgaaacagtcttcccaactgaaaaacgatgataaatgtttccatcattgcatatgcttaattgcacacttaaaaacaagatgcgataatatgaacttgaaggacatgacatttgcgcaaatcgatatccatgtttaagcaaaacaaaaatattgcttgctgacaagcatataaatgataacaaaaataatacccaggaaatgcactcctgtatagatgccatcaccgttggagttgtactttgaagattgctaaaaatgctgaaacccccaccccactgccacacatgcgagtgcccgcccatccattcaccccccccccacacacccacacacacccacacacaacaaaattaaatacacagcactgaaaaggaagaccatctgaagggagaggggtggtgatatatactgttactgactcatatgactgtgctacttctactgttatgtcaagaaagaaatatatggtaatacctgaagataaaagaaatcatcgaaaataagccttctccgagcaaaatcggcttcatctcgattcttaggcttgtggattcccatgtaagcctaacaaccaaaacgaatattgaggacagcatttaggagggcatacagatcacatgatgatgacatcatataacagaaattcaaacagatagaatgaagctatatcttgtaatagtcaacaaagagtacatgaacatgttggcacgtatatccagtgattttaatatattagcacacacgtgtgattaccacacagatatccaatagcaagaagaaaaaatccgacagtccatccatctctaggttccacttgtatgagtagcatttagtaagggaactataattagatggtttgctcacatcaaagagattgggcaagttgaattcacaagaacttcatgaggcatagggtcaatgtctggcgtcagcatcttcaaggccctgtgcacaattgtaaactattattactcctacatattcagatggaaaataataatatcgaactacatgcatttcatattaagttaaggtgatttactctttatcctttgggctttgcagtcatcccttaagtatcatcataatttaaattacttaggtacaatttagctgaatcatattttaggaatggggaatcggcatctttcaactatgatcactttaaaatagctgtgaacttagaggaacatcacttagggcccaccgactcagctttcatttagaaactagaaaagcacacaagctttgcactgaccttgagatggagaggctcagcaaacttggtttcaatcctgcttttgatgggtatataggatatggtttcctgtcaagcagggtgcattgttgttcctcttcttcaagcatgtcaatagtgtactctctcaaatcataatggtctttagtaagcgccttcttgatctgtgcaaacaaaatcagctaagcttaataatcacatataggctgtgaggctacaaagtgcagtccattacatgcataagtgaaaacatctgtatagcagagctacttttatgtcattgtaaagcaaatgtgcggctgcaccaacacaaattttaggattacaattattttgtagtgaagcatcaccaacaaataaagacaaattgaaaggtctgacaagcagcatgtaacaggaaaaggtatgttagttcaccaaccttaccgctgacataagcaagatccccctctttgtacttcgatgatatacacttaagaaaagatggagaagagaagcgtgtgccgctgaaaaatttcttgaggtgcaaatgaattgtcttcttttgttctgcttgagagttacaactcttaactgaagagcttaactcactctcgattattgaacaactaacaacaacctcaaggtaacctaaagtgtgcttaagtctggctcccctgagaaaacaaacgataattattgtttagagtacaggtttttggcgtatgaaaatgacctagccaagtttgttatacgaaaatttttcataatatacatttatgtaactacatttgggtttatgcaaaagaattaagtggtcaaagttacatcttactgactttgaaaattccaatatggcaatcttttgtgactggagggagtaccatttcaattggactcatagtgcttaattatgtttttcagtaatcagtctttctttgcagggaataatcagccaatctatgaattgaatatttttaactaataattttgaacctaaccatttcgctcacacacatgaacataacttttctatgtgttcacaacatccacagtaaaacgtccttttaatagcatcgaaaattgtaccacaatatactgaatgccaccacatgagcaagatcaaagaaatgggggaaacttttacaaacatgctataacacaagcactgtcatatcacagcagtcaagagagtgaaaagacaattctataccaactccaacaaataggatcaaggccagcagttggagcaagggaacgtatcccatgcacacaagcttacggtgcacactccgtcacaccaactaacaaatgtcaccaaattttctaaaaaatatatatacatgtacctccaatagtatttcatatacctgtaaagtataaagttcaaattcattatattctagccataacgaaaagaaaagaaaaatctgatagttttaagagtatatatctgtcagaattttgtcttttatgttacggctaaaatatattgaatttgaagatgagactttgcatataggtgtaatactattggaagtacgtgcacatttttttccagaagttttggtgacatttgttagttggtgtgcacggcgcagtatacataggatatgttcccttggactggagcaagactaattgaaatattaacttatactccccaaatgatcccagcaggggcatcggtcacatgaatatttagaaataataataagatcatcttaaaagatccatgattttaacagaatcttcttgtcccccagcagactcaaatttactctataaactcatttctgactaattcccctacaaactccagaaattgtagtaatggtaggtcttcatttaaattttacagggttaagagaattgactatataaatacccattccactcctccaaactatactgcccttctgtacaaatttcatggattattatgaccaaacgttgagtgtggccctagtgtcattgtgataggatggcacatcccatatcaattcttctttattatcggattaagaattttactcaacaagaatgatctgatattaaataccactaacaatccgagggcatcaattcaaataaggaaatgatatccttcacatgccaaaagatttttatggaaagactaagctcgggagatgccacataattaacatatggcaagtttaatgccgaagaagaagacagtggaaaacatcatatttctgattattcaattacctggaagatacaacggttccaaacagcatgatgtactgcccctcttctattgaaccttgaggattttgtagatctgcataggtccggggaaaatgctgcaacaatttccgtacctgcagagaagaaatatattgcatgctaagaattctatcaaatcaaaagaaaaaaaaaatactgaagcgtatctgctgctagtaccgtatggaaaccaccatcctctagctggcgatattgcctactagttgttccgggaaaacatcttatacttctgtccaagatgctagaatcagaaactgtagcatctgccactgccaatgactctggacaagcatcggtatcaactgccggttcaagagaaacaaactgtgctgtgagagaactctcttcactgattgataggtgatcgacgtttgtaagggttggatctaatggatggcatttgtcagaaaactcataagctgccccaaaatttccaccggactctcgcatgaaattcgtgaggttttcagaaagcacagtttctttctgactcatgctagcagcagcagcatatagttcaataggtgatgaatcaccaatttttatgcatggaaactttgcacacatttctgggaactcaatttctttgcatacactgatcaattctgtagcagatcctctgcgggctctttcttgctcaattaattcttgtgtattactataacccatcaaaacagacacctgcaatcataaataatccagacaatgttcactgttcacagcaagtacagatgaatagttgtgtgacattattagtgaagagtggcatcaagcagagagccgtgcaaatcaaatccagacgtcattaagtagagctattgcataggcttaaactataaaggtcataacatcaaggaagttaatgtacaagtatatgcgcattgtatttaaacaaggttactatgcactagtttgaactcacaacaataattagaggacttgggaaatataaatagctttcacttggtagagcccaaatggtggaacgattgaacagatgaaacatacagaactaaactcattactgatgcctgcaaaatcgaaggctaacactaacaagtgaacacaaccagttgctggcagggcacatactttgttcaggagttttgatctctctgacgtgccatccacctccaacagcttcctgacggacgtgtgattctcgcgcgaacaccaccggaagagcttagagccaagagcattgctagacctgcaacctgaacagttcagtgctagttgctaactcgctattctagccacaagcacaaattgcccacaaggggaggggaacctaacaaaatcaatacctcattctggaaggaatccttctagagcgccctctgcgaaaatccaaagaaaacaccctcgctaattgattggtgtgaccctgaagaagtgaagcgacctcatttcagataaggaagggggatagtatgtgaagagaaacgacatacgcccataccttaatccatgattgcgctgaggaggaggcgatcatgggtgcggccagcgaggagagaaccttcccgattcgccgcagcgctcagttcatccaccgcggagacgaacaccatcaaacaccaccagagcacgagcaggtgcccaacactaatggagcgctccgggttaccaatggaaggcggcggcgaaggggcgggagtgggagggaggcggggtagaggcaaggcagcgggagagagagagagagagagacgaagcgcgagaacctaacgtggagcggggacacgcgagagcctcgccggaccgcgcgcgccttccggggacggcagcggcggaggtgaggtcgtctttcccccctctcgtggaggcgagtggagtggaggccctcaccggcggcgcgggcggtgcagtgccgtcgccgtcgccggaaaaggggacggaggccgtacgtggtgggggtttgggtaggggacaagaggggagcgcagaagagtcggagacgatggaatggagtttccgcaagttgggctggctcctgctggcccaggataaggtggtcgagttccggttaggcccataggaatccaggcccattcatagatggattggttgcgacccaaagaggcccacaaaaatttgttgagaaaatccaaaaaaaatatcgggcctgttcagattgtagccaaaataaacattacctaattttggtataattttggcatgatttcttatgtatttagcaaatttggcaacaaactaaacatagacatttttttggcaatttttttaaaaaaatgatatggttaaaaatggcaacaaagtgaacaggcccatcattgacaaacttctaattgcaagaaatataatcgacatgtgctagttccatgaaatgtcatcgtacaagtgactttatcttagaaataccattatctgtatggtttcattagcaaacctccattaagtgctataggatgaattgtgcattaaacgggatggaattgatggaaccctagcaaagaaggtatttctaagaaatgtcacttgcacgatgttattttgtgaaattcgcactactcgatgacattttttagatttggatatttgccagtggcattatttttgtttttgtcatatttgattggttgcagccctacattcaagttgggcatccgattttggatgcaatatatcgaatttggatttttctggcaacctggttgctgaatcatgacagccattgtgtcttcagactttcaaactcgattcaaatagattgtttcttgtggatttcgaatagacagtatattggctaaagtttacactgacttgtggatttcgaatagacagtatattggctaaagtttacactgagtaaaacggactgatttttgtgctgttgatcgattctgattctgcaatgtgccacagaacagaagttctgacgatactgttatatagatccaagtgaccgggctacaggatagaccatttgacaaaaaaataaatccaatcacaagtgctacagggcgtaggcaacaacaccgaacaacgcgacaagcagcagcaacacgtagaggcgtgacacggccggcgggccgccggcgtcgctgaacctcgcgtactcggccgcgagcggcatgtcgtcgacggggagcgagcacgccgccggcccatccgccgccgccgcgacgcccgcggcggacgcctcgtcggcggccatcagcgcctggatcacggcggtggccgccgcgccgtaccgcgtggcgttccgctgcagcagccacatgatccccatcagctggcactctcgttcgcccgtcacgccggcgccgccctgctgctgcttcttcttcgccgccgctgccgccgccgcggcggcgccgccagagccggcctttatctgcggcatcaccaggctcgcgtcagacagaatgaacagtaatggcatttactagttccgtggtactgttaacccacaattaatggacaccaaccggacgaagtaaaacaacaaaaaaaaattactacagtaaaatttaccttacgctacagacattcttgaagtcatgaacacagaattatgacaagtgacagcccgagcctgagctctctgctttctactgttggcacacatggccttctacgtgccatgcatgttacgacgcattaagatctttggaagaacctatcagtaccaatccatatagagcactgccccaaacaaaaaaaaaagacaaattttgtacgtacactagtaacactactataccattttagatgatatagtatacgctagtagagttctagtggagtatcactactatactaagggggtg

SEQ ID NO: 67549 - DNA, 29213 bp, Oryza sativa
atatgcacatgtttcaccgctctcaaaacattggggattcatctttgtctgcaggtttctagtgtcaataggatacctaaaccaaaacccaagatagaaaagaaacctcccaaggaagaagagtctgctaacaaagagaaaactgactcttcggaatctgaatccaaagaagctgaatccacggaaacatcgtcggaatcagctgcccctgaagagagtcagtctgaaccacaaaagactgacgatttagaacctgaagctcatgatgagttgtgattattagcgtgaaccttggcaccccgtaggatttgttgggatgatactgatactccaagaaggcactttgtcagaggcaaaattttggttgctcaaattttctcatttgtttgacggccaaaagatgaggtgtaggatttccgtatggactagatgctataggaccagcagaaaggtgatccatagcttctaatcgcagcttctaatcgctgtatagcagtattatggtctctatggcatgctgtcaaagttaatgcctcaaaggcttcgacttcacgactttgtagttgcattgtttgtatcgaactaatttgttttgatattgctgagctatagaaattttacatcgattagcagtcttatcatttctgttgtttttgagagcttccagttgaatgtgtgctggtttgcgtcatgtctatcattatatattgtgtttaaatacgtgacaccggtgaatttagttattttttggcatgcaatttttacaacaattgtaaaaataatatctaatctattctattatatggtataagtacttataaagaaaaatccacccatatgattttcacgtttccaaactaaataccttgaaaggtactattgaatttgaaagtattaaaaatctaaccaaataaagtcaacagcggtcatatatttgaatacagagagtatacctcagaaaagaaaatcattctccctccaaaaaaagaaggcaatgctgctggttgtgttaaaaaaaaaacattctcctccagaataaaaaaggcaatgatgtattagcattatatactggttgtgtcaaagtacgctgtgtacaaactcggctacatcatgtggtcatcaggagggttctaacttctaaactatcaggtcagcaggtcgtgcagtgactcgggactcgggagcgccaacatacacaggacacggtcatgcataatcgttgcttcctcttactcatgataaattcatctaaaaaagaagcatctcaagtagtatcaaactccacgatgcgagaagtaggtgcaaagaatcaccgtctcttctttcaccttaacttctttcctgttgaggtagcgcagttgttagtttctcaaccagaaatcggcaaaaataaatgcagaaacagattataaaaagcaaaccatggtgggaagatgtgaataatgtttcctgctagaagatccacgttgtcacatatcttgggactgaagatgatggtccttttcacgctgctattatccatgtcaagatctgttgacacttcccctgttgtggccaactgaaacacaagtaccatggaaacatcagtagcacaaaatgctggtaatgcaggatttgagtgcttcacaattggtcaaaatgaacaaaaaccaaacagttctttttgagagatgaaccacatacattgctcttctccatgaacaagcagcggcagattgttagctttccttccagagaccttgacaaaatctgaactgtaaccccctttggatcgcctggaaatacaacgagtagctacttcagcaatgtgtatatgcactagtgaagcttatttatgaacatgtacgtggtagtacagagctacagatgattaaggcgcacctaaataatcttgctctctgttatactgtcttaggaactcagcatgcctatctttctccatctgcagaatttgttgcatccttccataataaccagatctgccacagagatacataaaacaaataaatgtgaacaaccagagatatttaagtgatcattcggaagataattatcaggacggttatacccatatgatctcacgggcagtgtaaaacagtccatgcttgttgcattaaatacttgttgaaatatgtcagccatagtttgccccttgacatctttgttgatcaaagccaggttgttttgagcatcgtcctattgcaggataaacatatcattttgaagatcataatagagtaagtatttatatcattggttatgttaacaacctacttcctcctcgctagatgtttcaccaattacatgctccaagggattctcggtctcaagattcctctgacctagaagtgcaagtgttctcttcacagaagtagggacctttggcttttcttccttaggtctggtgtgttgatgcaactgcgttgagataatatttagagacaagctaatcgttgtctaagaactccaaataacaaaatagcgcaactaaacactaaccaaaaatggtgtcccagcagaggaggcacttctatcctgtaaactgtcaagaagttcagaaattgaaacatttgctttcttggttgaacaagcaaactctgagggcaaatcttcagtttcctccttgatattttccaactgctcagccatcatggtttcaggagctctgtttgttggcattactgatgaaacttcttgctccccaatgtatgggttttcagtcttcacattcagtgaaacagaactggatccacgtattgagaatttgagcctgtgttcaccttttctccctgtatcaatgaagaaacgataaacaactcacagtgtaaaaaaacagaaattgttatgtacgaaagctcctaaaaccgaattcctcctttatccgtaaggcaaacaagaatatacatatctatgcagtagataaataggatttatggcaacgtacttttgcctgttccagcagataggaatgatatactaggaggaactttgtgcacataggctagctcatcggcttcttccagaacttcatcccagatggttgattcatctggcaccaccattttgttttccttctctctttcttttgaagcagcacaagctaatgacagtcttgttggtgcaagaacatcctgttaatatataaaggcacatgttcagcaagcactcatacgccactgctacaagtggaaatacactattagtagttaaaacaaacttttgttaatagatgccaaatacatttgttagaaaaaagaccaaaaataaaacaaacttcttgttgtacatcttataaagtggtctggtgccaagagaaaaaaaaagaaatttggaatctctctaatttcattgaagacataagtgcatgtcctgccaacctgaagtggtgttaatgaaatttgcgggcgaaaaaaaaaggtacagcagcataacatatcacatttcacatgctgtagcaacatcagcagatgcagcacctcatcagatattgcatcctcagcagaatcagacacatgatcagagtgttgctcggattgaggaccagcgcgctgatcatcacggaagctctccataccaacgctagaaccggtccatgggcgggtctaacatgggaaactttttgggaacaaacaaactgttatcagtatcaaggttaaggcaaatttccagaacagaagctagggttaacgcaaattcgataaagaaaaaagtgcgtgggtagagagagatatgggaaagaggatgtgcgcaacggatgcggcggaagcagcgggacgaacgaggggcgcccctgctcgctcgcgggatggatggggatcggcgcaggcggcggtggcggaggatgtgctcaccagggatggatgcggcggaagcagcaggacgaacgacggcgcccctgctcgctagcggaatggatggggatcggcggcggccgggcggcgccgggcaaacgacgatgagtgacgagggtccgaaagggaaatttaactatttacccctcctacgggcaaacggcggccaagcgtctcttcatgtttttcagtaaaaagtgcttgccggtctgaccatcccggttttcattcggttatgtagaaaattgtctagtttaaccaatttttcgcgggtcaattatatcattgaactaggcattggttttgatttttttttctggttaaacgagcggaccgattctgtttaataactaggcattttgtaagtttatctagaagaatggcatatcacgagtgacggtccgtaaaagcaccaaatagttaaattccccgtcgggaatcatactcatttggatacacacaatacttctcaagttactatgcaaggtccaatcgttagagctcgcgcctgacaattaaatttacaggtaagctcgttcctaaatatttgttaaatatttgttgatgtgattttgagaatagattgttacatacatgcccgggccaacacgaaaatacatggcccatttgacaacttacacgaggatttggcaaatttatagtcattcttcttgtgcgaatgagatcaattaaggcactcatcgcacctaatcctatacttacatagttcatccccactaaatgtagttaatgctatttctctcttctcccattaagccacatcgtcccaattatttctagccttttgatgatagatctatggttcaaattgtctcttctttcttctctcataacaccatgcaatcttaattatttttagactcaaaattcataagtatcaatttgttttagttttaataattatattgaatcctatttgtacatattatgtaacttaattccccgcagcaacgcggcagggtattcatctagttaacttgattagtgtagaattaaaggaaaactaccttttctttaaggtgtttccttccataatagcaattacgctccagccaacactaaaacaaataacactcttttcccaaaagtaacatgcaagtacaatataatctaaaaaaacatatgtattttcttcttgtttttattatatcaatttcaagtagcgttgttcgagacaattttttttcaatatgtagaataaggataaaccgatctcacggggatatgtgttgcttatctcattggtgaaaaggaaaatatttttctcactaaatcaacactagttaagagagttaattaggagaaattaatctcagttggtagaatttctcagctggtagaaacagatagaggttgatatttctggaactacatcaggtggttctagcatcaactctaggggatccacaccccacgaggagtcggagttgacgtcgagtcaacgggaaaatatcctcgaggtatgccatacgacaattttctctttcttcttaggcacaattacaccaggatacttggccacctgggaatataacatatacattttctaacatttgatacattttataaaaaatattttttctttttacttatatgttattctaaattaatattttaatcaaatagataattatttgtttcatagttcctatatgacaagcacgaaaaattatgttctaagatttaaaattatagtaaaaatatatggttgaaattgtaatatatgtgattcacattatacattttgatttttttttcttggaaaatgttgcaccaaaaaatatagctagtcacgattaatattacttaccgatgtaagcagactaccaataaaaataatataatcaaatcgtttcttcatttgattcaaactaatataatcaaataatataaatttgttctttaccatagtgtaggtaaaactaaaaatttaccacattgattttattttctttgggtactttggtcctgtttttttggttggggtgtttgggggctcaatctccgccgatgcacccaaacatgcagccattcatcatcgactcatcgtcgcttattatttactttgttgaaaggttcttgcaaatttcgtagccacaggacataataagctgagtagatcaacaattgtaaagttgttcaagctgatatcgtgtcatatcggttcatattctgagcagtacgcactgtcaaatacagtgtcacagtgaagactaaatgtcagcctctgtattagctgtcttttggtaatgaattaagcacttcgatgctactacaggtgagtagcttcttgccaaccatgcaggaaatcatttgcaaaatatttaatgtgaattctctttgcacttccttcagtcggtacacgtcgttcccagaagaaactacgagtgtgcatttcttgccacaatgtacggcaatctaaccatagagtaaacttcctacttactgataaattatgacacttccttgtcaccatttatcagaacctggaaagttggaaagaaactagagaactttggagtgtgctcagctccatttgcatgacggtggagatggttttgtcagattcaagatgggttcttcttttatcagtctcaagttggatttgatagagttagctgaaagtgtgtttccctattacagccgatggagaaaaccacaaggccaatgccacaaaactgggtgtcatagagcaaattttacctagtagaaatgggagaggatccctctctttctcaaacaaaccaaaaagaaaatccttgtcaccaggatgtcatgttcatttcccaacgccacatcatgtcgaaagggagaacaaaactcaaagaaaacactggaatttctacgcaagaaacgcatgcaaaagaaaaacattaggagagtcaagtttaatttaccaaactaccttaccaaatatgtcactacattgtacacctagctttgagccaatgctttgcaacttttactgatgctatgcgcataatgttcctatagttgcagttgcaaccagaaaatcaccatcaaccgctactcagctacttgggggcaaaatgttagcttttcttcccctgttatatttaaccacaaagaagaggtaaaaatacctagtgcgccttccattttctaagtaggtgatcgtggatatgtcctttataaaccttcatcagacattgcttcagctttgacattgtggaagagctcaacttgatacatcgatcaatcatgtcttctgcatatttacatgcctcgggtaacctctcatcctttagctttgatacgagcatgttcccactctcctccaatggtggaagcccattctccaccatgcatttccacaacttgatccctgaatcccagtctcgtgtatccaagaacatacgaagcgcgagcgaacaatttgcctcattgggccagaactcgttcttgaccatctcactaaatattgccgacgcctcccggagtttcctccccttcagcaagaactggaaaaccatattgtatgtgtccgcatctggaaacactccatcaaaggtcatctcatcaaggtactcaacaatcacctcaggatgcccaagagtgccctgcagcatgatcattgtgctatacatttccttatctgggatgagtccccgccttacgacaaagtcgttccagagcaccaccgcgccgcgcaattcacgcgccttgaggtgtgcggccagtgcggcgcggaagaacttctccccaggtgagcacctctgccggtgcaagatagcaagatagtccatcgcatccattaacgctgtggaggaaccacttgaaatcagtgtagtgaggaaagaatcataggcaggaacattggcaggatcgaatccgatgacgtgccgcatctcgtcgaacacctcgcgtgcaacgtgagggtcgccggcagcctcgcagccctccagaaggatggcgtaggagtcggcgtcggggcgggtgccggcctcggcgcgcgccacggggatcgcggcgcgggcgtcgtccaggcgggaggcgcggcagagcgcggagaggagggagttgagcgccggcgtgtcgcggtccatgccgtacatcggcagctccacgaacgccctgagtggggagctggccgggttggccgccagggaggagaacacggaggcgaaggtggccagggagagcaggccctgggtccgcatggaggagacggtgtcccacatgggctcgaacaggcggttcttgccgaggaggtcgacgacgaggttccacgagtagggggagtgctggtggcggaggtgccggtgccccgcccatcggaagaaggcgacggcggcgcgcgggtgggcgtaggagaaccggagcacctgctcgacgtcggaggaggtgacgcggacgtcggcgtcgtcgagcgccgcgtcgacgtcgggtgccgaggacgccaggatctcgcataggagacggatcttcgggggcaggtcgggggcgtccctgtaggtggggaacgccggcgcggacgggtcgcgggcgcgcttcgccgccggcgaggcggcggcgaccgagtcggacggccgctttggccgctggtcaggcatcgccgccgccgccgccgcgccggggacacgagggctagtggtggaattgggggaggagagaggtggccaaagtccagaggtggggtttttgccctatcccaaagaaaagaaactttcttttctttataaacggctgaagcagcgggaggccgagggggctcgcccacacgcgcggccggagaccccggaatcccaatcggatcgcgaggaaagccactgagagagtgtggatggctccctccttgctcgcctcggcggcgagccaaatcctcgccgctccccgccggggaggccgcggccggcggcgtctggtcatcgcctgctccgccggtgccggtgctcctcccaagctggtgactttcctcgggaagggcggctccgggaagaccaccgcggccgccgtcgccgctcaggtgaaaactttctctccatcgattgcgttcgtcgttatcttgatggaaaattgtactagtttggtgtgagctcgctgtacattacttagatttattgtagtatcatttatcgatcattagccgggatgctccatgaattgaaccgagtacaatgtagcatgacattaggtaaaattaaatggcgagttcatattgccgaaatactgaatatgttctgatggttgtatcaattcctggttagttggttcatgaaagaattgcctttaacttgttcttttccacgttttagtattatgcaagtgaaggcttgaagacatgcttggtcatacagtcccaagatcccaccgcagagcaattgatgggttgtaagatcggtaactcgctgaccgagtgcgctgccaatctttccaccatgaagctggagactagtaaagtaaactactatcttgaaagtgatatcctctatgttttagctatagttatatcataaactggaatgatattctgattcatgatgctgaagaatgttgtatggttacattgtagatgctgcttgaaccccttgaccggctaaagaaagtggactcgcagatcaatcttactcaaggagtccttgaggcggtaggcaatttaactttgctgtattatgggacatgaggataaagcagtcatttggattgatgatttttcatgggataggttgtaggggaggagcttggagtcttacccggaatggactcggtctgttcagtgttagctcttcagaagctgcttaacttcttttcaactcaaaggaatagttcacaagaggaatttgatgtggtagtgtatgattgcaacaatacagaggaaattctacggctaattggtgctactgagagagcaaggtataggttttccttgctccaacttcaccttagcttcccacaggagatagtctctaaacttaatgctggtgctacacaaaagacaggtcttacttgaggtatgtgaaggatctagcagaaaagactgacataggaagactggcttctccttccgcgatgagactaatatacgattctgcaaggccaaatggtaaaactagtgaaggaagactgagttcagagttatggaatgatattgaacaacttattcaggttaattttcccgatttagttcttttgtgcagcaacctagtagatatgtgttcaactagttagctgaaatctgcttttttttttcttttagagaatatcggtttggtttgccgatccctcaaaatttgcatgcttcctcatcatggaccctagaagatcaatctctgtatcttctgcattgcgatactggggatgtacaactcaagctggtggaaatatatgtggagcatttggttataccgaacagcgtttcgaaattcaccaaggagttgcagagaagtttttgccgatgactttctcgtttctgccatttctgccaactgattcttcagcagattggagcagagtgctgaattctttgagccaaaatgcaaaagatttactgaggaatacaagcaacaaagtatacccttcagttagttttgattctgttcagaaatcggtgacccttttcatgccgggctttgataagtctgaaatcaaactatatcaagtaaggcagttaccagtactctttcttgattcaaaggagcacatcatctcagtactactcatctctattggctgttttcgacaatctgttgttttgtctgaaaaatgcagtatagaggtggatcagaactactgatagaagccggcgaccagaggcgcgtcgtaaagctgccgccggcgatgcagggcaaagttggtggcgccaagttcgtcgacaggaacctcattgttaccatccggtagcagtgcggaccagcagttgtgtaaaatctgtcagaagagacccaaactgttataataaatcggtaagttaagtcttatttagacgtactgggtctgatcgtatggcaatattcgttatttctttgttgcaaaatgtgtaaaaagagcaagatttttgcagtgtcatttacagaaaacggaataaatcagcaccaataatctgtcaaatctcccaattagcacaaattccttcagttccatgcctacagagttgccgtctgcatgcctgcgtggaatcatctgagccgtcgataacacggatctattgatccctctgcatcgctgtgttcccctaacccgttttcttcccctgcgaagaacacgctgaagaaaacgcgagaaactaccagaaaaatcgcgtgttcgcgcgctcctccctgcgagtctgcaaacacttcccgcatccggatgcaaccagacggggagaaaaaccgcaaaggaaatgtccgtacacgcgttctcgatcattctcgcgcgccaccgtgctcgcatctataaaaatgatgacgaacactcgtgcatgccaagtcggagtgaactcgcaagattcacgcgaagaagcttaggagaacatcaacaatgtctttggtgctctcgcggatgctgctcgacaggttcttccccggcgccggcggcgtcgtcgccggtgaagcccggccgccgatggactggagggagacgccggtggcgcacgtgttcgagatggacctccccgggctggccaaggaccaggtcgccgtcgaggtggtggacggccacatcctccgcgtccgcgccggcggcgaacacgaggacgccaataacgcagccaaggcggggaaggccagcggcgaggaggaggaggaaaacgacggcgtgaggtggcattgcagggagagggcggcggggaggcggcgcgcggccgtgacgcagttccggctgccggaggacgcggcggcggacgaggcgagcgcgcggatggcggacggggtgctcacggtgaccgtgccgaagcggaagggcaagaagcggcacgccggcaacggcaaggcggccggcgacgacaagccagtgtgctgccgcttctggccgtgacaccgccgaggccgcggcgcgcgccggctcgtgtgcccgcgtcgcgtcgcgttgagtcacccgcacgacacgagcctgtagtagtacatgtcaagcctacccgtcaaaaatcttgtcctttcgccattggaattgccgtgccagtatggcgcatgagtgcacttgtacaaaatataaattgggcctgtttagttccaaagtttttttctaaacttctaactttccatcgcatcaaacctttcatacacacataacttttcaatcacatcgtttcaatttcaatcaatttttcaaacttcagcgtgaactagacacagcctaggtgaaaatggcgatctctgcatttctgtgtgcttgtggcagtgaactcagcgcatatggtttggtttgcgacttgtgacagtgactagtatcccctactgcctcctctgacaacctgattaattattccagatttttcttgttaacgagatgattttgtgcgtgaaatgttagttaggtagcggctcattcaattaacgtggttcgcgttgtcgtacgggcgcgcgagagcgagacgggacggttgccgcgcgacgcgatgcgcgatccctcctcacggcggcgttggccggggtgggtggtggcgccgtcgttttccgggggaattatttgctcctcgcaacgctatccggccgcataaagtcgccgcataaccactgttcgctggtactgacctagcaggcaggcaactaggcaagccatttcatctgttcctcgtggaccattttcgtggcattatcaggttcaggtatttggccattttcgctaggaaaatactagaagagcggtaaactactactccaaccttgcaagacgtaaaaaaaaaaaatcttgtgtcgcactgtagcctcctaggcgagtagaaaaatatttaatgtaaatctgaaaactaccatataatataaaaatgaacatttgagatttgtttaagagcactcataatgccttacatctattttcatattctacaataattttcaagttttcattataataggtggaccctgtgtgttgatgcgggagtttagtatgataacactgagtaaaaataatgtgtaagatagctagatactataaacttacgtaaattgatatggtttatgataattcaaattcaaatagtatgtagaatgatgattcaaatgaaaagtaagggcatgtttggcttgcaggtacaacagctgcctgtagccagtcgtggccggccgctgcttttttttttgtgcttgcttcactgttcctacatgctgcagtgttgctgcagctgaacagaccctaagttgatgtggctttacgagagaagaaaatgagggagatagtttggatcatagattaatcatctaagggctaaaaacaattgaggtgatatgatttaatgagagagagagagcacattttaactaagttaggagttaggatgaactatataagtatatgatattataaaaatgatcaagagacattgaaatattatgcgaattatgtgagatgatgatttaacaagcttgcatttgaaaagctataaaatttaataaattataaataatataatatgcttgcatgatgtttaaatataataattgttaatggatgatgatgtggtatcttttcatgttatgctttaggatttagtggactttatagtaagagaggataggttgtttccgctgcataattttccgagttatgttgggattaagatcctctaacttacttctctctaactgatgtcattgatatgtgggccctctatatagtaggctcatatgtcagtgactcaaagttagagagaagtaagtcaagaggatcctcttccgttatgttgtacagagctcagaggtgggaaggcataagcttttttttaaaaaaaaaacgagaacggcaagagcattgccgattatattccgattatattagagggaaaaaaggcataagcttttttgagagtgctgtaaaattaattataattgagcatgctggggaaaattaattgtgggtctaggatgttggagagtttgcttgtgcacgttggatcataacaaacatttggaaacgcataatgagtagttccacccgaattgttctgtcaaccaattctttccgtttaagtcaatccctcctatattttgtaggaaaagcgatgggacttgagctgccccctctgttcaatgatcagtgcacaactgcgcagcaactgggatctcaataatggtacaagatgaaaattgacagtaaacttattcaagtcaggttgtcctctgtttgatttgtgtgcagaaccgaagttctgagccacgttaccaagaaaaatgatatggtggacaaacttgataaagtgatacgcatgctaatgtagaggactacatccgacatgggttgaccatgatctcgcaaacaaacaacgaacaaggaatggaacaatggtattggtagttgatagtctataaagaaaataatctagtccaacttgctagatacaaccttctactgttctacatactagcacgagacaaaccactgcatgcaccaaccaccaaacactgatccatttcaaccatcatgtccttgccaaccctggataagttctctgaaaattcgtttactaacttcaatttcttaatttgctaagagtagtagtactacctaagaaacaaggtgcaaaaaatacgacaaaaacaaagacatgaaaaggtagccggatagtaaatgctaatgaacaactactagatgatcaaagatattcagagaatcagagtgatgaccgtaaaaagaggtgccaacttctgaagagcatcaagctaagcttccataaactcttttacatggtactgatactgatcagtgatcactaatcactacgcacaccaaaggaagtaaaataaaaaaaaaaagaagaagaagaacagatcatcagaagcagagacctattactatgtcgcaggaaagcagaggaaggcggctggctaagctttggctccaaaagttcagagatttgctgcaagcctgcgagagagcgggtgtacgtgtcgatctccggctagtagccgccgccgccgccggcgttggccgcgagcttgatggacgacggcagcgggctgcgcagcggcgagcgcggcggcggcggctgctccaggcgccgcccctcggcgtcgtagtagatcacgccggagaagtccagcggctggcaccgctcccccatcagtatctccttcctccacaccccgtcctccgcgcggaagctcagctccgccccggccttcctcctcctcctcgacgacgagatagccttcttcccgccgcctccgccgcccaggaacggcacgatggcgcgcgacgagaacgacgccgcgatccctcccgcggccgcaggtgcagccgccgcgccgcccgcgacagccgcctcgcgcacgtccccatcagcgccgccaccgcctgcgcgatgctcatccccatcgccgccgccgccgcctcctcctcctctcctcctcgcgctcttgcttcctcttcgagaccttgatggctagcttagcttctcttctcttctctcgcgcgcttctgcgtctccttctgcgctagctcgccattcccgcgggtatttgtagctggcgagctggtcggacaagtcaaacaaagccggttgggacggtgtaattaattaataataataatcacttaatcaccctgttcatgcttgactgatgcggttagatgacctgcttagctagctcgattggattaatttaatctttttattcgctaatggatggctgtggccatacctaggtggtgagtaaccttgtgtccctgaactacacgtacttgcgagcttgtttaatgaagtgaaaatgatggatttgtgcaattgtgtgcttgtggctgatgaatttacatgtcaaatttggccgttttgactggtgcgtgttggtggcagttgaattaaattaaaacctaagccgcgcgtaaccttgttgattgagatttgagcttggagacggttggggattaagagagataattaaggatccatggtagcctgctaggggttgtgttggcttggctctgtactgcaaagtgcagacaatgaaggggtattaaaggagatggctaatcagaatcttccaaatatcatcgtggtactatatagacctatagagagcatacacttgggaagaaggtaatgtgtcagtatttggtactagtacatgattacgaataagtgtatccataatcccactttgcctgttcataattaaaatccataatcgagtattccctccgtccaaaaataacccattcctaacatccaagataaaaatagtgaagcgtgagaataaccaaaatgctattaatcattgaaaaaagtagtaagagtgataggtagttaaaagctattgaaagagataaagtttctcgttttacatgccgtgggtagattggatggtataagttagttttttgtgagataaaatttaaaatctagaaattgagttttttttagacggaggagtaatcctatatatctgtaaaatttatccccactaaatatagttaatgataattctctcttctctcatgaagccacatcaccttaattgtttttagcctttggatgattcatcgagggtgtataatgtatctcttcacatcacctcaattgtttttagtctttggatgatttagcaggagtgtaaattacacatcttcatcctaaaggcacaccatacaacctaatcatttataacctttgtataattgataaagttacaaaaatatataaacatgcacataaaaaaatagtatagtaggtaagaaagaaaattttagaactcatatatactatattatcacacaattcttccacaagaacgcgcggggtacccatctagttatatatacaactctgaccgaagtgaaggagtcggtcaagttgatcgaaatcatcggctcgatcaaatgctcaataaacaagtgctaccagtcaattggagcgaaattaaaaataaatcagtgtgcacacacctgctgctacatctacaagcataatcatatcggctaaacagaattgaaagaatcaatcatgacacgctcatcatgattcgtgcataagctaatccagacagttgtacgtgcaccgataatcctccctcatgtcgatcgacagatctactcctacctaccaacaacgtcagatcgattagctccccgagtgcgcctgtgcactggccgtcgtacgacgagtattcgaccatccgagctagtagccgccgctgctgctgctgcgactgtgtgcgacgtacgggtgttggatgcgcgtggttggggcggccggaaaagcgcgatcgatcgagagatcatccagtggcgttgcgaattgcgatgcacgccgctagctgcatgcgtcgtgcgagtgcgccacatcgcggcgggccgcgggggcgggggcgcacgagaaaatgctcgtcgtttgctgtccatttcgaagccccggccggtaaagttggccaacatggtcagcacatgttggcgtttccgtggtggagggttgatctagcccactaacgctagctagcaagcttatcgcgttcagaattcgggtcgtggcaaaagtttcccttccactgctccatggtcatttgaagataaataaaaatctttggggttgttttttttgccggaatgaccgaaggaggtcattcaatgtaattaagataggaagaaaatattacaagaaaagttttacatcgacagctgactgtcgaggaaggatgtgcaccagagcacacgccccgaaccaagtgccaaccgcccaaacacacactatagacaggaaagccaagcaccgaaccggccatcgctatgcgagaccgattgccacctggccaacaacaccactacgatacgaagactcaaaaacgacgccctcacgaaggtcgcgatgccgaagacgccgtcgtcatccgtccaaagaactggactaggttttcgtccagagctccttgccgagggaggagggatacctcaacaatgcccccaggagggttaccacgcccgaagacatagtcattgttggcacaaagacttgggctaagctttcgctcgggatccctaccgccgtggtccgtcgcccaatctgaatccaccatctaaacatcggcggcacatggcttccaccacacccgaccggcgcccctccgtcggtcagctttcagtcctgccaatgacaagactgccaccacaccgcaccgacgccccgccgtcggccgacttcctcgaaccaccatccctgagagctggtccaggacccctccgttccaccacccgccggcctcctcgccagatctggccgaaggagaacccgggactaggtagcattgcttcggcagcctgagcttccccactgacaagcggccgcctcaatccagcctaaaaactcctcgcaaagagggggatgagctctagaaagggtgagggtgccgatcggcaacgaggaagatgacccaccgccgccagttccctttgcaccatctaggcctgcgccgacaccggaaatgcagccgcacgccgccgccactccaggctggccgcacgccttcctcggacgagcctcacgcgcgtgccagcctctgttgcggcctccactgcggcctcctcgcgccggcctgcgctgcctccgccaccgcgtcctccgctgcctccgccaccgtggcctccgcctccggccgccaccacgtcctccgctacctccgccaccgcggcctccgctgccgaccgtcaccgcgtcctccaccgccgtcggtcgcgtctccgcgcacgccggcctctcaccggctgccgctagccgccgcctccacctcccgtcgtcgcgcacgccggcctcctccactagctgccgccagccgccagccaccgccagacgccgctgcctccacctcccgtcgttaccgcctgagagcggcttgctccggccagctccggcgtggaggcgccggatccacccgtggggaggccggatccggccgcggcggcgccggattcgccgcctccacaccacgtctgtgacgcctccgcaccgcgcgttggcccgcctgtgatgcgtcgagacggggcaccgtcaaggtttggcctcgccgccgccatctcggctggccgctcggttatccggcggcgggctccggcagcggcgaggggagggagagggggagaaagtggcggcggcggcgctaggttttcccctgtgtcacccgcgcgtgggcgacgcggaggctaagctaccggaattcttttcagtcaagttttatttggctgagtaactaatctttggggatgtatcgcatgaagctgggattatacctgaactatcctattatagagcctcgtccgttacccataagtttattataagccataacaacttattagcaattaaaaaaactgatttcctattatagagccattttataagccataacaacttattagccatcagaaaaatgatttgcgaaaatttttatatatgtgtctttaacaacttaaaagctaatattaaaaacaaactaagttgaacatatcttaaaatcaattcaaaatttaaattttgactttagttttagtttttttagggtaaccgatggggcaataattggcatcgtttttaattacaggcgcaaatataagttgaatccacaacaatcagctgccacattttacatacgtcccacacgtctcgcggccctcggatcggctgatatgcacgcacaagtgactgaacatgtggatcagtggatgcagcgacaggcaggacatagagcggccactactactagctagtggccattattgacgtgctctgctcttacctcatcacattctcataccccagtacgattcctacgaacacttttgccttgggtaagtggtgagttgagtgatctacagattgacagcaccgtgtccctcaatcaatttgctttcgccggcgccaccacttgcaaccgcggcgtggcgtctctcttcttgtctgcattctcgcacttgcacagttgcaccctctgggaaaggaagcacgagggtgaaaagatctcctcgcttcgctcactcactccatgctcatcggtttgtgcatggatcatatcttctgatctgtaattgcgtggacacttcgagcagtagtggttgcagactgggagggaatgtgctcgcaagttgcagttgctgatgatgtgggaatgttcagaaagtgcagagacactttcgaagttttgataggcacaagacaacgatcgatcacagtattattcttagaatctctagttgtgtacttccattcaatgtttcagttgttctctttgggtagtttgctcttgcacgtagcaaccagaaattggttaaccctgagctgagtggggtactggtgttcgccttggtacagaacgtaaccatcttgcattaacgaattagggataggtagggtgatcaatcagcatccaggacttatttagcaacactgttttcagaattaaggtgtgagtacttcttctctgctctggtatatgatcaagcgtatgatgggccaaatttaataggtgtcgtaccggccgtcgtacatgaacatatatttgaaaaagaggttgttcaattcactgaaactctgaaagacagacgaatcttctaagcaagcatatcgattgattgttcgagaggaatcaaatgagcgtgcactcagagactttggtgtatactttctcagactaaatttgatttagtctttcgctagctgcagttgagcaattccagtttgttgtcgttatcagtgcaagtcatctgtgcgtgcaagtagcgaacgaattttggtgcaagtgcaaccttgtatgggagtaattttttcctttaattttgacccagttctttctttattagaggattaataagctaagagaggatggccctgtccccttgacagggatgcttactggccgttcggttgccatgtaaaggaatagagcgagctatggtcatataatctacatttctttaagcagtttgatcataagaatattgaatttttttccagaaataaacaagagtcttatgcatcattgtattaagaaaagtaaagttgatacaaaacgaaccgtacaaaaacaaaaccagaaggaagaacatgaagaagaaaaggggaagaaaaaagaaacagcacagttggtctattcctgtgactgaaaataggcggcctaaactctggcactatatatgctgagctgaggccgtcctagccacagccgccaccgcgctgcctcctccgccattgcctttgccaccttgggctagctccactctatctgattgaacacgtgattgttgtgctcattccatatcattcaagctccgagtgtaacgaccgtgtcaaaatctctcctctgtccttttaggatctttctctggctattgcaaagccggaggtggaaggagtgcccgttgattgacatacaataacactgtcgaattgcaccgaggactgtacacaaaagttttcaggattccagggagacatctaggatgtggtagatagtctcctcatgttgatcataaagaatgccatgatccgagcgtggtagcccaatgttgcttagccggtcaaccatctagcagcgtcatagtgccaccaaccataggaagtagcgacaatgtgggggtgcgaggggttctccaaatcgataaggaggaaggacacaccctagaaaaaggccttggtaagccgatcacaaggagtagagacatgaactctcctatttccagacgaaggagtctagctggcggagaggctaccgaatgacctgatccacaaccaatgctacaagtattccaagatcgcttgcacaccgagggcatcacagatgtctctaatccatctgttaccttgtattgcttgagccaccatcctacggcattgggtgtgtgtgggaatacgatcgtggatggtcagtggtaaggaatggatctcaacgtcgtacatccagccttttcctcccacaatagagccaactcatcattacccatgcccatgcaacaggacgtgaaagccagtgcgaaatcgtgcttcttgttcgaacaaggtatcatgagtccctgccatggtttcttcggtgaggttcagtgcaactagccaaccagatttagcatgatgtgagagcaataagattgaggatgacgagatcgccaaaatttgtttggtcatagactcagcagtagccgccctgtgcatttgatctacctgcccagtggaacctataatggatcttgttgattcccttgattacccattttaggggttccacgccgaccaaatggtaaatagatatggaactcaaaactgccttcatcgtgatgatctagcttataagagctatttgcttcgctttcagcaatcggcacaccacataatcaatgagaggttgtaaatcttgcttccttaaccttcgagaattgagcatagatcaggtggtgtggtgtgaaggtgttcacccagtctaagtaggttcaaatcctgaacccagggcacagcgggcagctagggcttgagccctaggtttgcctctaaaattttgttaaatcactatataaattttatagaaaacaaacactctattagttgatccatatcctaaccttagtcttcaaaaattctgactctaccatgctgaatccaatgtgtttcttatgaggtttcttgtgcccccttcttctttacaaaattaaagtagctagttcatcctagttattcccttgagaggcatatcgaatatggattctgtagattagaaacttaggcaaaggtcctcttgctgcttggaaatctttcgtaggaacatagagatcctccaaacgagcagctgcaggcgtgcaggcctcttgcagaatcggaatatggttcacatacaacgccttttgcaatagtgcgtaatgatccaacagctagtactaattactcaatttgtgcttggccattgatttgtaatgataatctaggagtatatgcgactgtggccggtagtgtgcggtgataggcatcgaagaataagaaacgacgtaacagagaaaaatgagcgtctaataatgtggccccttgacacctttcggccagagagttatttatgtgcttaatcgcattctgaaccactagtccggggctctacttgcagcgattaagttgacttgggactgttcgatgtgacgcggcacggcggtgatgagcgggccagcgttgactcaacacctacaaagataagagagatcgatacactgtcgaatggagaagaacagtcagcgcgacaagggtagccactcactcagtttcatactcagatgatacactgtcgaaggagcacatctcgttgccccggcgtatgggcatatggccgtgtgtccgtgtgtctgtgtgcaatgcccacctcacgtctctcgggccgaagctcacggaggaaggagagaacggcaaaacagggccggtggaacgaggccggaaagaagggacgcgcgcgatttcatgcgtatctccgtgattttcccgtcccgcgcgcgacgactcccgagtcacatggcgtcacggcctcgcgaccgtgtttgcttttgtggccaccgcgcgcgtacggcgctcggcacggacgcggacgcggcaaccgagccgcagaaaccacacggagaggtacgtacgcgaggccgcgaggtcgcagcgttgcaccggcgttggccggatcgcacggagaggctctgcactgtgaggaagaatgtgccttcgccgatcgctctcattctggaaaaggaacagcgatgtacacaactttctagagtctgctagggcatccgaagactggagtcaccaaattgttgcgcgcactggtaaatttttaaggtatcggtgaaagaaaagggtttgcggttaaagtgagagatgctcattcgacgacccacaaagagtaatttaaaagaggagatttaattagtatgcatgttagtaatactttgtcaatgcgttcccacgtacacacacacacaaaaaaaacctagctaacatgcatgttaatgtcattaactcttcatccgtgtcatgtagccaacgatttttgactaatatcctagcaactttgtgaattaaaaactgaaaagtggaagggcaataagagccgaaaggcccgaaaagcaagagaaatgttcatctcagcatatcaggcgatggaacagaactaattcccagtccttatctacaaacacctacaggtcaagcagaaccggattcctgcacgaattagagccaacaaaccgaccaatgaacggtcccgatgcaatgcaacgaaatgggcgcgcgcgtgcgtacgtgttcgtacggattttgattattcctcgcgccggcgccggcggcggcggcggcggcggcgaggctccaccgatcatcgatggcggatggctcacatgatcgcgcaggcgttggggttctcctcgctgaagatggtggtgagcctgttggcgtcggtggccatgcggtagatcccctcgcgcaccggcgtcgggtagctgtagcggtactcgccggagaagtactcgtgccgcctcggcgtcgccgcctcccacctcggcagcggcgacggcgtgtaccggaagtaccccggcggcgccgacgtggcgtggcgtgccggcgcgtgctcggcgccggcgttcggggcctgctgcgtcgtctgttcttgctgctgcggtggctgctgctgttgctgctgctgctgctgctgctccggtggcggcggctcggggccgaaccggacgcggccagacttcttgttcttgccacgcttcggcggcttcggctcggccggtggcgcgtcctgcgccggcggaggcggctcttgctggggttggggctgcgcctggtggtgctcgtgctcgggcccgtgttgctgctgctgtgccggcggcggcggcgtctgtggctggggctcgggggattgctggtgcggcggctctgcaggcgggatcacgtagacggagttggcggcgctgaaggtgaccgtgcgcgccaccggccgcatgtagtacgtctccgtgggtgggccgggcgggtaggccatggcgtagtccagcctctcctcccgccaccccctctcgcgccctgcatgtcgccacgcttcacaactcttagcaaaaaaatgaacttcgcgattttgagattggtttggacatttggtacatgaacattgactaacattatttatcaaattattaatccattgtcctaagaaacatcacacatcatattatcatttacatgtggctatgtgaggacgatatacatgcttttgaacgggttttacatgtgagattattagctgaaaatctatcgtacttatagtagcgaaaacttaattaagcagcctgcatgcatggctgcagattagcagaagtacctagttcgatcgatcatgtcctagcacgtgatcgatgcagaccacgacgtggcaaggaaaacaacatgtgcagtgtagaagacgacttaccgttgcattttccgagagctttcgacacgaacttgcccagatgatagcaacccatgcctggctcggccttagttttcctcttatctttctccctagctatctcgctgggatgtagcgatgtatgatgcgttggtgcgcgtgtgctcgagtgagcctgtgcgtggaatacatgctagcttaggaggtcgctcaagttcacggtggcaacgagagagaatggaaggaacggggccaatttaaaaggagaatactacgatcggttggtagcaagagggaatccggcaacaatgaactcctacctaaaacgcctcttttctcctcaggggaaggcatcgactgaagtggcaggacgcacataaagggtggtcctcgttttcgtggacgttggttcgagctaacaagtggtggcagaatatattctgctcggccgggacaatgcgtttgtgggagaggagacgcctaactagggatgaaaatgaggtggtgcatgctgcgtggtttacatttgtcatacatggcacaaaagggtttgacagatttgaccataaggttgcatagataaaattaagttgctgtcttactctctactcctacttgcgtgtcgattccttatttttgtaccggtgaaacgtgctagcctcattttcctgaaggcaatctgtttgcatgtaaagtagaaagctcggagtaggaaggtgacctttttttattcagggaacgcgaagccaaaattgagtaataggctggcgggttgtgactggtgcagacggcagaatggggcgggcaatggcaaggttgaaatctgttgctaggtaactcaaaatgattaactcggtttcaaacaaaaaaatgattaacaatgttgttacgcagaaaaatggttatatggtcgctaaagagctaaagatttattattactgcaaaaattgtagcaatagaatagattatacaaaaagcagatgctgcggtctaattatccacaggcaatgaatccatatatttttctatgaataactatatccttcaacttcaagcatcctatcctaatgccaaccattccatcctgcattacgcaggattctagcttaccaacatgggcagttgggcacgcattccccatttccgcacctccatgcttaggctccctaaggaacaccctctgagagcatgaagagttcaaacacaaacatagttgatcacgctacagttgattgcaacgcttttattattcccctcttccatgtggaagtctctggttcaaacctgagctcccaggtcggccagtagtgaaggtcctgtttcaaagtaagcacacgaggtttgccattcaaatggacggtccgcaccctaacaaattcaccattttccaatccctgaaataaaaggttatcagtattaattcaaatcaattgaacataagcttgccaggtcgatatatcacatgaaaagacttgactataccaaaggaagataactattgataatacgtaccttcaccacttgtataaaagtttcaagatctggagttggcttcccattaacttccactatccactgcagagcatagagaccatatctatgtacgggacttccatgacaccatctgcataaaatatttgatactcattcctcgttcccattaggtatctaaaatgtgcttaacaccaatgctatggacctaccgccaagccatgtacacatcttaaattttcaaccaactctagatttaccatcaaggagggagaattctaaatgattacatatatatgtatataagatttggagcgctacactactattatgacattgggagtggaattagaggaaacactatcaatatggcttttatgaagctgatttgctgtcggtgcccaagataacacaaatgggtttcattattggataggatgtactaggaagagattgtaaagttggaaagaacaaaaaaaacatgtgcaattgaaagggtagagctgaacttgttgagacccttgaccccaattcctgttctcttccctttatcaggatagggttactcggtttacactctaccctgactaagtgtactcaccagggttgttagattcaaatttaaaattttatctaatatcgggcacagctagtgaccataccaacttgagatacatgggaattgtagaacagacaaaaacaaaagacatatcacaaatgctcgcacttctcaagtgttggcatccctgaacccacagtagctataggcttatagttccaatcaaagaacccatagaagcaacatataaattcgggtggagcatgttctcacctagcaacataaactccatgaccttcttcgggcaaaaaaccaagtgcgcgcactgctgaatgaggatcctggattatgcatccacaccaattcaccatccgtgttgttccattgccatctcttacatcggttccaacaataagatcaatttcttttccctgttaaatgttgacacggttgaacacatagatatttagattcatacagtttcgtcaaaaaaaaatggttggtttcttacaaccagtcctcacctgacggaatattgtcatgttaaggactccatctgaatcaacagattggtccaatttctggcaagcattctcgatatctaggaagcatgtaattggctccttattgatagcaaggatcatgtctccctgttcaaggagattttctgctttggatccagccaaacaacctttgacccgcaaaacttgtcttcgcacagggtccttcttagctagagcctgcaaggataatcatattgaacagtaaatatttcatgcatccaaaacctctccacttgctcataacactagcatattagacaagtccaaaaccaatcaagcgaggtcctttactcctcttccttacaaactgcagcatttatctgtcagcgaacacttcaagtgaatggcatgaatatttctccagaacaataaatattgcactcgcgtaattacatagaacattcaggttgacagtccatcaggaaacgaatcatagctgtccgaccaagcagagcaacttcagaaaagactaaaggcaaggccaacgtgaaattacctgcacccagctatcactcaatccataacttcttgcctttgaaagcaaagttggatagagttccacctccagaagtctgatgaatggtattggcctcctaactccattgataatacgaaatggtccaggagtaccagagattaccttctcaaggacttgacttattgcatatattggtatacctctaacaaattgatgatcctccgaactgctacaaccatatttcagctggagaaaataattaattgatttacaaccccgataagcacatggaagaatggctaaactgctaagaatggtgccattataccattgcttacaagcattaaatgtgtagggtatgaattaatgctaggacaaagaatctatcaactttagtcaaacatgcagaaaagtctagggcctttaagtgtagtgaatatagtttcttatattgtccatttagttgattgttcaagatatcaaacggctaaccttccgtgtaagacggcgttttgttctttctttttttcttttgaataaatgttcctgagaacgtgcaagcatcattacttaggaaacaggctaaagcaaagcaactgtaatgtaaactaacctgggtggaaaagcttgcccataatgcttgaactcttccttgctcatccgtcaatatacccgcgaatgcactaccaaaatctaaaataaatatttttcaat

SEQ ID NO: 67550 - DNA, 191969 bp, Oryza sativa
  unsure (1)..(191969): unsure at all n locations
gataatgcagtttagagtactatagtaaatacagtagccttactttaggcggctaatcccgtcaaacctgaccaaacccgtgcaacgaattcctccgggctttgtatctgtattcttggctgttcatcgcaaatctgctcgttcaaacttcaaaaggccagccagcaagcagtagccagtgtacataaaagcacagtgattttcttagtgcatctctggatggacatggcccgttaaggagatcagctctaagcgtggtcatttgtggaaacaacacctagcacagggcagtagtgtagtacaagggtatttttggcaaaaaatattgtggcattcttgtaattcaacactaatatagggtgtaatccgtaattgcacacgtcagcaaaggccgtgggagtcgaccagatcgttattttttttaatcttcgaccagatcgctactgattaattaccagcgttcgtgtgaacaataatttcatggattagttagctcctggacattgctgaactacaaacagtgttgagatcaacagtgtgaacaataatttcatggattagttagctcctggacattgctgaactacaaacaatgttgagatcaacagagcattagttccaggccgtatcattgtttcttgccgcggtttttttcttctcttaatttcgcatgaagatgtgcatttcccagtttcatgaaacagacaaacaaaagttaaaagtttacagttttattcccagtccatctgaaatgaatggccaaagctcctgccatccgtttcggtaaaaaaaaatgtcagcgcaaaagttagtgaaatgcatattagattctgtttttagaagagaattcagagcactgaaattcaatttccatgggttttgaaaatacagggcaatgaactgaagggggaaaaattataagctagcagtgcaatatccagtactgtcagaattgtgatcttattacatttaaactaccttacccttttatttcttctacggttaaatttgagggtacaaaaatctcaaggtgtaatcatgaagaacaaaatatgagccaccaatgcaattttcagtacgactactttcatgcacttccatgccttctgtaatactgaaaatctgaatcacagaaactgcaacgaattcgaaaccaaagcaaaacacttcatttcttctcctcgcagagattctcaacatcaactgatctcctggcgacaatgaattcagagatggcaatatcaactgttcgtctgctgcaacataggaaatatatgatgcagttagactgtgtaataattttcagaaaacattgaatttaacatccatcatatgttaattatagagtaaattgcaccaacggtacaacaacttggtagatgggtgcgatatagtgcaagaacttgagaattgaacgttcgagtgtaacaacttgacaagtgggtatgttctagtataagaacttgacaatttagtattttggtgcatcaacttagctaagaatatgctaggtgagtttttttcacgatgtcaatatgccattacatagcaatcctagggatattaccttataatattgaatttaatctttaagaattatactgtacatccaattaccttaaagaatttttgttttcttcatcttccctaatcttaaccgaaatataataatttctacatccagtttaattgactttcagttattagttattaggataaaaatataaatatgcttatgtacacatccatgccagtatattgtcaaaataattacttaaaaattgaatatgtataaatagtgctccaaataattaagttgtcatataacttcttaacttattgtatcaaaatcatacatatcttgcaagtcgttgcatttaagcgatcacttatgaaattcttatactaaattgtacttagctgccaagttattacactagaacgctcatttctcaagttcttgtaccaaattgcacccacctgctaagttgatgcaccgtgtgtgcaatttactcttaattatataagcccaagttgaaaaacagtgcatggggaacttacacagtaattacaaaatcacaagaagtctcacctttttgtaactctaaagatacatctagttttcaagaatatatcaacaaagggaaaatcattatagaacttatatccttctgcctcgcttctaaactccttggttatcacactttcattgtttgcaacctcctccaaactaatgtgattgtcagccattccaaatttctgcaattcatatttccaaagttcaactgttagtcaaaccacaaaatttaatacaaccaaaatgtacttatatgggcaaatgatgaatcttaaaaattccacatttagagtcatctagtatactaagcttatacggctgttatgtgtacagtgatggcagaagtatacagtaaatcacagtttaagggctacatatatgcacctgatcaggtaagttcagggttaatttcctataaccaattatacccatatatagatttataacacaactacattcccaataattgaatgattacactccattgtgaatctgacaatttctgttttcataaataacattaagttataagtttactgctaataaatccaatctaatagcatatatagcatcaaatttaatctagcacagttcacaccattcaaacattattgtatttatgtaatcgcaggaaagatcaaacaccattcaaacaatcctgtattcctctaatcaatagcaaatacttcagacctgtctttctctattctatggcagctagcaaatcctgaagaccttaaactacgacggtaattaatcgattagggaaatggataatcttgctcaaaaagaagccttcctaaagttttttgctgagcagctgctgcattacctgaataaaaatagagaggtggcaatgactccgattccaaatcagacgagggtcggcgactccatgcaaaacgagggcaggcggccgttggggagatcatcgagaatcccggcgtgggtcagcgaggtgtccggcgggggaaagcgaagggaccggcgaggggcaatgaagcgccaggggccgcgtggtttgtcggcgccggaccttgatgactaaggtggacggcagtggagggggacgacgagggcttttcggcgctccggtggagggacggcgtggcagcggcaccggcggagcgctcgggctctggtggaggggcggcgcggcggcgcgctcggtttggtggatgagggcgatggaggcggcgaacagaatcaacagatggtgggggatcgggagaaacgatgaggaatactgtgcgaacgcgaaattaccgaaatatccttccaccgaaataaacataaagactaaaatgcccatgacaattaacggtcagatataatcttactacactactacacgtataagtgggggcactgtaaaacgtccccgcaggcaggaaaggcaaacagctggggcctccagaaggaagaaataaacacaggagaggacaaggagatgcacagccattagcagagaaaaaaaagggaaggagtaaggacaataatcataacacgcataaaattgtactactacacctagctagctgcgcggaggaacaagacaaagggcaagtggtgaaaggaatcatggaccagaaggatgatcattgccatacggttgaaaaacgccggagatatatatatcgtcagattatctatccacccccatccatattctttgggtttttaaattacacggcctcggagaaagaaattaaggtccgaagttaaaaaagagtgagaaaaaaaaggatcgcattttcttttgtgagagctacgaggatccacccatgcaggaaaacccgatctgatctgcagatatatgttctggtgatcaacagttcaacacatggagcgatctcatgcacgcccacacaaattcgtgtggttttgggcaaacgcagccgtgagctttttttttttttttccctgaagctcctgtgtgtcatctctctttttcttttttgagctagaattggcaaaacttttttaatccggtgtcttttcatccgtgttcctgtgaaagcagcgccgaaaactacccccgctttgcaaaaagaaaaaaatcctctcgcgctttgttttttttttttttttttttgcctttgcgacctcatcggcatccgctttgcgacccggccgatgaagagggggaccggggagacggacggacgctgtgagccgcgaatcccaccagcgcgtgtgggcccacctgccacgggtgacgcgccggccggtccagcctccacgcgagcagcgggtcgggcgcgtcccctctccttggcggtcacgaacactgaaaaacccgaatccgataagcggccgctataaataccgggccaaatcagggtttcccttccccagccgcaccgcacgctttcttgcataagaactcccccccctcctcgctccccgccgccgccgccgttttcttggagaggagaaatccgtaggctcagaggatttttggtagtcttgtttcgtgatattcgtgaagagggggggagctaaggggggattcgtaagatcagaattggatcacgcgggggcgcgctcgggatcgggggttccaaacacagcttcttcgttgaattgtaagtttcttcgctgaaaccctctccgtaggttggtacttctgatttttttttcctttacagattttgtggtttgtagggcgtattgctatgtgttgctattgtttatgatgggaattttggtttgttggtgtagataagcttatctatgtaaaacaaaaggtcagtaggttacctctttgatcttgcttgtgcagttaggctatcctgtttgagttgttcgtgatttgcagattactgcaaaagctatcctgtaaaatttcttgtcgtggtaaagattgtactaagaatttttgtgtgttcagatcctaagacatagaaaaatagttttttttcgtctccccataggaatataacaaatgttctttttctgtgacaccatgatcgaattttgttttttaatgcaaatgtatggtattatcattaacataggatgggatcagggacgaaacatatgtgaatataggaacatttgcatatgtccaacggaaaagtctcaactctaaatcttaatccaaatgacatcacgattgtaaatccgaccagatcttaaatctgaatccaagtgagactcaattgtaaatctaaatataagaaagaatactgatatatgattcattgtaaaggacgctgtggcttgtaggaattgagtattactggaaaattaggaattgaatcagattgtgagatattaattgacctgtcctgttgtggcatatttactcctagttagaacttggaatctatcatattgttatgtaactgtttactctttggtatcgttttgatagcttcttatctcagttttacttttttgcattaaagactcagatgcttcggtctggcacatatatcttctacaaacatatgcccttattttctctttgggccatatatatttgtctgaacctgatatttaccttgttatatacttgtgcagtaagtggatgtactaatggagtcaaagggtggcaaaaagaagtctagcagtagtcgttccttgatgtatgaagctccccttggctacagcattgaggacgttcgacctgccggaggcgtgaagaagttccagtctgctgcttactccaacgtaagcatcaaatacagatttaattccctcctttgtatcttccgatgtgttgctaatcatgtcaattgttccttttgttgcagtgcgcgaagaagccatcctgatagccctttcggcttctccatcctagtagtttaggatttcttgcaattccattttggcacttttcttctgacctatttctctggctgctgcttcctgataatcgaccagttctctagtcttgctccctgcactcctccctcctccatctccggcacagtgttctgaccaacctgctccaatgggtgtcttgtctgctgctgaccctcccccagtctcagcaattgggtttgagggctatgagaagcgccttgagatcactttctctgaggcacctgtctttgctgaccctgatggtcggggtttgcgcgccctctccagggcccagattgactctgttctggatcttgcacggtgcaccattgtgtccgagctgtccaacaaggactttgactcctatgtcctctctgagtccagcctgtttatctattctgataagattgtgattaagacctgtgggactacaaagctcctgctcacaattccaaggattcttgagcttgctgaagggctttctatgccacttgctgctgtgaagtactcccgcgggatgttcatcttccccagtgcacagcctgctccccacaggagcttctctgaggaagttgctgtcctcaaccgctactttggccatctgaaatctggtggtaatgcttatgtgattggagatccagcaaagcctggccagaagtggcatatctactatgctactcagcacccggagcaacctatggttacccttgaaatgtgcatgaccggactggacaaggagaaagcttcagtctttttcaagacttctgctgatggtcacacatcatgtgctaaggaaatgacaaaactctcgggcatctctgacattatcccagagatggagatctgtgactttgacttcgaaccctgcggctactccatgaatgcaatccatggctcagcgttttctaccattcatgtgacccctgaggatggcttcagctacgccagttatgaggtcgtgggcttcgacgcctctactcttgcttatggcgacctggtgaagagggtcctcaggtgctttggcccttcggagttctctgttgctgttaccatctttggtgggcatggtcatgctggaacatgggcaaaggagctcaatgctgatgcttacaaatgcaacaacatggtagagcaggagctgccctgtggtggcctcctcatctaccagagcttcgacgctactgaagacgtacctgttgctgttgggtcgcccaaatctgttctgcactgcttcgaggctgagaatatggtgaaccctgctcctgttaaggaaggtaaactgggcaatcttctcccctggggagaggatgcgttggaggagaatgatggagtgtttgatgagtaagatgggacttctggtgacgattcgctgctttgttttcattccgtggcatttttatctgttgaggttgtcgtttggttattctgtgaagcagccagccaggctattagtattttcgcttgtaagcatgtgttctgatcttgggacgtatgcttggtctaaataataatggtgaactaaaagctctaggtggtcagctgcgtctgccacaatgagcatgcgtcgggagaaatgttgtcaaaacatatgaataagtatttgcgggaaatttcctttgccttctgctaatgttccttccgatctcaattgttaaattttgttgctgctggtgtctaagaaagttctgcttgggacactagatagtatggagaaaacgattttcgaaagtttccactcttgttatctcaactctgtagagctccccctgttccatgggactgcaaatgcccatggcacaggtatatcttaaggtagtacattaatgaaaagtctgggagaatagcatgtgcaaaatgcttactagctcttataagttaaaaatagctggaagaactgcattctatagctttccccgtgttcatggttatcttctgcaagatatggctggacgaagtatatgccgcatgcttggctcttgccgccccattcgccttggcatggaccattgacttcgattttttttttggacatgtttatgtatttgcttattgtcctctactttacatgtaacagtaatttaaaggagtgctgcctgatctgataattgcgtttggaatcctttaatgagcttgatcttgtcgcgcttggaaagatgatgcagcgacctgttcggtaccctatgcttatcttctgacatccatatctgtattattgtttatgaagttgtacgctttgtacccaattatccatgaatatatatattttttctttctggaaactgcatgttgctgaattggtttatactggacgatcgcgacctcctccattattcgggtgcttagattggttcggcttcgttgacacgcgcgaacgaaaaagaaagatattagatagatagatagatagattacgcggtctcgatcacggactcgtgagggcaatcgcttctcccctaccttgccgacctgttgtccttggaacacttccgagttctgacgagctgattcctccgatggtggcgcttctgtcgctgttccgttctcgctccaacgctgttgcttgattcatcagttgcaacttggcaaggaactggaagggatctgtgctgaggaggtgtgatctcacattgtcgtccaaagcttggatgcgttgcttggccgccatgatatgctcatatgccgcgtctagaaggcgatcaggtaggcaggcagctagctgctcaaaagaacgtgccacatctccgggcgggaatatgctcctggtctgtcgcccatatgatatgtgagcatcaaagcatctcccattcccagccacagagagcggatcgtttgttccgagcgtatcaattcctccctcctccttggcccgcgcactgcacgtaggagtaggacgtagcctagattgttgtagcaggtcgattgaccgaacctgccacgcagtgattcgatcacacgggcacacggttggcctgcactgggctaccgatcgatcggacgcgagatggaaacgagattcgccgccagagcacgagagggaatcgatctcccttacacgtcggccggcaagtggagtggttgatggctctagacgccgcgggaaaggacaaaggcgaccgacggaatccgccgcccggtcgctgcgacacaccccgtgccgcgtgcatgtgccgcgcgccgaacgaattaataagcttccgttccgttcggccggtacgcgcccggaagctggcagttgggcacccgcgggggcgaaacgagcggcccacgccgttttttcacggattttcagcccaaactgctgctgcgcgactgcgatttgggtccgagattggcccggctcgtggagttattacgggacaatcgcttcctcaacggtcttcctggtcattcgtgtgccagaaagggcatgtgactatctgaggacatgacacgtacagcgttttctttttcatttttctttgcaggttctgacgagaacgaacagacgcatttactaatctcatacgtgtactcccagtccgagagatttggtgataagagcttaacttgggctgtgatcagggtaacattttttagcgtgtcacatattatatatggacatatttaaagtattaaatatagtctaataacaaaataaattacataattctcttataaaatatgaaacaaatttattaaggctaattaatccatcataaatttattaaggctaattaatctattattagaaaaagtttactgtagcaccacattgtcaaatcatatatcacttaggcttaaaaagattcatctcacaaagtagtcgcattctgtataattaattattttttagtctatatttaatatttcatgcagatgaaacgttcgatgtgacgggatgaaaaattttagggtgacatgtaaataaggccttagttacagataaaacgcatctcgcgccatctgcattatactcctttcgctaaatcatttagaatttagatcacttaattttcactctcctttcgctaaatcatgaccatccagaccagagcatggagaaaaaaaaaaccaagctgctactacaaacagatcatcatcaacaacaacgaacaaatcgaatatcgatcattctcaacatacattgtgtcgatcccttctatgcatgtatgtatcgatcgtgcgtgcacgcatcatcagccgttgacgcgggagcacgtccggcggacctcgccgtcggcgccggtcctgacgccgaggctggtgagcctggcgaacgaggccgcccagctggcgaagaagctcccctcgctccgcgcgaacgcctccaccgtggcccgcgtcgtggcgttctgcaccagcacggcgtccgtgcgcagcagcccgcgcccggcgagcaggttggcgaagtaggcgttgtcgaaccgcgacgccgacccctcgtcgcagtccaccgccgccgtcgacgacaccgtgttgttcaccgccgagcacgccctgatcagccccccggcgtagtccgcgttcatcgccgcgtccgcgggcaccgtgctcccgttcgcgtccacccggaaccgctccccgaacgtcgtgcagtgcgccgacccgatggtgtgcccccctgcgcgccagtgcgccacgccggcgatcgacagccgtgtgctcacggtgagaccaggtgaaaagtgaaaatcgcagttgatcctccagcattcaagagcgtgtgtgtgtgtacctgagagggtgacgaggtcgtccagggtgagccctttggcggagaagctcctcgccatggcgtcgacggagaagccggtgtcgatgatgttcgccctgacgttggaggccagcgagaccaggccgtcgagcctcccgagagagactggcaccaacggtcctccggtctggtttgcagcaggtgaatgcatgttagttcatgaatgtcactcattttacattggtagtttatctgctttgtaaaccaatctgccctaacatgccaataggattttgtgccaagactaaaaattgagcttttaagtggcacagaaaccggagcaagcaattaacacaagattaattaattattaattaatataaaattgaaaaagggttcatttgaatttttaaagaaacttttatataaaaagtttttgcaaaaaaaaaacacggtttagcagtttgggaagcatatgctaatggaaaacgagggtgttgaagtttagagaaacatttccgtagaaacaaccatattataagtcttgctgtatttcttttttgttaccaagtctatgccgaatcaacatctatatgatgtgggtgaaatggtgaaggtgaatgtgagtgtgaatgttactgcaaactctgtatttctagatacagaggaatgtagtttcaaagcatatctgttcttaagtttcactattccagttgttttttttataaaaaaaccgaagccagcaaagctggtgttatattaagcaggggagaaaaaaagtatttacaagatcaccaaaacagtgaaagagagaaagagagaggaaagaagaagctactaaacaatgaaaaactattccagttgtgccccccttcattagctcatttcatcaatccccttaggaccattaatcatgtcccccacagaattacgcacataaaatattgtggtccaacgacataagatgacaatcatgaaactaatggaaacggaattgtgttcacttagttaagttcatgatggtctacctgtctgattttatttgggtgtaaccatagtagttctaattattttccaaggtatagtcgtgtaacgtatgcatggaccaggagcactcaattcattggatgattaaagatctaactgttgcagcattaatgtggattatttctgatgtcctatgcttatgaagagtactacatctgcttaactatatttagtagcaacatttctaggaaaattcatctcaggcaacaatttaaatatttggcacatttacctttgagtggattgtagcaactagaaaagagaaatcacatagtgccatcatacttacaaatgtaacagcatctcttgcggcaaggactaaaatgtcgctgcaggaaacagttacagggcacacggcttcaagcagcctcttggcagcatctatgacattgaacccaccaagtgagaggtttgcaggatcggtcctctccgtgccgctaccttcaatcatcactgatgcatcacatccctgagaccaagaaaaaatgtactctaagaatgactttctcactttctgttattgtgcaagcgtggatgttttcacaattcttaaacccgatgagatgcaaatgcaagacaaatacaattgttcccataattgtggcagtgacaatgtgcaagctgtggaaaactacattatgtttggttataccaagcgtgcataatggattagggtcttaattttagccaccacatagcttagtgatcaataactattctagactggaccattcaatcgacaagatatacattatattcgaataatgccagattattagccgatgcaattagtgccacacatgtcataactattctggggaaaactagggtgagaaaaggaatatcctaaactaactagtagaatgagcatttgattagttcttcaggtcttcagcatttcaaactaagaaaacggatgaaaataactattattcagctgctagtaaattgggccgaaggaactatatatcatcataaaattgaacaaaaacacattactgcattatatttccaccccaccattgttatttctgagaatatgaaaaactgagacggcaaatggcaataccccaatccagtgtgatggaacaggaattgttgatggctagatctacacacttggatgtgattcatataaccatctacattgcagacagccatttcaccatttgcttgcatgcacaagaacttccattgttgcaaattgcagccaatgtgacgcatttgacaaatgcaagcagtatactactagattctgagataaacagtcatggcatcagtagtttcttacctcaacaaagcagtcatggaagagcatcctgagaagcttgccggggatggtggaatccaatgtggaggccgacctgacgacatccctcaccgccagctccacgctcgggcaggactgcgcgtagaaatttggcgagagctggaccggcgtggacgtcgacggcgaggaggagttcgtcgtggaattcgttggagccggaggaggagaaggagatggtttcggtgccgctgccggcggcggtggcggtggcgtccgaggaggaagaggaggagacggtctcggagccggtggcgaggacggtggaggagacggctttgtggtcggcgtcgccgcaggaggaggagaagatggcttcggcgcgggtggagacgacggcgttgtggacggcgacggcgcaggaggggaaggtggcttcggcgcgggtggagacgacggctttgttggcgccggcgacgtcgccggtggcggctgtggaggcctcggggctggcgccgcgggtgtccgtggagaggacgacgagttcgtcgccggtggggatgccgcctttgccggcgttgctggcgtcggcggcgtccgttgagaaggcgccctcgcagccggcgttgctgagctagcagctggcgccggagacgaagacggcggctgcgacgacgagccggagcctgcggcgacggccactgccaggacagagaaaaacagcgccgagcaaagaacaccaatgcactcccgccgccgctgccgcctcatctgatccatcttgcagccgaggagaacgggatgctcatgagctagccagcccagctgagctcgctcacgagcgcacaatcactcacagtctcacacaccactacaccaccaccactatgtgcaagaacagctagcagctgatgaacatgcagaaatagtttcggtggtggacgcagagagcgatcgatcgagttggcgtagagaatctactagtcgcgtacatgtatctctcgcgcgccggcattaacgacggtggacgcaccggcagcagcaaccactatagcgaatgcgccgatgcgatccattataaatcgggggacgcacaaccgacgccgcgctacactagacggactcatgtacgagcatacgacgacataccggacggtcggctgggacaatctatagtaggagtacgtactatggatttcgaacagcggtacacgtacgattctccggcagcatgcgatcgagaaaaagtttcgtgtcaacacggcgaggccggttaattccccggccgtaccagctggtccaggagacccgtgtctcgcgtgtacttgtgctttaccttagctcgggctcccccgttagagcaaggataataatgggctataaggctctcatacaagagctagcttcacacaactttcaagaaacatacatcaaatttatagagtgagaaagagagaatggaaaaaataaagttaacattatagctaacttattatacaagttaactctaagattgacttatagtaagcagcgcgctttactattaaacttgctcttaatggcggctatctagctggtaaagctggcatcccggatgcacgcatgtttcgtgtttttttttcttttgaaaaaggataaacatgcatggccggctcttgttcaggcgcgagctagtagcatgcgcatgtggatgcgtaaggtgtattgatggcgagggagtgaatcgggtcggggttgggttgggtgcctggtgcgccgcagtaaattcggggagagagagccacgccattgatggcggcatttactccggcgacgcggttggtaatggatggatgggcgacgactcggcgctgggcgggcgggtttgcagatttgcagcttcctgatcagagttgaggccgcgggcgccacctgtggctgcacgcgccggcggcggaggtggaggaggaaggctggaagggggtgtagttcagccgagaagttcagctaaagctcgcgcaccgacttctccatttcggcatttcgcgattccacggtcagaagcgggaaggattggtaggcgggtgagtgagtgattgtttagttatcatttttttctttaactagttaagtgcctgtgcgttgcaacgggaaaaaaacgcatcaatttcaaattacagagtaaaattgtgctgaatagttattgaatgtaagcttatcataatcagaccgataaaattatgttaaataattattgagtgtttcttaaaaaagtagtaatataataaaatcctaattcagtccggggatatacgtattcagctgtatttacagttttacactcatgacatcaaatcaagtaactaatcaactaatagcacatttgtttggcaacaagtatatacagatgacattctgtatttcgtaacatagcaagtgaatgcaagagaagtaattttgcgagtagaagggactaaaccaaacaatacatgtattttttaaaatgcctctataaaatatctctacactataaaactcctgatctaagaggcagtttgcaaaatgcctctacaaaagtgtctttatataaggttttttttgtagtgacagcataggatcacacgtccgcaattcaaacccagaacaataccataatgttcacactgctagaacatcatagtgtcaacgattgattgagaacacacacaagtatcttttgtcatgagaaacatattctctatgcctgcaatatattcaatataaaaatctactgaaccacaacacataaagcatcaatatgtcctcatgaatcacacaccacaggtgcaccacaagctagcttgtttggtcatattcatagcaggtgatgttacaatgggagaggaattgaggaaggttacttggtttggtttgcctggataaggggaaaataggtcagtccttatttaccagtatatagtaatagttatatatatgtatgtcataccattcccgtataactattttctctatacgataatactatgtgtttgcttctaatatacttaagcataacatgtaatttgtgcaaagatgaaaacatcagccacaagcaaaatcttttaaaaaaaaagaagggaaaatagttgcataaaagagaagctttgagatctggatcaagaaaggacattggcccatgaactatttctcaaaaggacaaatccgctttcttaaaagtattatttcttaaatttctccacaagttcttcaacaacaaagacatttcatgggtcacgtatagaaaatacagacctaaaaacaaatgatagagcctcttctttataagagagaagagggggaactttttggtggatattttagaacagtcgctatggttcaaggaaatagctaatcctcaagtgggtaatggacaatcaattctatgcttggatgatacataagccaaaaaaatgaattggattgcatatgtgcacaatggtagccatatatagtattatcagggctcctggacccactaaattgatactttgctgaaaaaagagaacaaatcaatccaaaagtcagctctaaacaaatgacatcgatctgttgatgtagcataagcagtgcaattaaaagccatggaatatgagtaaacagatggagggtttcgtacagaaaaccccaatttctgatagtctaacgttaactaaattcagggaaccttataaagctttctacaaaatgcaggctacacaggaaatgctatctacttatacatcaaaagaaatttagctttgttattctgaaaacagatttgtaggcagtcctagcagcctatgtactcctatttgtaagttaaatatttattaacttactgttaaaaaaaacatgttcagcatccttgagtctagtttgcatatatctatatcaacactggctactttaatcccatgtaaacatatgaatatgacaggcaacaggataaagtttaagagaaaaatatatagagcaaaaggtttgtagttgcagcctcaatcccatataaatgtttaaaagcttgacagcctgatgcaagatttttttcgttttctaccgctggttgtacgattttgggtagcaaccgattagctgggctggatagctgcagccaaaaacgccacaacaatcagaacagatcagcctcaatatgctgtgacttgagactttaatgcattaagaaaaataaagctgcacttaatcagaagttatgtgcaattaatctgaagatagcattatatagtttagaaaggatatggcatcgaggtggggaacaaaagcgtgaaaatccccaacgatagagcagaactggacagtgaagcatgacctggtcatcgaacatcagtttcttacgccagcaagatctcaactaaattgcaagctcaataaacaaaagaatctcctctcttgttctttacactatacaaagaccatttcatttgatctaacccatccatcctgcccaagttttttcaagtctaagccattggttatgtatatgtatgtttctggtgataacctaaattagttacagattataccttcagccaacatttagcttgtacaagtccaactcaagatcaacttctatattgaggcataaataaggaactctcaatttattgaggatgaattatgaatacactgagaggtctttcttgaaaggaagattactatgatctcattaacaacaacattagtagtgcagcatacacatttttttctcaagattactatgaaataaatatcagttatcaatgttgataattcaaaaccacaaacaaaactatatacttattatgccgtaaggctgccctatcaggtcacttcttgctattttttgggtttaaaaaaaaatcatcaaacgcagaagtatttaatacaataatgaccttttcaatgtcagagcttcgaggcaaccttctgccacggcggggtgatcggctgctgcttggcgcggggttgcgtcgtaaggggccagctcccacgatctggcagcaactgctgaggtcgaggagggaggggaggcagtgcggggtcacgttgtcgggggctggctgccgcgattaatacaaagatccatgctcacttcaaatatgaataaatagaactgtcagtttagcataacgattcacagaaaagggcatccaccacaatctttaattttgcatgtggagatatatattcgaatgtggcaaccctatggccagagaatgcataatataagcagatcggcacaagtattaccttgttgatgataacctctgtttgactttccgacaatcagatcacaataaggcaatatgaggacaccacctaagatgtatcggatatcagaatgatgttttttttttgagatgtacccaagcagtctaacccctgcaatagattgaaaaacatacagagtgagattgtttctttgcaagacacatttttaccatcatatattttaattccatgatatagcataaggacagaaatgattaacagttgtctgtagctaaactctgaaatgtctttctttttgatccctagtgagcagaaaagagcaagcaagtgtacgtccaaaaaatataagtacattttaatgataaaactgttcccaaaaaacaaggaaataggaatcaggatgatgcagagaagatacattttattcagtgcccctgatcaacaaagattcactggccaggccataaccaatgttgcactttcaaccgggctaatttattcaggtgcaaactacaaaggtttgatgttttgaaaggaattagtagcacttgctgaccgacaacatgcatgtgtgatacagttacatgaaaagaacggcaacgagagcctgatagatgccatcctggagggcatctattgaaactgaaaaaccaaaaccttttcaagcttcaccctaaaaaaatcattagtctacataaacaaagtcagatcgtgaacaaagctttttaagctacatccgcaatggtgatagtacataatataagacatacatttataaaggcaaaatttgctatgggacataaaaaacgtgcaattttccttggaagcagattactaaagataagttcactcaccagcccaccaaccatcacaatcaagctccccaatttctgcctaggtagcatgatgccgtctaatcatgttgatagaaactggcatatatatagtcccacagtgtttacagaaggaggctatgaatatggcaggaagcatccagctcctagagtggtggctggcaacaaaagtggccaaaagacgaaaaatttggagagctaacattatttactaactacagtattgtgttgaacaaaccacatgaataataaatctcaagtaaattttagattttgatgaattctgccatacaaaatgatattaaatcaatgttccagacatactaacagatatacttgttagttttctgatcgataagtaggaaattaagcaaaggaattcatagaatgggttgaatgaccttaacgcaggcggcggcagactccaatggctgcacggtgataggcaggaggctagcggcagtggcaggtaaagaggcgaggcaccgtgacgtcgacggcaggctgatggggaagaggagcggcagcgacgtcgacgacaggctgatgggcaggaggaagacgcggcggcggtgacaatctggagtggctggcgctgtcgacgacagcgcggaggctgatgcagaggagggcagcgcgggggagtgggctgatggggagtcgacgatggcgtctggagcggccggcgacatcgacgacggcgtggaggctgatggggaggagggcggcgcgggagagtgggttgatgggaaggagtcgacgatggcgcaaataatgatgggaggagggcggcggcggtggcgggtggccggaggagtaggcgtcgacggcggggaggagtaagaatcggcggcgggtggatctggagcggagtccacggcacgagggggggcgcgccggcggcggttgcggtgggcggcggcgccggcgccggcaggggcaagtgggcggaggaagagacgtcgcggggtcaggttggcggaagaggagtcggcggcgatggcgagtggggcggagaaactgtccgcgcgatggcggtctaccgcgatggcgatctctgtgcgcgattgcccgttggatatgacgatcagatggttgatattacgcatgtctgtcagatgcgtctgctatgtcaggaatcaagaccaccactacggactttttaagtagtagagattttttaactttttcatcacatcaaaactatcctacacatagggtgtgtttagttactgaaaaaagttggaagtttagggaaagttgtgagtttgaaaaaaaaaattaaaagtttacgtgtgtagtaaagttttggatgtgatgtgatatgatagaaagttggaagtttgaggtagttaggggtgaatcaaacacggccatatacttttaactgttttctttaaactactaattttagtcaaacttttaattttaaagtgaaactaaacacagcctgagaggtggcagtgggttttatggcttcgccggccaaccaccggtggcagtgttcatcagaattctggtagggacaggcgtaatgggtatactagcttagaatcacgtagcaaaagaattaacgcaactccggatatagagtatcacgcgaagccaaaagcaaggtgtctcacgactgactaaaagttgaccctacctgaccaacattcgaaaaaaaaagaaccataaaaaatcattcaaaatatatatgactataatcacgaaacaactatacatatacaaacaaccactccctccgtcccagaaaaaaaaagacaaaccctgggtttccatgtctaacatttgaccgtccgtcttgtttaaaaaaattatgaaaaaaaaataaaaagacaagtcacgcataaagtattaatcatgttttatcatctaacaacaataaaaatactaattataaaaaattttcatataacacggacagtcaaacgttgtacacgaaaaccaaaggtttgtcttttttttttagggacggagggagtagtgcgtatgatccatacccgatataatgcgcgtagacacaactattgttttcctaaactccgatggtgagaaaccgagcgtaagaattgatagatgaaacgtgattagatactaactatacgtatagaaaaaaattataatgtaattatattgtaactaacatataattataataattatagtataacacggtggtgtagatgcgccgcggcatccacaggttgcatgttttcttaacttttgtcacatgttagatagcaattatctctttttttctgagggagagagagaggagataataaaatactcgatattgaattgccgatggattactcattaccatgtgtataaggtatgataactccaaatctcatgtgcttgtgtgtttttactttttagagctctataaaaataacatgggtgctaaactattgttctggaattatttcttgaaggcccaattaatttcgggctgggccattagcaagcaagccgcgtcgaatttgtcgctttgaatgggccggaaatgctagggttaccgtctccctcccaaagccccgcctggtgattcgccgtctccctccgtcgccgtgccttcccccgccaccgtcctgctcaccggcgttccgccggaacgacttgaagtccacctctcgagctcggcggcctcccccttagggcagaagcggacgaggcgaatggaagaggttaggggcagggagagcaaagaccaccgcggcggcggcggcggcggcggaggtgatggggacggcgagcggacgggacggtggcgcgccgaggaggtcatcgctgggaaccgcgcggttctggaggctctccgggagctcgtgatgtatcctgtcctctacgcacgggaggcccgcgtgctcggcctcaatgtattgtcgcctatcccctcttctcttcgtccttattatcatcaagtgcacctgcttgtaaatagcaatccatttttgaaataatctttgcattggtgcagtttcccagaggattgctgctccacggcccctctggcactggaaaggtactgcttttacggtgttaatgtcttcaatccggtgcaatttatggccaatgcgtctgcttaggctaggttcatgtagagtttgcttttatcttgctgtggattttgctactggtatcgcaatttgtagtgctgaatgttttactgcttttgcaattctgtcagaaaagcatggtccgagctgttgttcgagaatgtaatgcccacctcacagtgattgagtaatgacttaactcgaattggttaaccttgaaagactctgctttgcttttaattgcatattttgatttggcacttaattcacataatgtacatatgtttacagttcaatttctgtgcataaaccccacgctggagagggggagaagttcatgcgagaggcttttactgaagcatattcccaggcatcacagggtagaccagccgtgatattcattgatgaacttgtgatgacatatgtccaccgcgtggcagtaggcaagtttgttatattacctacaaattttatatttgccaagaagttattattaatgtatttttcacaggagagagcaagggtcccgcattgttggtcagctgttgactctgatggacgggaagtcatcaaagctgcttccccacctagttgttgttgcatctgctaccaggtcaggaatgtcagttgcgtgatttgtgatcttagcaaatagcctaacattttaagttcattttaggaagttcctctgttgatacggcagcatattccactaagtgcgcttaagttttcctttagttattctggttatgaacttcgtgtttttctcttgaatgaaaacacaacttgctttcattagggtggatgctattgagtcagcactgcgaaggcctgggcgttttgactcagagatagaggttactgttcctacagcagaagaaaggttcgagattcttaaggtatcatataagaatgtagttttcccctcaaaaatagtaaaagaatgttgtattttatgatgtaacatagcaagccctgcattttttggatgtggttaacgtatgttcatgatgattttttcttatatgaagcttaatcttatagaccatattatgtttttagctttataccaagaatctacatcttggtgaatgtgttgatcttcaatctgttgctgcatcctgcaatggttatgttggagctgatttacaagctttatgtcgagaagctgcaagacgtgcttatggtagattatcaagctcatcagagagtgagaatgtgctaacgctaatcatggaggattgggagtctgctaaatctgtggccaaaaatagtgtgacaagaggggtaactaaagaaattccagctgtttcatgggatgatataggaggtttgaaagctgttaaggtaaaatatgcctcattttaggatttctttaatcaaacctcctttaatggttattgttgctatgcttcagaaaaaacttcagcaagctgttgaatggcccatcaagcatgctgcttcatttgatagacttggaatatcacctatccgtggggtgctattgcatggtccaccagggtgctcaaagactacccttgcaaaggctgctgctcatgctgcccaagcttctttcttttcattaaggtttgctgcgtaaaaattgttctctctttttctcatttcatccttccaacatgcaaaaagaagcctgtgaatcgcataatattttctgatgtgatgcttatattgtaataaattcaataaacatcacttaatctcagatgtactgaaaaggagttattagaggaagcaaaagaacttaacatgtttatttcatgtactgttaagaccaagctggcataatttgttcaaattctgctgcttgaatcgttgtcctgtacgctagtccaaataatatagctagaacatgctaaccggatcattttgagttcagtatacagtcttctatgttgttctaaatttcttacacattttcaaacagtggtgctgagttatactccaagtatgttggtgaaggtgaagctttgttgcgacgtacattccagatggcacgtcttgcttctccaagcattatattttttgatgaggctgatgcaattgcccctaaaaggtgcacatttatatcttgtctcttgttgtcctgtggcacatactagtgagatctatgatacatgatgcatgatattggtaaaaatgattctgtacaatcatcataagaatgtgcatgaattgttataggctatcttctataattacgtaataataatatttgcatcttttccatggtgtacatgattaggaagttgaagaggtgtcagaagtgttaagcatattttgttggatatggttccccaaatgttcttttcatatagtagaatcaatttatgaaaactttgcttctgcgcatgtaaatctaatttccacatctgaccagtgaatgttaatattggagtttgtaatcgttcagaactggtcccagcgggaactctagtggcaatgccacggttggagaaagactcttatcaactctattgacggaaatggatggtttagaactggctacggtacctcttacatatttagattgacgatggcattcaaatgtgactctccttgtcatatctcatatatgccctttctttgtactaaaaaagtatcttgcaatttttgatgtagggaattattgtattggctgctactaatcgcccaaatgcaattgatgctgctcttctgcgcccagggcgtttcgatatggtatcccgatctccctctccctctccctcacacatagcaaacaaaatcatgttctttttttcattttaactgcaggttttgtatgttccaccaccagatgcggaaggtcgatatgaaatactacgcatccatacacgcaaaatgccattaggagatgatgtggatctttggaaggtagcagagcgtaccgagcttttcacgggcgcagatcttgaaggcctgtgcagggaggcgggaatggctgccttgagggaaagtctgaggtcagagcgttttgtatgtgacgatattcacttccaggccgcgctaagatccttgcgtccatcacttacacaatcagtggttgatgagtactcaaatgcagccatccatggtccattgacgaggagaaaacactaaaagatgtattattctggcgcacaagcatcagtgtcgcccattgttgattctgactagttatcagaacattgtatcatcggtctgctgtatatattgaccaaagttgtgacatgttcccatatgattgcagcggcttgtactgtttcccctgtgtttttcttgggttttgagagtattgagagacagaggttaacactagaagataactctgcctgttaataactcccaaggactaataaagatctcatcttccccaaggaagattgcaagctactaatatgaaatgatattcagaaaatgctgctgatcaggaaatccaagtgtcaatacatagagatcctgcaaaaacgcactgcttctggtgcttagacttacactaaaagcagaacatgcctgtttatgtttcacatatatccccagcaaagcaatttttacaatgggaagagaagtttcagatatgtaacatcttctgcagcatctcctatgcatcttgctccttgtagactaagaatgcgctggtcttgcaatagctgcgtgccagcgccttcccggaggaagtaggcggtgagaaagcgcactgtgagatgcacaaagtctcgccttcgaggaagcttttcctgcagaagacgaatggagagtgccttagcaagataagataatatcaaactcttggaaatgcttgcagagcatagaagagaacaactggacagacagataaataattcagtgatatttgcagtgtgatgtcagttaacaaatagttttattagtcctataatctggtcaaaagcttggaatttgtccaaattgacaatgcgtgctatgatggatctatacattgttgttacagagaacaatgcatgctatccttctcttaatgcaatgatgcgcaagccttttgcgtattccccccaaaaagaacaatgtatgctatcaagagttcaagacgggcattgcaggaatgctgcgaaaaagaaagatgctaagtgaagcaaagtaggtgagaatgcgcatcaaacttagaacttacctagcagcatccatcagttgtgaccctattcgctttcttctgcgtgacggtacaacccaaattgctcgaaatccacaatgtgcaggaacatcttccttttcacatattatagcaccaggatctcggtactcttctttgttcttgtctgaatgatcatgccgtttcaggacttccctcttaaaactgattttcccgaactctaatgtatggtttgttttgactggttcaattttatcaacaggcagatcagtgccgttttcctctgtggagcctggaatcactttatgtgctgttttgattggttccgcaacaaggcatcccactatcctctgactagatatgaacaaatatacctatgcaacgcaaatgaggttttacccattaggatgaatatatgtgcatagatgttgtcatatttgaactaggagctgatgttaccttacaaagcttgtgaaggagctgaccttcaccaaaccccagctccttctgtaccactttgatcacctcctggacctgaaatattcacatgacattacataatcataaaatgtctgcaatctgcttctgaacttctcgtaaatgtaaagtggttgcaaaattggatcagaaacttcgcagttagtaaagacacacattctacagtttagaactatgaggaacccactcttttcaatattcatttccccaagaccccaactagtgatttctttcaactatctaggcaatacagttagtcattcaggcaaaataccttgctgttccgagcacatgaattttcatcggtcacaagaattatccgatccccaccttcagacctcgcgaccacggtttcattgcgccaaccctgcaactcaaacatttgtcataaactcttcacagaaatttataacacgagatgaacagaagagtgagattcacaaatatacatcaggtgcaacaccttgaacgggacgccctcgaagtaactcttgtggtatgccttgtgagccttctcgtcgtcgtcgttcccgcgggcatacatcatgccacaaaccgagcacatgtggaggagaaaatcgggctgcccaagctccaggtggaactgcgcgtagttcctcttcttgttgaggaccttgccatccgcacagctcttgggcctcttcacctccatcccgcaggttccttccctatgcgtgtcgccaccacttaccaaatcaacaaagattgatcagtccattatcaaatctgaatccaggaacatgccaatgtcggacagcatgcttgggaattaacgagaactaaatcaacaaccatttttttccaacctgacgagcgattttaatattcgctctaattgatggaatattgcagaaattcgctactagagtggaatccggcaatatttggtaccggatcgctacagctaacagatttgaagaggggaccaagatgaagaacctgctcgtctcgggctcgggggcctgacgcttgaagaacgcactgatcttgggctgcatccccttcttgcctctcgtcatgctgcttggaaagacggagagtgaagaaacggacgcggcggtggcggcggtgaattatgcgaatttgccagcaaattattagcatgcatgtgtgcaacctctatgtgaaaatagctaaactacagaattaaccagtgtgcagaacccaacatatgtgcaaaacacatccaaatctgaactaccatatgctatatgagtagcctaacaaaatcaagaagtatcatacccaaaaatccccagacctaagcgagatatacacatcaacccaagaaaacttttaaaggaggaagaagaatgccactcaccgtccagcacggggcaggggggaaagaggccagtgtagctcgctcagcggggagggggagggatgccctcacggctgcggcggcgaaggacggccttgacgggaggcggcggctggtttgcggtgcagcgcggagggggggacagcgcccggctccgttgtgaaagggggcgtggcgaggaggaagacgagggccgcgggtggtcggtggggttagggccaatcgacggcggagatgaggcggtgaggccgtgagggcggatcggacgggcaggaatcgagaaggccacgcgcgcagggttttctaaaggggaaaaatgcgggagggggattcgggcgccaaaacaacgggcctgaaattggcagcgatggacgcccggacgagcgctgtgacctcggaacgttgttgggacttggctgggggtgaaaacggtatggaaattttctgaccgtaccgataccgtttccgcaaaactaatataataataatatttttatcgatggttatcatttttaaaatttagttttttttaatttctaacggtgtggcattgaagttgacactaaatagatgaattcatgaatatgaaaatttttcgaccgtttctgcttgttttttaaaaaataataaaataatgatgccgtttccgaccatttccaaccactttcatccctagacttgggagagaggaacgaacaggagactgggagaggtggagagtaggtgagcagcagttgtcgtggaccttattcttatgaacatggtgggctgctgggccaactcaatagtcaatattcattataataagttcactttaggtctctcttattgacgatgagtttagattgtgtccttcaaccaatttgcaagatcggtgtaaccgaggtcacatgacagtataacatccagttttaactaacgtgacgagttgactattatcaatctggttgagtcagcgtgagacccacatgggtcttacatgttagcagccaactctctctaccgagtccctttacctaatatctatctacccatcccttttccccatctctttcccgacaggaactggagcaactgctggaaaagccatcatgctcaagaaccccgtagttaccttggccacgtagcttgtgttgccatcggggtaagccgagggggcaacacgatgttacgcgatcgaggtcgatgctgggttcctgaggttgagggttgctcgagcagccgcctggcaagctcaaggtcttctagtccactggttgtcacccctctcccattagctgctatccttcttcccgctgctcaccgcctttctggccttctccaccggtggagagaaattggcaagagggatgggtagagagaagaggcgatgaaggaaaaaagagttaaccgctaatatatggggctcatgtgggtctcacgtttactcgatcagtatgatcatagttggctcatcatgtcagttaaaatagggtgttatactattttagaatctcgggtacaccgatattataaattaactgacattatactggtattgtggataaggacgcaattcaaactcagcatttaaatgtcgaaagtgaacttatttcatattcacttattaattcctatcaggccttgattaggtcgtaagtagctacacagtaataacgcagtgcaaagagatgatgcgcaatagtaaaaggcacaaagtcaaaattagtgttgacatgttgcccagttttctactactagtacatagattaatggtgcaaaattaccatggttaaattagtaggagtatacagtactataatagttgcaaggtggggggtgtcaagtcaaaaccttgagcgcggatacccatcaacgcacacttgctcttgctcagctcgccaacgccaagatgcgcctcgtcaatctctcccaccgatcaatcgcgagacctgcattctagccgtgcgaattccggcgggcttccgccgtagatccccaagaaacccccggcaagaaatcgctgcccagatggatcgccaagaggaggaggacgacgacgcggcgcttcgagaagccggcggcggcgcctccttccccggcggctggctccggcgtctgtcccgcgagctgcactggagcttcgtgctcgccgtcgtggccgtctacggggcctgccagggtgtcggcgacgccgtcggcggcgtcgcggcggggtactactggaaggacgtgcagcgcgtgcagccgtcggcggcgcagttctaccaggggttcgtcagcgccccctgggtcgtcaagcccatctggggtctactcaccgacgtcgtccccgtcgccggctaccgccgccgcccgtacttcctcctcgccggtgaggggattgcagcctcctccgcctcctcgatcccatctcgcagttcgaaggctttcgccttacttgatcacttctctcggtgattcattcaggagtgattggggcgtcgtccatgctcacgctctctctccaccgcaagctgggcatcatgccggcgatcttggcgctgacggcgcagagcgcgggcgcggcggtggccgacgtgacggtggacgcgctggttgctcagaacagcatcacgcaccagccgctagccgcagacatgcagagcctgtgtgggttcagctcctccgttggggcattgcttggattctccatcagtggtcttcttgtccactccatggggtctcaggtgtgatattccctgaccttagataatgatttgcatcatcatttgttttctcacacaatgtcaattgatatgattgtgattcttgctttttttttcttttcttgttctaagggtgctcttggattactaagcatcccttctgcactggtgttcttggctggtgttttgctgaaggagaggcgagttacagatttcgattacaagcaggtcagaatgtcaagacaaaatttgaacacctttccttttgtgtgttgagattgctgaattcaggcatggacagtgatgccacttgagtgctttgatggattcaggttcataggaaattctacaaagcaattcagtccatgggggcaacactgaagtgtgccgaagtttggcggccgtgtgtgtatatgtatgtttctctcagtctaagcctggatatccaagcaggaatgttctactggtacactgatccaatagtgggaccaggattctctgaggtatgcacattcctgcatatagatatttgctagatatcatcagttcatcgcatcatttgcatggactgtaatactgagaatgcataccactgttaaatccatataatgaggtgtggttttagataaattcagttatttgaccttcttctaattttaatcatctgatgacacttcgattgcgtcattcgatcgtttatttcaggaatttattggccttgtgtattcggtcggttcaatcggttcgctgctcggagttttactataccaaatttcactgaaggactgccctttccgcggcgtgctattctggggccaagttctttcaagcctggcaggaatgctcgatctgataatggtgacccggctcaacacaagaatcggcattccggattacgtctttgcggtgattgacaacagtgtctcccagatggttgggaggctcaaatggttgccgctcctcgtgctttgctccaagctttgtcctccaggcatcgaaggaactttctatgcgctgctcatgtccatccaaaatgccgggttgctgatgtctggctggtggggtggcctgatgctgcagttgctgaatgtgactcgaacggagttcagtaacctctgggttgccgtcctgatcagaaacttgtcgaggctgctcccgctgatgctgctgtttcttgttccccagagtgaccaaaactcaatgctcctcccggcagagatgcttcaggacaatgaatctactgaagctaggaaaggaggtcaagacactgctgaattttccgtccttgtcgcagatgattctagctgtcatgctctgaatgtggctgtcgaagatgaaagaatcaaagtggtcgatgctggaacgggtactgtggagttgattcctctcatgaacgagctacaagaccgtgggagttgactgacaagctcatgaacaggatacttgtcttccatccatgattcattctataccaaattaccaatggcgttctggttctgttctccactctttggtagactagttctttatgtatcatcagcaacagcacatcaataggttataggtgaaacaacagttagttttcctttcattttttgtaacagaaagaagcacagtatcatttggaaggatattgaggcagttccttcgggttttttttgggtgtgtgtgtttttgtgttttgttcaagcgtccttttgggacgtacgatttttagaggaatttcatgtgacttgaactgtttcatcatgtgaaaattctgtaaaattcatgaattccaaaggtgctcacaagatagtatgatactgtcatagacacagacagacagaggcaaaccattccattcaaagccagaatactgcatcggatacgacaggaggctggcgacccaaaacctcgcgtttttcttacaagaaacaaatcccagatatctcacaccacgaaacaaaccgcaacaggataccacggcgatcacgcttgtttgctgattcacctgccaacggcgatcgatcacgctttactgctgtgctaacctcttcaggtgctgaaacatctcctgctttatccaccgacggtcgtatggcaggaaggcatgaagcgaccggtcgaacctgcgaggtgttgagggcacaaatggttaagttagttctaagcgcatcagtgtatgattagtaatgctattcgatgtcagggaagccggcactcacactagtgcacttatgtcggttaggccatcgatgaaattgtacaggtcatttatatcataagttaagtccctggccatagggttgatatccctgattttcctttcgtaaaggccacagattcctgtcattccatacagcaaactgtaagtaccaagttcctcaagggaagaacacacatataaacatagaaaatggattaagaaacaaggaagagcacgcaatgcttgtcctgggcatgattaagaacataatggggataatagagatgcttttcccaagacttagaatggaaaacagcaacaatcgtacagccgttggcatggtcctatggttagctgatacttgactgcgtgactcccaaactatgtgaaatttacagacattcatttaatggttaaagaaaacgtatgactgttatcatgttgattcaaatagaagcactacgcatattcctcaatgatatttgagctttaaagagtagcttgttgggttttctgtacattagctatagcatatcatgttagtttattaaagcaatctgtacacgttctgttatatattcctacaaggttaaactaaaagacagtgaacaaaaatctgatgaatttcctgaatttcagtccaaagtactaacagataaggagtaaatgaagaaaatactatgccactgcttatatagctgaagcaagcaacaaatgctcatgcaatttattaatgcaccacttttgtgataagttcataaccgggaacatacaggcacaaaaggggaaaggttattcccataactgcactaacatttcaagcaagcatgagagaaaataccgaccatccagtgcatggttaactgaattgaagtccataaatgttcttgtcgctctgttctgcgatggttgcatgagaatgatggtgtgcctcccggcctgagaaaaagggcagaaatcacatatggtgcataaaatgctggcaaacatctaaaatgattttgaaaatgaaataagctcgcattactctagacactgagaacgaacggaacaatatctttgccagggtgaccgaagctaatgttatttttgccgggaacaatattcaatgcacagcggaaggcagtgaatgctgcagcaaaccatcccagattctaccaggaaaaatcacactaaccaaccaagcattcccgatttcccaaaggaagacaaggagaactgcatttgcacgcccaacaggcacaaactagatgatatcctgagcatttcggcagccctacgcacatgagcagaagctccacaccacaaagatggtatgattttgcatgcaaaacccagctgcctgtacgctagtatactgtagcacatgattcttccttgccttcctactacccaaagagacgagacagctggaggttcttcaatcaagcatcaacagaagcaagcagctgggggaggagaagcaggagcgaaacgggtgcataccatgttccgagcgaagagcgcgccagccgccgatgcagctctggaccagcacacgcgcccgccgccgcgccggccgacgaaccctaaaaaggaaaaaaaaaagcacgcctcgattagtgagtggcactggcaccacagggcagggcgcgagctcctctcgtcaggtccaatccaggcacgggcggggcggggcgggcggagcaagaccagaggagaggtgttacgcttacgcgaggaagattcgattgctcgctcgcgttcgcgtgacaacgaaggggaaagggaagtgggaggtggtggagccgatcactcgccgccgagaagcacacgagactaatgctgctgctgctgctgctgcagtgcagggctgcgtctggtggcttaggagcaacgcaacgagggggtgggtgggtgagcggtgagctttgcaattgattcgattttgatctccagcaacagagagggggggggggatagggacggaaggcttctagcgctttgtctagtactattatctaaatttaaattttggttgaaatgtatgccgtactctcttcattctaaaaaaaacttaatctaagagatgatgtgacctctctttctaaaaaaactgaacttagggctagtttggtttgaggcataaattttacttaccaatatttgacaattttaataatgtgtagtgtctatttgggaagccaaattttagaatgtctaagaaaataggccatgatgtgatctctccttctaaaaaaaactgaacttagggctagtttcgtaaaaaaaactgaacttagggctagtttggtttgaggcccaaattttacttaccaatatttgacaattttaatagtatgtagtgtctatttgggaagacaaattttagaatgcctaagaaaataggccatttcaataattaacttaggctatttttgtttagcacaactttgccttcctaaaatttgtcatgccaaaacttaccaaaatttagcattgacaaaaattccaaaacttaccaaaatttagcattgacaaaaattccaaaacttaccaaaaattgataaggccaatttactagcccttaggaaacttagcttaggagacgatgtgaactctcttgttatattgatagtatgaagaatgtcacgcacaagcaggcagcccacaaacagaatcatagtcaaatgcatcagcaagtaattctgaggaaaatgataaaacttcatcgcacacgaggcacgaatgctcaagcaaacctcagaattaggtatcaaaatttgaccgctacaatgacacgatatattgtaaaccaacagaatactccaaaaccatagtacattgttacaaaatgtgtacgcacagaaaagaactaataaagggacacaaaaataccacattaagccttgttcatctcaggctccagcgaattaagctgtcacccgatagcaaaatccatggcttctttctttccttcgttgtcgaaacaataatgaacactcatctgaccttgcaaaaatatacagcacaaaactggctgttgctcacatctccagtacgagagttcctctggggtgaaacacctaagctatagagaatacacgatgctgttttggctaggcacagcatccaaaaggttgatatgccaaggctgccaaggggctattatttcaaaagtttgttgcaggcgtcgattaccacagcatgcgagctcaatatagcctgacctgaagagtttccgcccatggttttcatgacagcatcaaaaattcctttgcggaagtatgtatcctccactgcttttagaatctcctcaacaacttcaaagctcaagccacacgacaaactcagtcgtgcaacaacttcaccaaacaaggctggagctagaggaaggtcaataccaatatcttccagcagggctgcatacagtaagcatccagttttcaggtcctcagtcttgaaaattttcttggcgtgcagatgctccagcagcctaacaagaggatcaatgaagttgggacccttatccaaagcaagattgatagcttctttcacaatctcagagtagtactcaggacactgaagctcctcgatacattgttgtgcttcatccagaatacgtatgccaaaatactcttcaagaagggataccgtcttcttctgaactgcagctggcatctcatgggaagaaccggctgctttgtctgtgacaggcacaacagctggagctgcacttacaggttttggtgatggtgcagtttgagctggtgtatgagtgagactagccataaggctggaagggcgagatggtggaccaccactgcccaaaagagcactcttaccaattagtgctccacttccatgaggaagaagcctggagttaatagatgatggcttgttaatagatgatggcttattaagcaacggaccctggttacgaagagagtcgcctcttggcattgatttagaacgtggaacttcccagttatcattatctaacccaggcattccaggcatctttcttgatccaggcataccaggtgttccaggcatcccaggcatcatccctcctgttcctggtcgattcattgggaatccaccaggggaaagaggaccacctggtgcattacggccattcctcgtgagtcctgttgcccctggccgtagtccaagtgtcttcatagcctcatcatgaatttcactgattgtcttggccttaatctgaagattgcaagcatcacaaaactcagaatggataataaatttataaatccagctaaccagtgattgctaatacaaacagcaaactaagagtgggaacaaaaacattgaagccatacttggcattaaatttagtgtaagccagaaacaacattatggtaccaaacagaatgcttcaatgtatagtcaaaacggtgaactgatgaattatttcaaatatggattataaacatggccattctcttattaatataggggtgtacaaagcaatagacaaacccgttgattctaaataaatatatgcaatttcatagcactggcgattgcttgccattcccacatgagcatgcatgtttatctaataagctcacagttaaagagccactacagataactatggtgctagaatttggtagccattgaccaaagtactcatagcagcacctcggtacaaccaagagactaacgtcattatgaaagaaagacaatgcatgtataaaagataactaaaataaaacactagggtgattttatttacctcttcacgtcgaggcacccaattgtttgaacgaagatcaaccacatcacgaaccataaacctcagacgtggtgccaactgaaggtttgttgttaactccttcatctgaatgaagtaggtatcattaattcgacgagattttgggttctcgtcaagctgtttaccaattgtattgaagaactgacaaatagcctcaacgttttcctcttcagggcaagcctttttatcaggtccagaccccaagagttcctgcatatagaacagattagacaagctacccctgaataataataactttattaccaatttgctaatgcatacctgaacaatgtgatgaactatcttttcaggtaccatcttttgcttaagtagctcaccaattagacggatatttccaagtgttcttagtttgacaatcctttctttgtcccttctctccatctcttggtcagggccagtcaattttgctatttcagcccttaggctctcagcaccttcaaatgcttcctgacaattgttcaacagcacacgcttgaatgtaatctctttgccacctggttcttccgaagggaatgatggtagcttctcattgagatcggaacaaagttgagcatacatcggacagaaggtgggctcaaaaacagccttctcaaatatgagagaaataacatcctgaatcaaaagcagaagatatattaatcacaaggaggctagcaaaaaatagaaagctacagaaaagagatctaaaatcatccaacctttagaatatcagcagtggtaattccagattccattagttggcccttgagtagatcaaatttctccggtgtcagtttgtttagtatactgcatacgcacaagaaaaacaggcagcaagtcaatgccagaaaactgtgttataaagaaataaagaaataaagaaataaaagcactcaaaaaggaacaaaaacatgaaaaagactgaacgataattatgataccctttcactgttttcaggactctatctttctctgagagattgcctcttctagctgaccaaggtacctcagccttgataagagcaggagtcgggccaacctgaaagacatacatcagcaaaggcctgatcacaaagtcacaaatacatacaagtatacaagttatgaaagaaaaatacatattaaaacatgtgaattgatttcatacaacaaaataatatggactgtcacatacaagacaaactgacattgttctgtaccaatttataacccgacacttcttctgtggtttacatttcaacattcattgcaagaaagatagggttaaaagagcatagatggcactagtgatcaattgtgaatgaggggacagcaaaatgtgtaaataacactgttgagttgggtagacgatcccgcaaaaggcaaaacctagttagtttagtaatttgatgaataataatagccatggattaaccgaggaggttacatcagacataatcaacagagggaaccaacattaattccgaatcagtagctaccactaagcaaggctacttcaaaagcaacattgtttagcgcaggaagaaatatgagcttattcaagatatgaaaaaaaataatgaatgaataaggtcaaatggaacaaactttactgataattcttgtcttgaacatacctgagcttttgaagcaaactggtggtttaattgatcctgcctgttaacttgctcttgttgccgaccacttgaagcatgtgctgctttagcttcacgaatgttgtcccaggacttctcttcattagctgccggaggttgaaccgtgcgtgcacgccagtcacggttatctgtctcaccataccgattgtgcggttgcgcctgggtttgtgtctgcacttgcacctgaacaacaaaagactacaatttgagacagaattgtatgcttcaaccagaccaattggtaggattgattaatacgtatggtaaaaccaagtgaattatgatgacagcggaaatagcaagagctcacatctgactcagggcgaccccaaatctgatcttcaccatgaagctctatatcaatctcttgattaattcttaagatggcctcaggtatgtcaacgatctgttagtaagtaaaatcataattagtacgcaaaaaattagtagtcttcacaaggtcgcaatataaatattatatgccagttgaatgttagacactgtctaatgttgtctcaatagaaggtgtagtacatttataaaaccaggttaaaacagaacgaccgaactgcgaaaatagggtactaaaactcaacccccccccctctcttttattgcatttcaagactacagagtaaacaagtaaccaaaacttatatcgaaagaaagctgcggctcttccacttgaggctagtaggtacagtttcacttaaatatcctgtgagtgcctctatttccatcctagatcggtgctactttgtatatagcatagtctaaagttaaatcattcatcactgaaatttccaatgatatgctagcaacgcataccatcgaagtactcgtaccagcaaaatttctgttataaccatttcaatgtggccaatttagacacttctacatttattgcagccaaagttggttgtgtttcaactttcactgcacgaatacctaggggacattaacgtggtatatttcgatgtttgtgtgctatgcacctagttgcagaaacaccacctacgcgatattgttttccatgtctgatgtgttgaaaagtattccaaatagaaacttctgctctaatttagctcaaatgtgccagatacgctgcaagcatttttcaacaaaaccaaacgacagggagcacgtaaagcagaacatgtctactaagatattcacagcaaatttcccatccagaaactgatattgaataacacaacagattgcaagtacctcacgcagttcgagaagttgatctcttgtatagcgaacacgctcgcgcacctcaaaatttggatcaccaatctgcagcaaaagtatcagccatgtcagcatatcaaattagaaaacacaagtccacaactccacaaattaaatcacaggacacaacattttggctaataatctgagagattgatccaacaaaaaaatatttgacataaagattacataacacccacgacaacaacaacttgcttgattcagctaaggatgcaatacataaatgctgtttgcagttttaaaacaaacatatatatgtatgaaacttgccgaagaacaaggcagactcagttaacttatatgcacggcccattgtatcgcacaagccacatagaagagcaatagaagccctgaaagctaaaacaacactggaatccactacaaatcctaagtatagcatgctgaaccatgaaatatccaactttaattagcaaaagctgtcatatcacagtcgggactatcagctccttgtctcgcattaaccccctcctaaaactaggtcgagccgtgcaagcgataatcaactacaaccactaacgcccctcccagattggagcatcgatttgagatccgatcctctcaccggatctccccctcccacgcccgccaccatcccatcgaatccacatcgagcagtacatcaagccgccagatcgggcgcgtccaagctctcatcccccatcatccccccctctcaccttggatgcgccgccgacgtgggagcggagcaagtcgccggagccggaggcggcggcggcgaaggcgggggagaagaggcggccggggcgggggccgccgccgccgccgccggggcgcaagctgatgacgggctggtgatccttctccatgcttctcagacggggggatgggagggggatgaaccgaatccgggggggccgcgcgcgagctcgatcgaggcggtggggggaggaatccgcggggaaatcgcggagaaatcgaaaccccttttcccttctccctcttcggcgagagaaggttgcgtttgcgaggggaggaggggaggaggaggaggaagggggagcggaggcgtggacgacgggaggagggtggggttttatcccgggtgcttttagggctgaggggagggtgggtgtgggtccggatcgtagtttccgcacgcttgcgtgggtagtctcgtactttcctatgcgcctcgcggggattttactggcacactctctcctggtgcctggtggtgtgcgctggtgtatttgtgtgcgggccggtatttgggtcgtggtggttttgggcacgagagattgggatatttacgattgggggtatccggggcttagctggtttgtgacctgaggggtgggtattaccgtactttgtgcagttttgctctgcgtgctcgactgctcgcatagtcgcatccggcttacggttacttctgttcttcatcgagttggtattatataccagatctgttttaaaatataataaatatattttctatgtaatatgaattaaacaggtcattaagagagtacattttaaatatgtatctaggcttaatggagaagtctattctgtcctagggtctcgaggtcggagtcttgacccccgcgtcgctctcacgcgggcggctcgggggcgaaaccctagccgcccgcgccgccacaccttcttccccatcctccacctcgccaccgccggagctcggcggcggcaaagccggcggtgagccaggaaggcggcggcgaggcccatacgagtcagcggaaccgccctctgcgtgaggaggacggagatggccgatgatggcacggccggaggtggagtcggccggtcagcttggggcggcggatccggcgcccctgtggcaggatctggccccccacctgcgggccagcgcggtgggcgacacgacggaggcagagaggggcagcgagcggcagcgatggaggacgcgggtctcgatcggcgatgcagcagcgaggcggtggtggccctcggcccggtgatggcggcggccggatccggtgatggcggtggccccttgaccagatccgtcgccctcctggccggctgacgacggcgagctgcctaggagaggtgggggccggtatgccctcgccagcgcagggaaggctgcaggaggccggcgacggaggactgagccgggtggcgggcacgtgacggaggcgggggcctggtgctgcaacggaggcggggggcgggtgcgcccaccggcggttgcgggaggcccttgtgcgcggaggaagtggtggccaccggctgcgcccactggcgtcttggcacggcgcagcggagcgctcgtggtcccgatggctggccgagcctcgacggccggtcccatggccgcctcggccggtggtcgatgcagcagtggatggtggaggcttggcggctcggcggactggtgaatctgcctgagctgtgggtggtgggctaggcttggcggctggagtgacgatgtggtggtccggcgacgttcgttgcacgggtggattgggtggttttggatgacgctgacgaaagccttggctggcctttggttggaggcatcgttcccctccttggaggcgtcgttatggcgtctccctcactaccaagaacctttcccatgcaaggatggtcgttcgtggaccccgcgtcgaagctctgtaagcctagcttttcggcgaggccttcgtctcctaggttccattcttgatgtggcgagcgtacaactttcttcgttttcttctaggtgaagtcggagctgctttgttagggtgcaatgaagcttggcaacaataacatgttgcagttttcgaggggcgttggtgttagctgcgttcaagaagtggtgctctggtgatttgcgctgatgttcaaagtggacaatcgatgtcttgcttgttttctgtgatgcatttggcaacgatgttgtgatagctgtggagtcgaagctgctgtgtcgctaggcgacaagcccggcaacgataacatttgcttcacgaagtcgaagcctttgtatcgcttacaacaagctctttatcgatagctgttttgggctccgccatttttcctttttccatggtgtcggtagcttaggttagagtgttgtggttttcgcccagttttcccctaattaactgtgcattgtaaggtttggtctcgttttctccttaaaatgagacaccttcttctttatataaaatgtcggcaatggcctgaccgttcgaaaaaatgtatctaggcttagaaattgtcttagaagcttgaaattctcaaaagcagctgataagaattcataaattctaaaagttttttttactttttactttgaatttattttctagacttttggtaaaaacatgaacagtttgaaggggttaggcattttatataagactagaaaaaatgtctgtgcaatgcaacgggtgaaagctattttaatcttatcgttattacttattatacgatttagttaaggtgaaattcactttgagaattcgcttggatatatatatattttagaaaaccataagttgcaattaggagtccgaccatctaaagttagcacgtgagttttttttaaagagatttcctatacgactccttctgtatttccaaaagcgaacgaactttaaaaaccgactcaaatacagatctgtatttccaaaagtgaacaaacttaaaagccgactcatacacggatggcgtaccaaagtaccgacaaaaacatcttaatccttataatagtagagtgggtatggttgtcagaaactcctcccttaaataacgactaggaatatatagttgagtgaggtggtggataggtcatgatttaaagtatattttacaggtgttagatattgtttttgtatgtttgtgatccccccttgtttaccatactaataacgtttattgcaacaagcccatagactcgattgcacgagtacatatgactagggatgggttaggacgatgaattgagatccaacctcttatggtctatagagtggaagaagggatataagcataattgagacctaaccatttgtagcgctgggaggaggaataagaatggctccgcttttaatcattagagactagcttggtttcaatttatggtctttgctatctttttctcgtttggatttataagatgcaaatccgtattgagcaggtgtttgatactacctcacatattccccatgcccaaatgtaattatgctttatttatttccatatctgcattatatttaaaaaaatcccatctctactgcatctaagtcccactctgatatattttcataaatagaaagttttataaggaaaatgtgagctctattgattatgaaatcaagttacaattgtttaatagaagctcacgaatataagttggtgtttgcacatgccataccgcacaatgcattgtgcacataactagctaagttattttataatgaaaataattattctagcttttgtttcaaagaaactataaaagttgcaggataaatgattacaaattataaatttacggtttaattaaaagcaagacaaccacttaaaatacaacttaaatacatatatttctatatatatggttggtcagagtatatatggtgaagagaagatgcacatcggtggtatgcacggcaaaggacacaaagatgtccgacttattcgctaatagcctcgtcgccattctcgttctcgtctatgtccaagagaaagtcgggtaggggtcagccacaccatccccaccgccggcctcgcgctatcgctctcagtgctcgatgtcaccacatcgttctactatcacaacacctcgtccttaagaacacagctgccgtcctagtgaggctgtttgggatggtgttcaggtgatgctcatgaatcgaaggcgccgattgttgttggtacatgacaccgtcgtcaatgtgttgggcacaagcgacgtggcacaatacaccgtcgtcaagataaagtagcaactgcaccacacgcaatatttgggtgtacaatcatgtgctggtggccactaagaaagagagagaagggatggagggagagaagaggggcaatgatttatgggtctcgctataatttttttgttttcttaactagggcacccactattatgtgggcctaatatttgttttaattttttctaaccagattccaaatgacacgtggatcccactagtgttttttatattttcttttagtgccatgtaataaattttacgtgagacgaagaccaagtaaacatgttataccgacatcatgtgagccaaaacaatcttaatactactgagagactcgacccaatcttatgattgaggaagaaactcgacctatgattaagggacgtaaagtggaccttttcctatacaaattcagccacagcccacgccccacggcgacagttcacgcgtatcagggatcagaaccaaacgaaaggctggcctgctcgttattttggtctggcccattgaaagcattggcaaagatccagtccgttgtctctgcaacagccgcgcacaggcgacaggtgcacgggctcgttccgcggcgtcgcatgcagtgcaggctcgcgaggctactaaactcgccttccactctgcacaatttgccgtctctagtctctacctgtgtatgacccggccgtgccagaacctgtactaccggaatacggccagggagtacatgccagttattttggaatttattttatttttttattttaaattttaattaatctcatattaggttttagatggtctcttctttccatagtttttatttttactaaaaagaagtccgcgcgatgcaacgggtaaaggttatcttattatcatcatacaatttagttaaggtgaaattcactgtgggaattcgtttggatatatatttttctagaaaaatcatgagatgcaattagaagtccgatcatctcaagttagcatgcgaattttttatttagatttcttatatgactccttctatatgtccaaagacgaacgaagttaaaactcgactcaaatacagattgtatttccaaaagtgacatgggccgacatgacgatgacgaagccattagccattaggcgtcgttctccttcttgaaggtgtcgttctgacgttgacatttcttagcaccaagaacctttcgcatgcaacagtagttattggtggactcctacgatgcatccgaagctctacaatcctctataagtttctctgttttttttgggatgtctatacatctattgatagaaaatcccacctcccatctttcaaatgttggaccgttggatgtgttttaatattcgtgcagatgcattaaccctacctctcatcctcctgttcccctcccgtcacgcgtccgcacccctcccatcgctactcctctgcccgatccgccgccaccgcccgcctcgccggctggccggaggacgtcaacggcgccggcgagaccctcccctccccccttcctccttgagccgttggcggcgaggtgcccccgccaccgacgccggcccaccacccttctccagccctgcggcgttgccggcgcctcaccggccgcccgatccgccgcccaccgccgggctgccgcctcccccagccatccttctagagccggcgaactcctcccctccccctccccttcccacccccaccccaccccaccccgcgatcctaacccgtagggtccttgccggcgccggagaaaaagaggaggtcgccggagttggaggaaaaggcgtgatgcacgaatcttgaagcccatccggtgtcccaaaatctgtaagatttggagatgcaaaatctgtcgaaagaaggttagcaatttcgtttttcttctccaaaataatctaccgtgtaccccgtgtaatgctgtgacgggagtgggtgcttgtttgtagctgtactagccggctagccgcgaccggttccatcgatacctcatatacctatcacgtgtgccgtttgcgcgtagggaggtttgatatagtagatcggacggctctcgtgcgcggtgtgctagatggtgcctgcaatattttgctcgctccgcgtcaaggccatgatgcgtacgcgtgcttctcacacgaaggtccccacctgtcagcccagccacccgagtacccgacaggttctctgctgcactgcgcgctctgctcgccgcggtcgccggcggccgacccgcgtgaaagcgtggaacatatccgagacttagttggagacttgggccgcaagcagattggatgagtttggttgttgccttaattattattaatcacccgtctcttaacgggtcggatcatatgtttgttagcgagaccgagcaggatacctgaattaatgaatttaacaatccacatagctgtacaccctataaaaggcagcagctagcgaacaagaattttcgtgttttgtgtgttgacatgaagataactactggtgacaggtatatacatgtgcagattttttttttcatgaagaaatacggataacgatcgctaatgtgacctttttttttcttttctctttctcgcttatgtacaggaaagaaaaacggaatgttggattcaagattcctaagaagaaatttaggttttgtgttcgtgatgagtatggcacgaaggcattggctgagcaagttatggttaaatccacgtcactgtggcgcgagattgagcttcgtaccgagacaaggatgattacagcatttttttaccatgggtgcggccttcgcacatggtcagcgtacaggcagaacatccctatttttaataaattgcatgccgcattaaacaatatactcagaaggtacaagagtcgtcgtgtggaaattggcctattttatctgcaatcaaatatgaaatgttttcagtttacagtccggagtcctttggacaacaacaacgagtttctgaaaaagttacggaaaattaaagcacacgaatgcaacatgagagaagataatgcggagaaaactggaagcctttcccctataattatggggacattgagattagttagcaagaggcatgtacttggctttatgtttgtgatatttttatcttgtgtaataatctttctatgaaaatataagatatcttgaacatcgcctaatattaattatttcttttacaatgatccttcttcatattcttgttggttttctaggccttgaaaacaacaatagaactccaagaccatagcaacctacttttatattgttgtacaattattcataaaaacatgtaaaaaatattttgttatgtaaactttatagcaagtttttttcctatcctattggtgtattgctggcctaacaaaaaaaacatatattttatcctcgccagtttgttttattgcgcaagcgttttttggtaggcttgcggttttttttgtccatccggttttttccgtcagtgttttttcacaccgcagttcggttttcatccacttgtttttttatttgccttttttttcgccgggccggaccctaatgttgcctccacatcgatctttcttcccatgcatgcgtcgtttcccccatccaattgatcgcaaaaatcgattctatactcatccttcatcattttctccatggtttcccctttcaactcgattttaattcgtcggatttaatctccatttaacattcgtcgatgatggctggccgttgagctttcccgaccattttatctgatcaaaattccttaaccaattttgggagatcgagaaaattcagccggactttatgggtaggatcggctccggcatcgtacggcacaaaaccatattccgaaggttaaaaacggtagtcgactgtgcgagctaggcctgtggctccacttgtccgtgggcctccgccttcctccccacgccgcatgcctccatccacccaacatgcactggtcgtcgctcgccgctcgctctctctccgcccgccggcctttgcttccctagtcgcctgttggcgagctcccaaaccgcataggatgccactccctccctccgcatgtgcgccaccgccgctccctctgccctagcccacggcaactccctccttgccgcctagccatggaactgaactgggttgggactagacaaggtcggggatatggctgatgtgtaataagggctttttgttagttcagggtagtagatacattttcttttgtattctaaatgaatctctaatggtggagtaaatgtatggtcaaatggttattacaattttgaaaagcgggttcattgagcaaacttcaaaaatgatggtcagtttaattgttaggcttcaaaatagggtgttaaagtgaaagacaaatgcatattctcacctgtctcaaaataactttatgattcaccatcttatttatgtaagaacaaactttatgtataagggtctatttggatcacatggactatatttttagtactgtcacatcggatgttatgacactaattagaagtattaaacatagactaatgacaaaacctattcgataacccttgactaattcgcgagacgaatctattgagcctaattaatccatgattagactatgtgatgctacaataaacatgtgctaattatgatattaattaggcttaaaaaaatatcacgcgaattagctctcatttatgcagttaattttgtaattagtctatgtttaatactctaaattagcgtccaaacatccgatgtatgtgaaggcgtgcaatgattgctttaggtggtgtttggatcagcccccctccatatatatatctttgcacataacttgccctgacgagtgcatttcaaccctgtgacatcccggcccaataaggattaggcctgtgtggcccatgtgagctgtgtgcgcatgtttagtaccacgtcgctagtttagcacgagtggaaccgacttataaggcctcttccctccaaccacatcactccggggttaacccttttacacgaagcgaggacgaaagtgtaagtggggtggtgtgtgtaagtgggcccgctcatcggttggctgggctacgcggttctagagggagggctgttacaaacccaatcctccaaaatatccctaaatcagctaaggtttcgacagtgagtcggtgaggttagcggaagaaggccgagaggtagtggttgtgggggttagcggaagaaggccgagaggtagtggttgtgggggcctcagcggcaggaggcaacgcagtgcagcggggttagcgatggcacagtgcggtcagattagcggcgggaggcccatggattctccaagctcgtcctcgtcttgaagtcaccggaagaaggtgttgttgctcaagtgctcgttgtgcgggagatgacattttctttttttggggaagaacattttaagtattttttttttgggattctggtgtcagtatatagttacaaagagatatatgcgacatgttgtgatgtggagggggctaagagcaaaagtgttgcctatgtgacataccatgttggtggtcaaacgtggtcaaagaacgattagactgggtgtgatacattaaaccaagttcacatatctaaacgtgcaattttttagtccacagacttaagtgacaccaccacacaaatttaggggaccggccatgtatttcactctataaacagccataaatccacagaaattttgttcacatctcgttctaatcgtttcaaccatgccccgttctcgccgcggccctcccaagggcgccaactcgtcggtcgccggcgctgcgccgcgcgggggacgcgtgagtggcctcaatcaagcgtacaaccggatggcgaaggccagccgggtgcccaacccgctggccacgcccacgactcaccagggggagctcccgggaagacgtgtcgaagtgaaagaactgaagttctagtcaaaatatgataaataaaaatattgttttttaagaacattcatttgaatgctgtcgtgctctataattcttaagactatttttaactttcccttcaactaatcggcagcaggaagctagtatggtttgctttctctcatagccgtggatcctattctctgcattcttctgaggtgcagcagcccgcggagcagctgggccaccaggtcgccggcgacggggtggacctgcccgtggcggcccaggagcaggcgccagtcatgggccaggagggccatgtgccggcggcgcccgtgcacgcgccggagtccgatcctccggcagcgtgagggcgagtgcaactgacaagatcgttctgcaagcgaggagggtgtagtggcaccgaagccacgcaacgcaaaacaaagcataatcggccatgcaaagtagtatgtagtaggaaaaaggcagtgaatcggctggtagtttgtagtaggagaaggagaatgaacaagaagtatcttgaatctggagacgttaatgagaagttatcctatatgaatttcttctttctactgtttgattgaattgctgtttgtttttcttttcttttttgcgtttttgtgatattttctttgggctgggctaaactgttcgaggaagagggtgggctccggcctttcgatcggtgctcaaaggtgggtcttttggcctcttcgtgcctcttgatcttgatctgtaggagtatattttggctgtgtttagtttagtgtaaagtttgaattttgattgaaattgaagatgatttgactgtagagttgcgtgtgtatgatatgttaatgtaatagaaaaagactgaagtttggatccaaactctgtatctaaacacagcctctgctagaaccgtcgtcctcttcgtgcccttgtgtgattgctaatagatctgtgtagattccctcactctctcaaaaaaaaaaaacagtgcagattctgtctcggtcgcgctcctcttcgcgttccaggaatccgccgcttctcgggaaggcgggcgcggcggcgcttccatgttcccggcggcggagcacggagctagggctcggccagcgccagatctaacggcgtcttcctagggaagagcaagagcaccggcagatgcctcgtggtcagctatatcggccgtctgcggcggcctcggggcccaccagatctggcggtgggcggcgacatcgagctgaacgacctccatcggcgccaagcagaccctgccgtatcgtcggcgtcgagcagcttcgccaacgacctccacttctgcgacctcggcggcggctgctcgttcatcccctggtatatttctttgctcttggcaagaacaagaacactctttgttcttggcatgaacaagatgatcgtgcctgctgcaattgtataaacagagaatttgttggatctgtggctgcagcgtcattgttggatccgtggccagcagcagcggcgcccgtctgctggtgtaggagagctctgtccatctgtcaaaggagcagcaaggaagaattggaatggagtattgcttctggttcatgctatagcaattttcttttatagaattggtgctaatgagtttgctaaattggaggtcactggatgtctggattggttgatttgagggtaattgatgttcttgaaagtgcagttttttttaatggtgccaactctacaaatttaatgtataaacttgtcttcttggttggttgatccagatgcggtgagttgacaacaatgggctcttgcatctcaaggaggaggtgacgacagaggtcaaatgtcaatggaggtaatgtttcttcagccaatttcacaatgttcaatcaatatagtttcaggtttttcatagcacaaccatttggactgtatgcaagggagtaggagtacatggattactcctacaagggagtaaaacagtgttcctgtaagggagtattaatactgcaagggggtaaaacagtgttactgtaagtggcaattctgcatcttactgtaagtagcctatttaatccctttcctgggattcaacgtactcgattcatactccattgaacatcatacatgacagaatgacaccatgattcatgtatccattcaatttcagagaccataaaaatgaggcactcaatgaaaagacaacagaatagcctaccaaacttgcaatccaaactttgttttccaaaacaaactttagaacatatgttgtgcatgacaataaaccagaacaacaccagagttactcctttacatcagtatttgtactttcatgtagttttctcccttatatcagcagtatttgcaacttttctcctatacatcagtatttgcgacttttctactctccatcacaatagtgtcctaagccattgctctaaccaacttgttctagacagtccaacgccttctcgtagactctagcatcacatgatagccaagatggtaaccttccttctctttccaaagcttgcttattcatatgtgggattttgtacctatttcctccattatctttcatcacttctagcatgcacagctgtagagttaggaacactctgtttatttttgaagcttcataaccatcaaattcttcttggacagcatgaattagttcttgaatagtttttggacttgagcaattagttaatgattgaatggagctaaagaatcctaaatctaacacattcatatctggtgaatttgagggttgtttcagctgaatgtttagtcctgttgcagccactgcttgtaggaagtgtgggtcatttggagggacatgtgttctagcgttgtcctgttggatataaattgtatccccaatgtcctcttctggccacaatgactgaatagctggaattactttttcaatcaagaattgcctcatgacatccctgttgactatgatagattttgtctctaaagtccctatggttctgttgcgactctttcttatagctggaacctgaaaccaattcataaagagttcagatcagaacatagagtaagtcatttgaaatgatgaactcaaactcacctctttaacaaatggccacgtgccaatcttgccagaaaaagtcacattcccttcctcgtcaaatctgggcctggctattgcagttaggaacataactttaccgattctattcttattttgaacagtccgcaaaggatcttcttcttctggcaggagatagtaggtcttcttccttttagtcatatcaaccacttttcatcaatatggactatgttgtgcatggtcatgaatctaggatcaatatcaccaagctctaacattgaaatgcagaatttcaccctttctctcttattttcctccctcaagtatggcttcaacgtattggagtggcgtcttatcttacccagcttgaatttttggtgcactgttgcaatactcacacccaaagagtttgcaagtgaccttaaattagatcttctattcagcggaattgtagcgatttttgagagatcaatttccatcttgttggggccacagcatctagtttttctgttgtcaacatcaaccttgagcccgagtgcaacctgttcccttgcatgcttccaaatcctttgaataacttgaatacctacattgaaatattctgcaaccttttttgtggtgtccttctctaatctgccacctttgcttttagcatgtaatgctatgtaaacagcatatctttctttgtctgataaccatctccttatctttctctcttgtggttgaacacctacaagggcatgaatgaaacaggacaaatatattaaatcaaattaacaagattcaaaataatatggataagcagttgtactaggactaggagtactagaattaatataggtaatcaaaacatgaattacatatcaacatgtacttagagtagcagaatgtcaaatcaacatgtaccactgttaacatgttactaggagtgggagagtaggagtactaggattctggagttgatggacaattaacatggatagacagttaacttttttttttctttcactctttatttcagttcaagaacttcaggcacagggaaataaacaaatggcagcaggagtatgtgtacaacagtacatgcattcaagtgtacaggcacagcagaaggaaactctacaacatgtatagatcagcttgtataccaacataaaccatgtggaggcttgtcaatgagtaggaggcttccatcatcacaatttgataatgcagtttgtatcttccttttgtaaatgcagtttgtaacttctttttgagactgtaacatgttgggagcagaatttgataatgcagtttataacatgttgtaaatacagttgttgaactattgggagcagaatgaatgaatgaatcgatctgacagtgtatctgtttggcaaattgagtcatgagctactcctggttatatcattgaacctacaaactgaacaagcatgagttctccagattttagaggcaagagtacaacatctactccatttcagaggaaagagtacacatctaggaattgcagaatttcaggggttctccaacaataccatgaatttttttttacagtatccaaaagattttagtcaagctttcagggtttttactccatgatttctggaaatttcagagaatactccctcatttctgaagtggaatacaatgatcaacatccatgatttctggaaatttcagagactactccctcatttctgaagtggaatacaatgatcaacatgtactcatagtattctacggagtaaaaatttcagtattctacagacatttcatgaagtgatgtacagacatttaggaatagtactctgaaaatttcagtatattaacatgatgtttggttgatgattcttaacatggcgtttgaatggcatcatcagttaagacatttcagagtgaagaatacagtacaacatcttcagtactccatttcagacatttcagaatttcagaacttacataaaaataaatgtgaactgtgaataatttcaaacatttcagaacttcaaaaatctgaaatactccaacatccttagcgagatgaatcaccttcacccgaagcaatgttgcctgcattctgagctattacctcgtcagctacagcacctcctccaccttcatccccagcaatgttgactccagcctcgtcagctatggcttcgcctcctcgaagttcgtcaccgtcttcaggaggaggagcgttgaggtcaaagagaggaatcgccgccatggagcttaacgtgatgacgcacacgcgaagcagaaacttgtggaaagggagctctgaaacttgggggaggtcgctgccggacttgtcgggctcaaactagtcgacgtgggcgtgcgttgagaagcgaagcacgccggagtttggctgaagcaggtgttctgtgaggcgaggcgtcccgtgccgtgccgcgtcgccggagtgcgcaccgaggaggctgcgaggcgaggcgttctgcgccgcgtcgctggagtgcgcgtcgaggagtgtgcagtgccggccatcggagtgcgtgccggggagcttggtgccgaggaggtgcgtggccgccgccgccgccggcgacgcggcccctgcgtgtctgcgagctactactacctccgaggctccgagcaatggaggggagaagaaagggacatcgggggcataaaggggaattcatcgcttccttaatttgaaattcaaatcccaggacgtcttataacttgtaacagagggagtagctctttaggccgagtttacttcaaaaatttttcttcaaactttcaacttttccatcacatcaaaactttcccccacacataaatttttaacttttctgtcacatcgttacaatttcaaccaaacttttaattttggtgtaaactaaacacacccttagtgttagtatttattttggcaaggttggttgcatcgatttggctgaggtgagactggtgacagtgagaatctgtgtccttatgttatgctctaaagattaactcctatattgcttctggatgtcatacttggaaaccatggcagtttttcattttcttgcctcattaatgatgcttcaatctatcccattcagatgttattgttttgaaaggtgtttgattgtattcctcaccaagggaaaccatagctgattgcagagttgatgctgcttgttgtcaacaccctgctgctgggccagaccgcccattggatattggtaacctgccagaatgttgtttttcgatgcatttatcacataattttcatactcgtctgaattttcaggtgtccagtcattaatttctgtatgccctgtgttgagataactgctcccatctactccctccgtcctaaaatgtagctatttctagcacagtgtcttgtcccaaaataaagctatttcttcacctacctcctcctctcaaccaatcacaacaattctttttcacctactttctcttttcaaccaatcatacacttcctccaattattctcacctacttttttaatacccatgctaacttcaaaaatggcttcattttagaacggaggaagtagattttaatctgttcagttgtatattcgtgtatccaaagctctctcatactactattcatggatgaaaattcaatgatattgatttgatagcagttctctgtaattggttcaacagagcagatcgtttgaattgttctgaactgcgtcccatcaaatcagtacatacaattgccaacactatcatctactaggttcgcagtgatgatttactcgagttcctttctatcccccgttgtgtgaatcttgattgatcttggttctgatttcactgaattgcgcaatgtttgattgcaggctgggacaaggcacacctaagaaccacacctccgcacaaaacttgtatttgcaggcgcatgcgtcatcctcggctatgattcgtctaccgccgatgcaaccggagcagcgacgactagtgtttttaattgtacaatcaatatggatatgtgcctgagtctttgtaacatgtagtatgatttttttactcgacaaaaatatggctgtaatttgtgttggctatatggatttgttggtaaataggatactctatagtcagggagtaatttatttttagggttaattggatccatgccactgtaaatatgacaaattaaaaatatactactactattcacgttatctgctgagtgccactacaaatttctaaaattggaaccatgccactccatcattctttccgtcctccccgtcaatctttccgtcatccccatcatctctccggcatgttcaccatgtgggtctccatcttgccggcggccatgagctcaaggagggagtcgaggaagtcgctgccgcggctgtacgggtgcatgtgtaggcggtgacgaacatggggtcgcggccagcggcgaacggcggcggcgacggcgaggggacgctctcccatggccaccgctccgcccggtgtgttacgtcgtcgccaaggcggccgtggtgtttggcgcggcgcccgacggggccgggctggggctgcagggcaagggccagctcgtcgccgtggaggccatgttcctcatgtcgctcgcgctcaccgccgcgcacatcgccatggcctaccgcgccagctgccgcgagtgacgccgcctgctcgtctacagaatcaacgtcgaagctgtgagtgattgattcccttctttgcttgtatcgtatcaaaacaaaggattttgcctagtggtagcttgtagtgtggattggaaacatattaaacccaaaatatgcaagctttctagattccaatccgtgttttcgagagattttggagaacaacttaggcatacgcttgccgaccttttactggacatcacaatggccggaagaacccgacgtccccacatgcgaggaaagcaatggtagagcggtggccggtggacgagggcaggaggaggcactgccgcttcttgccgccgccggctgcggcgcagggcgtggagaaggcgaccgcggagtccgcgcgctcgatgcggagctcggcgacgaggtgcaggttgcggctgtacccgtggtcggcgaggtgggcgagcacggcgtcgtcagcgggcgtcatccggggcggtggagaggaggagaacggggagaggatggggaagacggaaagattgatgggaggatggaaaaagtgacgggagtgggataggtccaattttaaaattttacagtggcatatagtaaataacgtgaatagtagtggcatatttttgatttgccgtatttgcagtggcatggatccaattaacccttatttttaatgagaaggttcgagcaatttgtggccaaagcaatatgttcatatgtttttactctaacaatctggaagtaatttatttagttagagaataccagagtcaaatgttgttggtatggttagatcaaaagctatatttactgacataagcaggggaaaatttgatgaagggtaatttttagttactgagaaaaggccaagaagttatatggctagactaaaggtaatctatttacgaagagaaggcccgggtaaattttttggggagtaatttatttattgacatgagtgctacggatttttgtgggaagtaaattctttactgggtggacaccagagggattcttttgctaaaaaaaatatatttgtcagtaattgatttactgatagaggcttggtgtgactaaaagccaataatttatttactaaaagaagtttaggtgcataggtaatttattagtaatctttttactcgtggtttccaagggaaggaaaacaacaggagtgtggaaagggaaaaaaagaaaaaaaaggaaaaaaacgaaaaaaaaaaaggaatggagggagtatggactgcgggcggaaaaagaaaaacaggggagaaacgactgcgggtggaaaaatctcatgaaaaattcgaaacaatgagcatttgagattagaaaaaaaaatcctatataggatttttcgaggatttccaacattaggttggaccttatggccttatgggaaccttttatcgtctccatctctttccaaaaaaaatcgtatacttttcttatgaaacatcaaaataaataaataatcagtggttcgcaaaggatcctttgaacgtagtacggggcttatgttttccatcatgcaatttgatgacaaaatcaaaatgttcgtgcccttgagatttgattcgtaagcacacgcgggaaaactaataaaatctttcagcatcgaattgcacgacaaagataggatcgaacaaataccctgcaatatcgttcattgaattgttcttggcgatcaattaagcatcgaaatgcaagggaaagacagaattcgaattcgaattcaacactgaagtattttagtacaggtttacaactgatcaccgcccacactgacgctgctactcttcttcctcctcttcacaatcccctgctccttcaccgccacgcccttcctcttcgcgtcttccgcctcgccgttgccgccgtcgtcgccgccgccggtgccgaccgcggagtacagcggcagcgcgaccgactcgggcgccttcacgtgcagcgcccgcacgttcctccacttcctcggcacgcacgccgcagccgcctccacggcggccaccacgttctccaccgcctcctcccgcgccatcgccgcgtggcccacccgcacggcgcggcacgtgccgccctccacccgcagctccacgcgccgcgccgcctccctcgcggactccgcccacgcctggtcggcgaggtcgacgggcacgacccgggcggccttggccgccgccttgcccttgccgcccgggcggaccctgaggcggcggtcgacgagcaccaggccgcggcgcgcggcgggcgggagcgacccgagcgcgggcgaggggagcgggtcgatgtcgtcgggcaggtccgccgggaggcggtcggagacgagggagatggacgggaacggcgagcgcgggaggcggagggtgtgctcgaagcggcgggcgggggcgcgcttgagggtgacgaggaggtagatgggctccggcgccggggtggggtggtgctggagccaccggaggagcgccgccaccgcgcgggccacgtcctcgcggcgtacgcggctggccggggcggactccatcgatggcggcggcggcggcggcgggagtttgggaattgggagtggtcgactcgcgggggtttagggtttgtatccactacgcttgttggacccgaagtgggtttggtcctggttgaaccggaccaggaagccggttgggcggctcggatgtgagccacggctggagtgatcggctcggctcggctcagccggtgctgagggaccatggtccatggagcaaacacaacacatcattgacacacaactataccaacgttctatctcctttgatgtcatgacatcaaataaacaaaccaaaccatatcttggccagtatgtcatcaatctggtcacgccataaatctcaaggggttcaagtcttcaagacatggctagatagatatatatcaaacctttctacggagtatttgtatggtcataagtgtcatgatggtccaaaagaggcaaagatgatgttactatgatcaatgaggtctactctaatttgtttgttccccggaggatggttacatgcctttgttgagacaattattccatttgaaaacttcacaataaactcacttggtaattactccctttaatttgaaggaaccctatagttttcacttcaacatcatattacacttgctagtaataaaatgtggtaccggtaactatcgagaaccacaaactaattataggtgcatactttctatttgcgcatctccctgtcctcaaaacaatgaggtccacatatactcagacacgctaatcaaaccacccgaaccaccttttatcactgtgtattcacaacctataaaaacacacttcacggtcggacagttttccttaaccaatcatcattccctcatcccattaaatttgctcaaataattaaatatgacaggcatgggttcttccatcggccgtgccaccattttctactgcgttgctctatccataattgccggcgccgcagcgacacaggtgccccccaccgaagcagagtccgtagaaggtagtagcacatgcctctcctgcaaaaattactgatcagctaactaatgcgttcattttttttggtacacgtactgatcacggcacgcgcttgtggctgcacgtatgcatatcccagcggcagagcttgcgtcctctgccttcaaggccgacacgttgccctcagcctcccgcaagctgatggccgttagtgacgtgccgctaggtaatggcaccttgttgtgttgttgtacgtacatgtgattatagcttggcggtatatcgtctgacatgcgcgagtgtggcgtggtgtgtggttggcagcgccggtgtgcccggtgcggttcgacaagatgaaggggcccgccatcgagctgggaaagaagtgcaagacgacaggggtgaaggtgtgctgtgaggcgttcaagacattcgcatgcccgcacaacaagctgatcaatgacgtcaacaacggatgcgcggacgaaatgttctacaccatccacacctacggccaattgctgccgggaaccatcttcaagaaatgcctcgagggaccgcatgggatgaagtgttgaattcgatcgtgctgattcgacttgctcgatcgatatcgctccgttgttgctagcctccggcctgatctatactacctataacgatgaatgtccctttcgtcatcttgcaatgtaactaaacttacttttattacttcgaaatgcaatgaaccacaaaaggtttattacaattttctcctaggatattggttgaacataaaatgttaaccataaacacaacatttaaaagtgtgatgaagagggcgagcgtttaaaagttgcatgtcgtaatcttgaggcaatggttatacaactgtttaccaattttggatggagattcacaaacagaattcaataattgtgtactccttatcttgggttggtaggtgtcttctttttcatgtgagaaactttttgttttgtgtgttactctgtaataattggctgtaactcgttgagcaaaggccgggatattctattccattatctaaaaaaaaccataaacccaacatatcaatgcaatctctgtatatctaattgttataagggatcgtgacgctttgagagttgtacaacaacccaaacacttttttcccttcctttcccttcctcatcttgcatgtcgccgttttcatgcgttcgtgaatgctccttcgcctcctatggtggcagtgccaacctcatctcgactagcaccctcagctaacctcctccatttcccttctcccctctcttccccaaggcggtggcatcgagtgcccccaccatgccatcttcgttgaatgaggatgcaaccatcacatagaataaggagcaccttctcctcgtgctcaacacagttgtgcatgacgtcttttacttgggtgcatcacctcatctatggatgtattgtacagaaacgttatcatgccgacactgccataagatcgacaaacaccttaataactcaatgaaagtactcaattaatataaacatgcatgtacggcaaatagacaaacacataaatagatatatgtcatattttggcaagaaaaccgaccatctatcttcggctcttggctatatgtcatagttttgggcatggcataagttaaatttaaagggttcatcaacacatagctagatgtacctctacagagtatttgtaattttgcatgtcaacgggccatgtgtttcaaatattcaaagaaaaatgctgtgtgctggaaattgtttcttctccgaaggatgtgtgtttgcttttgttgagaacagtataaataatatatgaacaatggtttaaatggttgctatcggtgtaatcactccgcttcatatttcgatgatatacaaactattcattgtaatctgtagtggggattggtacaactaatggttttattctaaatagtttatggaattcacacacacgttctctctaattaaaaaatcacaggggggcatcttctcctagatgttactccctccatctcacttaaccaattttttcaatgttttataataatataaggcgcatatgcatatatgtaatgaaatagcatatttccctccgcttaattttttttaacattctccaccctgaccagtatctgtaatttcattggttacatgtactttatttgttaagatgatacaaaggagaaggtgagaatgtactatttcttgatttttgcattagtagtagttgcgtcttatattttttatatggagggattaattaaagttgtacttgtagcagccaattctttttcttccgtttgaaaactttactacacatgcaggctcagtagtacttatttttagagagggaaatctgtgtggtctgtagtatgtacttcataatgcgagtatgcatgcatgatttgcattagaaatcattgagaattaatctcgcacactaattataggtccagctaagttggccctggtatatatattggccgcaaattaaatcaccacaactcctgccctcaaaataatgaggtccacaaacagacgctaaaccacctcaaccacaatttctcatggtcagtttcactaatcaaccgatcattccccctactctcgtatatatgctctcgtaaaggcacgaacacacatctctagtcctgcagcctgctgggaatcgcaagctaggatgggttcttccaccatccttttctactgcgtcgctctgtccgtggtcgccgccgccgccgtcgtgtcgtccgccgccgaggaggccgaggggccccaagacgaagcaggccgcttcctatcaggtactatagcacatatgagtcctgaaacgttaatttcctagcttttgcaacgtaaaaaatggctagctagctaactccaattatatttttgccatcgtcttttggtatacgatcctcttagcggccaccctggcgtcctccgattccgacgcaaagacgtcgcgcagggcgctgaccagccaagaggagataatcgcaagtaataacacgcacgcataagtgtttgttgtatacgtactgtgtgccggcgatgatatgatcgtcgtacgtcgtctcgatctgacacgcacgcacgcacggtgctgcggcgtggcgtacgtttgtacgtgtgcagagccgtgcccggtggagttcgagcaggtgaaggggttcggagaacttggggccaagtgcaacgacaagcagacgatgaaggagtgctgcgagctgttcaagaagatcgcgtgcccctacaaccatctgctcaacgacatcaccaacgtctgcgcgaacgaattcttctacctcatccacaccaagggcaagctgcagcccggaaccatcttggagaactgcaacgagggccctatggggatcaactgctgaacgcctcgaagtaccgtacgttgatcaatatattcaccatttcttaatttgatgacaaattttactatagtacaccaaaagtttgtgaaatttacttgtggatatcgaaaaaaaagtgtaatggttagaggacaccaaaaagctagtaatttgccggagaatagtttggcacaattggagagacaaattcttcaaaatacgaattaaaacaagcttatgaaactttctcttctcacacacatcacgctggttggagtctgtgaaatacgaattaaaatttatcctgcgcacaagaccccagcaaagtgatagaatgatgtaatcttcagcatagtgatatagaatgatgtaatcttcagcatagagataaaatgatgtaatcttctacatgtaataaggatcaatggatcactggtggtacattggtgcatttgccatgtagtttataggatttttttctctctaaatgattcggaaatcagaacacacacatcatcattcatcagttgagcctcttgatggacacgatgcgaccgagctcctcgcgcaccgacacgagcagcacgaacgcctccgagccctgcacgtccaccatgtgctgcaccgtgccggtcaccgggtcggcgtagcagccgcagccgaccacccgcagcacgccgccgccgtcgggcgcgccgacgacctccgccacctccttctccttcccctccgtcaccgtgagcagcagcggcgccgcgggggagccgcggcgctcgccgtactccacggcccgcaccaccttcccgccgtggagcgccacctccgtctcgtccaccaccgggaacagcctccccccgatctccacgcgctcgcgcgggtcctcgtcctcgtcctccttctcctcctccttcccggcggcggcgacgacgcggtcgtcgtcctcgccgcgcgacaccaccaggtgcaccttcccctcgtgctcgacgacgccgcgcgagacgccgcccagcgcgacgcgccacctcgtcagctgcggtacgtacagggacgacgccatcttgacgctacgcgggcctccggctgcggctgcggcgccgccgtccccgccacacaagaagatcaggaagctagctacggcggcgcacaggatcagcaagagcgatggggaatgcatgagctcctcgctagagccctcctcctcgatatataaaggagcgggatctggatcggagttgctcgatcgtgtgtgaaacgggaccagaggggggttagttcattgttgtaagcgagcgtaagccggtaaaggcaaaaagttaagccggctgggaagcatggggtggcatgaaacggtcgagtactagtagataacacacataccatcggtgatcgcgagccagttcacatccaattaatgttttttttgcttccttttgtcactcataaatgtgtagtactaatgcattcttgccaaattatgtttgtagccaaagtcctcaacttttgcttgtcattcctactgctctctttaattagtttatttagaaatactttagaaaagactactgtgcgagcgagcgcgcgtgaatgtccaattcctatccggattaaagtccccgcgtgaatgtccaatttcgatgtagtacaaactatatatatgatatttataggtatcataatcagacttcgctctaactttcagtgcaaaaacttgtagacttttcttgagatgagattttaaaccacgcccatgagcttgtctcatcccgattcgtttttaactttcaatgttgaagttttgtagtttatagaaactttatttacatagaaacatgtgctgcacagaacatgctcgcaccatgcgaattttcacgcattggacatacctaactaatacgtgttcatgttagaaagttcagccgcgagggaaggatcggagtgatgttaattatgcaaaaaagttcatttacttccctaaactatttcattggatcagttaagcaccctatacttatttttattagtttacactgaaaactactaaaaatattcagctttactttttaatatcatttatatattttttcctctttatatgagttgtaatttaagctaggaatttgagccatagatgacactattgtcaaagttccgaaatatttttaaaaaatttcacaactattgacttgaaatttaaaacctagatatttaaatcaatctcggtgcttccaccctatgtaaacaatgtagaaaacatctaagaaatgttgagagctgagttataatacatctatcaatactgcaaaatttcaatgtaaaatatgacatatatagacaaagaaaaatacctttacgaggtaaggtgaactattttaaatagtttgggatgtaaaaatgagccgataacttgtttagggaattataaatgctctagcgaaatagttcgggagagtaaaataatgattttacttttccaattatacatatgaaccaggtgcggatctctggatttttcatattttggtccttttgaaaaacttatttcgtaaatagacccctgaaaaaacttatcccagaaatggtcctttttggggcgccagagtacgggacagcgccagcctctctggcgccgtcctcctgccaccgtggcacacgcgaaccgacgtggcaggaggtgctggcgccgcccgagggaggagggcgccagcacggctggcgccgcccccccccccccaacccctcacctccattcctgtttctctgtatagagttacaacggtgtcatttttgttttattttttcggatgttttttcacacttaggatcacgatacaaccaaatttaaactcgaactaccacttagctaagtctgaaaatagctagcataccacttagtctactttgcaccttcactaaaattagaccataactcctttagtaaaaccctttgatcagcatgttataaataatgcactctatcactatatgaaattacttaatctaattcaaaatataaccacatgaaataatagccataagttaaacagtacagagagatgcatttttttgatttttatttcatttttttgatattttttcacacttaggagaacataggaaccaaccatatataaaaaataaactcaaacggacaaaatatgttacttgtagaattttccaaaactctatcgaaacggacaaaatatgtcatttattaaaataggcgtaactttctcatacggactcggaatcaggcaaataatatatccacggacatctacagaaaatgttacatccgattctcccctgctttgctgggttcggcgatattaaaacctctaaattccgcttgcaagattgtattttcgaggagagaagtttctcggtagagctttggaaaattccacatgccacatattttgtccgtttgagtttattttttatatggttggttcttgtgatttcctaagtgtgaaaaaaatatcaaaaaaataaaataaaaataaaaaagttacacatctctcctctgcactagttcggagagagaggagaggagaggaaaaattctacaggtcacatattacgtccatttgagttcattttttctatggtgggttcttatgtgtccctaagcgtgaaaaaaatatcaaaaaaataaaagaaaaataaaaaaattcgggggggggcgccagccactctggcgtgctccccctagtcacctcagcatcgccccgccacgtcagcagggggacggcgccagagaggctggcgccgtcctgttggatgacggcgccagccactctagcgccccaaaaagaaccatttctgagataagtttttccaagagtctatttgcgaaataagtttttcaaaaggaccaaaatgtgaaaaattcacgtgcggatctagcccacgtgccaacttggccacgtcccgtggactagggcgaaaaaagcccacagagatatatcttcagccgttcagcgtatgtagtttgaagtgagcccagtatgtgttgggttgccggggcttgatcatggataactcatcgcccctgcttgatacatgcggtgtgcagcgacgcaagtaaaaagaggaggaataagttcacttcgtgaccctcaactgtgatcgaaatctaatccatgaccctaaaccacaaaaccggatatctcgacccccaaactcctaaaaccggtgcaatttgactccctaggtggttttgaagggcagttttgctgacatggcgtcacgtggcgcctacatggtgatattgaccgagtcttcgttccacgtggcgttgacgtggcacttaggtggcattagaattaaaaaatatgtgtgggacccattagtcattcacacataaagaaatatgggccactgacatgtggggcccacatgtcaatcctcttcattcttcctcctccctctctcccttctctctctttctctccctttttccccttcagccggcggcaggcggcgagaacgagcggcgacgacaggatgggcgagggcaggaacggcgagccgtgcagccgcccccgccgctgccatactcctccttccgaggcgtcgcagccgccgccaccctgacacctctccccgccgtcgcagctttcccatgctcgtttgtagtttcaactgcctgagaagagcgccatttatattttttccacgaatatctacatgtatgttcacataagaagacaatctacaagaaacaaataacagatatggtgtaccggcttaaatagactttctacctggtcatataaatactggatctgctgagcttgttgtagaacatgtgttgacagttgacatgagatgattaagtgctgacatctctattatctttgtctctgtttcttggacagcatcaagaagatttgtcaactccacctaagatacgagtgccggcggctggggcagcacgtggagctcgtcggcggcctgctgcgggagctcgagctcgccgagctgatgcggcgggaggccaccaggcggcccctcgagcggctccaaggcgcgctgcggccgtgctgccggcgctcgcggcgcccatccactgacgacgcgtgctcgttctcgctgcccgccgcccgccgttggggaagaaggggagagaaagggagagaagggagagagggaggaggaagaaggaagaggaccccacatgtcagtgggtccacattacttttttgaatgataaatgtgtcccacacatatttttaaattctaatgtcacttaagtgccacgtcaacaccacatggaatgaagattcggtcaatatcgccacgtaggcgccacgtcaacaaaaccattctccaaaacagtcgagggagtcaaattacaccagttttaggagtttgggggtcgaaatatccggttttgtagtttagggtcatggattaaatttcgatcacagttgaggggcatgaagtgaacttattccaaaagaggacgcgcgggcgtacacgatcactcgctctcgccgtgcggcccgttgcccgttggtggtgagcgggtgcctcggcggatgacggaagcgcgcccggagcggagcggtgctgcgttcgggcggagcgcacggaacgacatagcatgccaacgggtgcgcaagggcgcgctcctgatcgtcacgactcacgcgggtcgcggcggggcaggctgccgtgccgacctgccgggccttcttctccagcatctgcctggtggatcgatgcatattgtctctcgaccagaactcttattgctagctgagctggtaataacggtaagataccgtggcagccgatcgatcgatcttctgtgtggaggtacgggccggcggtgtctgatttggggctagtttattttattatcgaaatcaatctgactaatatttgatgttattaaaatttggtatgttttggttctatcgaaagtttggtaacgttagatatgttagtttgaaacccttctaaagtcttgtatttgtttttgtgagagaaaacttttaaattccaaagtttagtaagttaattagagattgtaaaatatattttattttgtaaagtaacataaaaatgatagggttaaaatagtaatgaagtgaaacatcggtttaatttggacctgcgcgacggctgcgcgacgatggcacgatcgagctcatagttgaatggagacagagagcagaagccacctggacgtggtaccggccgaccggtggcttctcggtgtcagcttaactatgaattatgaaatgatgaaatagtttgtccttctgttatcgaaaaaggaatgaaaaaagatacacttattttgtcacgacttatttggacgttagaacgtaacatctccgaactttatcctggacctctactcgaagagatcggtttaattcccgttctttatggattccaagcaagacggaagggtactgtaaaaaaccattttgtacgtcagtaccctcatgtgcagcacacctgtcttcagaaatgattgtccacatatggatatggataggttaattttcagagaccaatttttacgtgccctcatgtgtagtagaccaaattttcaaaatgcatttttagacaggactgtaatattgactactaattatgtcgggttccaaaactaatgattcggtaaccaacatattaaaattgtatcaagctctggatcagtagattgatacaagttcaataatctgtatcgtctttgcatacatttagacatagctttgaaggagatattattacataaagtaatagggtatttacaagattgtggctaactattacagcagaagctttagaatgacctaactctgctgttttactatagacttaaaccatttaaattacctagacttgaagactaagttaaaagggaattaacttgtgtgattgaactcccatcatcaacaagaactccaaaataattctgaaaaaggatgttgaagcaaggatgagtacaacgtactcagcaagctattatatcaaataatgaatgcatgaaatagtatttaagtagatctaggtttactggcagaaagctgagaataaagaggaagaaagcctggtatgtctttatgcaacagtatttagtaaaatcttgagttaagtttctaaccaaatatcatatgagtcccgatactcaattccgtgagcacggctattcgaatagtttcatgaatactctactgcagtagatgtacgctttactcgtagtcgtagcccagccttaggttagtcgtagcccagccttaggttagtcgtactcgatgttgaatactctacttgccaattttcattagcttagtcgtagcccagccttaggttattaacaatagtggcacctgttccatgaactctagtccccatgcgctctgaacgtaacgttatcagcagcgagaggagttcttgcgttcccgaggtttttagagagaactggatgagagaccccacgtcatctcaaccaggtttttacaatatacacacacagcgatcgcaatataatcaagatatttacctgcgcctcggtaaatatcacatttgcccttcgcggcataagtttgcctccttcgcgaggacttagataagaaccactgtacagaggtaccacattgttaattaacctaataactaggtctgtccctattctaaaagctgcggtcatactcgttcgtttgacataagtatttggtggcaattatatcgatagagacagtactagccacccggaaatcaactaattcatgcgtactgtcccaatctaagttcattatatttttatgcagtctaactaggcagggctaagcaaaatctagcatatatctagtttgctatatgttcaagttatgaattcaaaatcatgaatggctaatgcttagaataaagctatagagtataggataattatgctcaaaggagaggaataataacttgccttgctccaacgcaaataaatccaagataggcaacctgattatccgatgctcgaaatactacaggttgccatccagaataaaatagactctattaaagaagaggaagaaccaaattcaataaaagccataaaacaacaagaaagcaatgaaggtgagaaaggctaggtttgaggggtatagctatctccttaatgggttattgagctagtattttatgcgcaggctctaaggagttggaggctaggttggagaggggatcaagcaactgatgtcgcttatatctcatgtgtgggctttggttgaatagtggctagggtttcgatgctgaaatgggataacatatcggctcgtatttcatgtttaaactatgggtagttggagggtaaatagctggtatggagtttggatagcaggctggctagggtttcatttgattaagccaatatcgaggtaggatgaatatcggctgagatttgggtgtttgctagtcgtcattagaattgggtagtatgacgactaggtttggtgtctagccgatgtcaacagacaatataacggctagagggataggaagtttgtgtaggtttagtggggcggatgtgttactccgacaaccgtgagtggcggcggagcggctaggatcacacagagtctgagagctaactgtgcggcgtgctgtggaggtcgagagaatagtgaagctccgactgctgtacgcatcgaggcgtggggtgccaggagcagcacttcgaccttaggtttaggttttgccgggctttacaaccaacggttcgacgtcggggatagtaaaccgcgagcgtccccatggaaagcgtaaagttccaactggtggctttttagtggctaaagggtattttggaaataaacggaaatattcgaaaagcaaatataagtttaaattgtaaattcaattataagattatatcaaatatttattcaaatggtatttgaataaattaaggaaattcaaatgaaatattaaaatagcaaatttggtgtcaaaaggtagggtttgaatttagatgaatttaggtccaagtttcatcggaatcggatctacggtttaggagatatgggcttctaaagattgggatttgaattaaatctagaaaatatgaaaagttactgtgcgggggcccacctgtcagtatcttatcttatttttctttttcttttctccttcttcttccttcttctcgtcttcctcttctctgttccagagagagccgagagaagagagaggagaaggggagcggggtggcggcgctccggtggctggagggcggcgacgtcggaggccacgcgtgttcccgagcgtcgcgtatccggggaaggcagtagctggcggagagggagagggaggaggccggaacggcgacggcaggagcttgaccatagcaataaaaggagtggcggtggtggcttgctgtggtggctaaaagataggggaaaaggggaaaaatgagttcacctcgtcgaggcaaacacgatggcgcaagggcttggcttgtagagctgtggaagaggagatcggccagtggcaaggtggtggtcggcatgggaggagagagaaagctcggtttgatttgggaaaaggaaggggtgttgccggtttatttataggagggggaggtcggtttggaggaggagggcaagagggtcacgacgacggcagtggcgtgcaaggaaggacaacggcggccggctttagtttcttagcggcgacggaaggcttggcggcggcgtgcgcgtgcacggcacgcgcgcttgcgggaggaggaggggcggctcagctatgggccgacttgggccgcgcgagggagaagaagaattcggcccaaagttaaaaaggaggaagtctaattttcctagagattcaaataatagatttagaggaatttggatggctagattttgaaaaaggatttgaataatttgaatttgaaggaaaattgactgagagagagtttagaaggaaattatattttaatataatttccaaaagaaatatttctctagttggtttgagtgcaatattttggagagggagtttatttaatgcactcaaatagaaattcaaaatattcaacaccataaataatatttctctagatttgaatatttttgagtatgtggagggaatatgtagggagtagagtaaatagaattttagcccaaaatatgtggtatgaaatttagagaattagatatgggctaaatgaggttttggatttgggacggagggataaagtctattctcttagcacaagagcaattactcacaatatttgtaataatattattcgtgtgccgagaagaaaatcaagctacagaaattaaattggtggaatttagatatttggatcaagaatcaaaggatgggtttaagatcaaaggatgggataacaattaattccaataaaattggaagtggaaaggatttggtttggaagattttcttggaccataattcgaaagggttttaaatagaagaaattttagtcgaaagaaagttttagataaaaaccaaatcaaggaatatttcgagataaaattttaaatgagaatcacaaaggcttttgaatatcaaagggggatttttatgcaggttagctttaggaggtctcactaattatattttcctaagtttaaagaggttattaagaatataagacccggcatgatgcaaaattagaaaatagctaatttttggtatgttacaaattaataggacaaactaatacggaaaaaaattgattgcacaggttagaacagaagtgtcattatgttttgtttctattgatccttcctttttatttaacttacgatgtcgagcatcactgggcatgaacgtacaaagttcaagtcgtcgctgcagtcttttctagttcttgttctaggctgtacttttaaaattttaaggttccattatatatttatatgtttcatagtaggttttctaattcttagatacagtatagctcaggggcaattgcttaaccgtatgtgaagagcagcattttaaaagcaattggtctaaacgttttgtgtacatgtcaattaccattggcaattcttctcttcagccttcacgtccaggcaaaataactgaggagaagcgagtgcgactattgcccgttactactcctcagaagacagagtcaggtagtctgctatagcgatcaacgcgcgcgcgtcgtcgtcgtcgccacgtcgcacaacttccttgtccttcgacgaccgactacgccggccgtgcgagactgcgcggcacgaattgagtccgcgcacgcgcgcctcctttgtttgtttgatgtcgaaccgtgtaaatcatcgtaccaacatatcctaataccctatttattcggtctacgggtatacccgttgacagttgatgtggcgagtagtatttcaaagtgacaattattttgagataacttttgaatgctataaagacaaatattgtagaacggaggaagtaataaaagaacatgtgatgagacaaaatgtgtgggtgaacgaataaaatagtataaaagttagtaggtggaagaataaattaggcatggtttagtttccaattttttcttcaaactttcaatttttccatcacatcgatcaaaattttccttcacacataaacttccaacttttttcttcaaacttttaattttagtcaaacttctaattttggtgtggaactagacacagctttaatataaaagtagataatagagaaataaattagtataaaagttggtaggtggagaatatcgtagtactaagaaatcctaaaactccttatattttgggatgaaattgatggagaaaaattcctttacattcacggacgaagggattactccctcctctttcctgtttaaattcatagaacatgtatcacatatatttaaaatcttgtatattttggaacgagaggtgaacgttcatagcgaacactacctaccgctaccgctacgatgtaacagttttaatgtagtatcttgaaacttaacgtccgctatttagacttaacagatagcggatacaattcaatttagcggatcaccatatcctgagcctattttatataaccacgaacccataacaaataacgagtttgttagtgttttgtctcccaaaactttgtattcttgtgaatcttaacatctaataagtaggatattatgtttgttgtttaatttgatttaagttgaaacaagacatcaactcttcgagtgctactaaatatctagtattctcatagcttatacgtgtattgatctatcactaatttgtttatcagttattttgttattgttttataatattattatctatgatatgaactcttaaatatatgtgataattaaatgccgctattgattaagctcgcgatccgcgatcgactatatagacaccaattgatcattaccacctgctatattctattattacctttccggtactgtctctcggcttgaaatgtcgcgcgcgtgcggaggcgtgcgccaagatcacgggtgatgacgatggcatcgatcgtcgaagctgcctcttgactgcgggtgagcgtgcagcttatactgaagcgcggtagatcgcaccaacatttcagcaatgcaacgccaagagttgccgtgcgaagcacagacttcgatttggcgtacgtacgagcaactactagcggctacagttactagataggatcggaacttcgttttctcgtgacaaagctaacccccacgcttgttcgttcaattagtttccagataaattgaaaaatctatactccaaagacgtttgcattgagcagcaaccgtgtactagttcactgacccaacgacaacgacgatgacgacgctgatatccgccgaaccacccggcaaccccaaccccaaccaccccggtcgattgggacacacgtagaatcaccgcttgttaccgcgctggataacgtggaggcacgtacgccagccccagcgggcacaccacggcgtcaaatctcggtgtagtactactactcagcatcagctcatcatgacctgatcgtggccatcggattacttatatttaattaattgctcgacagatgtaatatccatcggaaagcaacgtgcagctgcagtgacacgccgtcaaacgaccgaagtccactacaaaacatacagatcggtggcggtgtaacctggttaccaggatgatagtggagcgcatgcttgtcagttgtcaccatgactttgtcctttttcctttcaagaaagctgagggacggttcgccattgattaataccgttcattcaaaaaaaaacaataatgacatatattgtacgtagtttcattacatgtattgtaatcatatccgattaattatatatccacccatcaaacaaacgagaaaattaaaaacgttgaaatgaagtgcgttcatttatgtatatccatctggcaactgcaattatattttttttctcgagtatacaagccagacacactagcacgcgcacaccacacactcacacatccatctatatatatagttgtacatatcctagcacaagtctagctaaagagattaaaggccggcgaatacccatgtaagtttaggtctagtttgaattcggataaacatattctaacacaaggtttgatgaattaacttaactatcaaaatccaataaattaatgaaacatacaagtgactactacaatactacttactgcctcacgttccacaatattagaatttccaagttgttaagcaaaaaccatggtaaagggaagagacgattatcttttagtcactttgatcagtggtcaaattttaaatcacttatattctctttccaaacatctcaaattgattagccaaaaatgtataaattaaattttcgtatattgaaatcagtgctccatagctgttcatatggtaatacacaaattttgcgtcctataaatacttatagtttagaacggatagggcatgctaattaagatctcttaaatataagttcgaaggagattaactaaagtcaaaactcattagagtgatacaacatccgtcgtcacaaagtgtcagcaatgttaggtgcgttcgaatgtgatgtttgactgggatttttcgtgatacgtaaaacaagacaaaccatttattattataaacttaattaattgagtattaattattataaatttttagttttttctaagaaactattttaaaaaacacaccacttaattagtactagtttggaaaacatgctaacggttaatgaagagtatacgaatctaaactcactttataactccatcttacccaacttaattagagcaaggataataatagagctcacttcctactattagctaatcttaaagccaacacgtataataaattagctataagtttggctacaattttcttctcatctcgatatgtctcacttatatattattaattgtatttgtcttgaagcttgtgttaagctagctcttgcatgagagccaacacccttaactttttgttatatctctcctccatataagcttatagtaggtttatagctcactattatacttgctcttatgaaggacaggggaatgataaatagggtgtgagctgaaaaggcatatctatttgggttatggtttcccctagttgaaacaactaaaatataagtactttggttaaactcaatccaagtgattgaggcctgaagaacgacattcagggtgcagttataattttttttccctatctccctgtctataaagcagctttactttaggatcggactagtaataatcaactttagagctcagtgtatatatctccaaaacatgacgacgtcaaaactatatgtgttgatgtctttgtcgtagttgttctcactcttccaagtgagagtccttgcaatgtgcaactccgtttttatgtcagatatgatggaaaagacatgcctttaccttaaataaatctccgcaaatgtaacacgatgatgggcaagtccaacaacaaatttcagctttcccctatcacttggttaggtcaatagaagcttctagaccagatcgcctctatgtgaaactatggtgaatttggtttacttttgctaatacattgcataaggattatcatgcaagtgctgtgtaaatacattacattctattccattatctaaaagaatgcatcgcatttcttttcttcttcgtacttcacacgaaaacaaggattcttggatgaaatattctggttgctctcgaagttactcgccgtcataggctccagcttataaatttatggattattcctgccacaaactttaaattatgatttttctatatatattctgcattaatataatattgcttagataacttgttctaaaatacttttatgtttataatatgtaatatttaattaatccttataagcattaattatccatatatccaatcatttataaagaacaaaaaccataatcaaatgctgagagatatatatcatatttttcgtataaaacttattacctctagataagtacctcgagattctaaaatttgtgtgtaaaattttagtacctacaaatattttctcaaacgtaaaatttgtcattttctaaacattataattcagaactatttgactacatatatgcaccaagaggtttcttattccaagtatatacatgttgaattgtgcgtgtgcatataaaagtttgtgtacattcttgaccatatgaatacttcttacctttcaaatcaatatattgaacgcaaaaacggaaaaacctaacaattttatttcctaaaaaatacagtagtcaagcagctgctatagtcagcaaatatagttagctactttcatcgctcacataactcatcaatagattatacacaaagttatctcctcaatagaccgaggatatagatcatactgttgtcagttgacaaggttggcagccactcttttctcatttaggagtatatgtaagattagtcttgcctaacattctccagtcatacgcattccaattaatattgtgtcttactccctccgttccgtaaaaacaaatatagtacgtgatatataactttgtagtattacgaaatattaggagcaatcgtttctattttggcttgtaattagagggcgtttaattagctactcaaaaaaaatactccatttgttttaaaaaaacaaatatagtagcttgatttataatttacaaggatcgaaattaaggagcaatggtttctattttgacttgtaaccaaaggacgtttaattggtcataaaaaatactcgagatataacctattttattaccgtgaatttagacagagatagaaaaaccattgctccttcttatccttgtaataaatcaaactataaatgaacccaatcccttaacaacatgtagtaccatcataaatatatcattataatcatggaatgacggaatatgttagtacataatcttaatagccaacatttactgagccatctttatgtcatatagtacactaatcatctactaaagaaaagaagaacaataattattgctattttaattccttacaatatttttggccaccgattgaaagtgtgtttatttgacccattttgtcatcctaaattagtttggtagtcacagtcttcaatcaacccgagttataattccttgtcctctcctccaccgtaacccgaacagctcttcttgtcaaggttaacaaaaccgtatgattatcgtacgttatagtggttatcacgtacggtaatcttttcaactttttaaaaatacggtataccacgctgtaagcctgtaacgtcgtcccaaacaatttggcgaagctaggtgaggtgacgctaaaccccgcttcttgccgacctgagagtcggagagtctcggcacgacacgacgagaacgatctgataaacactcgaccgcaacgtccccacacgaaaaacgtccagggtcgggtggggtgaaccgtgtccacccaccaaactccaccagtccacccccatccatccctgactgtccgactccgagcccatcgcttgcggtcgccatcccaccaaccacccccctcgccccacgcggcccccacccgtcgccttctccaacgaacgacgccacacggggtggaagaaaacccgaaaaataggaggaaaccgacgggggaaagccgcaaaaaaaaaaaaagttgagagaaaaccagagtgagctgcgcagctcatgacacatgatggtgagctacgcctacgcgagctcggagctcagctctaccgcccccgcacgccgccgccgcccgtcgcctataaaagccgctccacccccaacgagcccaccagctgctctccaccaagagctgctccgcccccctaccccgcaacccgttgctttgtgccgcgcctcgctttggtcttcatccgcctcagatctgattcgttctaggttggtctggtgagtggtgcttggcgtttttgttttttgttttttttttgttttcgtgtgtgaggggattgggatgctcacgaggtgtttggtggtatgcgtgggcggcggcggcggcggtggcaggggaagatggcgatcacggtgaggcggtcgacgatggtgcggccggcgtgggagacgccgcgggtgcggctgtggaactcgaacctcgacctcgtggtgccgcggttccacaccccaagcgtctacttctaccgccggggccccgagggagggggcgcgccggaggggttcttcgacggggagcggatgcggcgcgcgctggcggaggcgctcgtgccgttctacccgatggccgggcggctcgcgcgcgacgaggacgggagggtcgagatcgactgcaacggggaaggggtgctcttcgtcgaggccgacgcgcccgacgcctccgtcgatgactacggcgacttcgcgcccaccatggagctcaagcgcctcatccctgccgttgattacaccgacgacatctcctccttctcgctcctcgtgctccaggtgagctccaaatttctagtagcaagtacagttagatccaagcacaaaatcaaacgaggttagagatagctttctggaagtggagcgcaaacaatgctttgcaactgcagctgacaactaagtttggcagtaagccattaattataacattttggggctgattgtatagctaggtcccatgttggctgttgcactaaatgtttggggctgagcttagcgggtcacctactctttggttggctttaattagctgcatcagatgtacggttccatccaggcagttgatgtctttctgttgtgggcggggtctatttttggtttgatgtttatgcttattgtgatagtttagtaggggttgtgtaggaattatagaattttaaaacaccataattcaatgccaataatcagtatccactaaaaaaatgaagtatatgcttcaccttgactgtgtcaaagcctagacaattttgatttgtccagagtgattgtatcatatagatttgaaatgtgtttttcacgttggactccacattgtcttctatgttataccatctaaaagtggcagcagcgtgcatcaatttgtgcattaagagtaacagacaacaaaagccaccggtcgtgcgggtacatccctgccaagcttgagaaactaatactagaggactactttattaagtagccctttaatttgctccggtatatccctatatcctgtcctgaactactacacttatggattcatgacctacagatatttgaaccgagaagcttatcccatttggagctttttaacattggatttgcacgtttaaccctgctagcctttgttgaatacttaaaactttgtggcgatgactatatatattgctttgatcacttaagcataagtgccgatcattccatgtcattccatgttactgctgatatttaagtgttttgatgccagaagtaatggttagattgcattaaaacttgttattagatgggaacaattttagtaggcactaatgttttcttctagggcctctatagctcccatatatggttgattggtcaatctcattgttccaaaatgtcaaccatttgccccatgatgtagacaggaggggacttaattgggtgtgatattaacattttgtgatagttagtctttgactgacaatagctttcttttgcctgttcgataactggagcccttgtcctgtagagcctcatgagctgtttatcctttgatggatacatcattcaggttgcacgttcaattttgtcctaaatgaaacatgtctgatctgctcaccttctggttatccatcatcagctgccctttcatgctggaattcttgtacaataaatcaattaggttgaatgaatcattagtcttacgtgagacatacttgactttgaaataatatggtacagtgtacaacacaacgtgttaatggaaagaatttatttgcttgtaagtctagtagaccttaggagctaaaattttatttagaaaattgttctaataattgaggcacatgctaatactttttccttgcaactgaaaatttgtgcatgcactttccataacataaaactgggccaaaatttacaaggttacaaaccatagtttcattcaatttttttactcgctgatatgtcagcaaccatgactctgagtagtcttggtgcactgcatgttggttggtatggatctgagtgttaactggagcatgttccatctgacaagtttttgcttataataagttaatagatagtactgttttgcgccatattgttccaattttagaagttatttaaaccttgatttcctctcttttatcaactctagttgttgctaacttgttgtaacacctgtttagatggcaagctgacttcaattgtggtgtgcatgcatcaaccttcttttttttgtgggttgggttgaccatggaatgttgcatcctgagctagacaagccatttgcatgtagtccttctctgttagttgccaataaaatgtcttgcagctgtggcaaaggtacttttgcattgcttggtagagtgcttgtcaattgttggatcctaacaccttgttaatgtggatctgaggcctgcgaatatcatgcatcccaaccccaaaaaattgtagagaaaattatgttactctttatctagtgcacaattggagcatctcttgtcatctgtagttgattccttctatgttcatcagaaacttggtgtattgcctgtcttaatggctcttcctagtaaaagcctctaagatcctgtccttgcgatattatattcggtgatgcacttgcagcacatatactcagatcttgcatgtgcatatgttttaaaattcacatatgtaaagcatcatcgaacatttcttgagtggccataaattctaccatgccatagcagtcactgtcaaacacacaatgctatgcattcatgtccatggacaattcagctatttcatgcatcagcatatgtctgttttcattctagaatcactttgccatctcatcttctggttcgtggccttgattttagttgtgttagttttatttattttgttatccgtagcctcattggttagctgattatgctagaaaaaaaactatatcaacatgataccatattggtgattcaacacttaactgatgtgacatagaccaactttcaatgccccctaccatatatgtatttggtctaccattaatagtaagcacgacagtagtcaaaggaccaaacttatcagtaagggagatcacacatgttcctataacaaagcggaatctaatatgcatgcatatagtattatccaattattactatcatgttgtcttgcaatttcatttagtcatcaatacacattgtttacctcatgaactatgtccgtatttgtgattaggtttaaacaattctggctcacatttattaattataaaattgcatgcctgcatgtttcatgttaattaatgataaggcatagtacatgcttgcgctagtttttgtatcacttgtactcttgtttgaaaatttttttttggctgatggcagattctatggcacattttttatggtagaatcagaaatcgggaatttgatggaggatgttgtcatttgtatgcattattacatgacaaaagtttgtatagaagcacaaatttgagtttatatgtttatggttgcagtcaacaattttggtggcaatgcttatgtcttgcatcctaagtcttggaaattcaattagaaatccagtacccagtatagtatggaactgagtttcagttcaacaatataacttgcagatttttgaagagttgtgtcagtacatagttaatttctgacatccagaatgtttatgcctattggtgtaagcaacttctatctgtgtcattcatgtactatctatctcaatacttgtaatgttgctataatggtatatgcagttgaaaatatgaattatatttatcttagtaagtgaaacatttcaagacactgattctccttggttttgttattttgttccaggtgacctacttcaagtgcggaggtgtctcccttggagttggtatgcaacaccatgtggcggatggcatgtccggtttgcactttattaactcatggtctgacctctgccgaggaactcaaattgccatcatgcccttcattgaccgcactctcctacgagcccgagatccaccaactccatcatacccacatgttgagtaccagcctgccccagccatgctgtcctccgtaccccagtctgttactgctaataagacaacaccacctccaactgctgtggacattttcaagcttacccgctcagaccttggtcgactgcgttcgcagctcccatcaggagaaggtgcaccacgtttcagcacatatgcagttcttgctgcacatgtctggcgatgcgtatctcttgcacgtggcctgccttctgaacagcccactaagctgtattgtgccactgatgggcgacaacggttgcagcctccacttccagaaggttactttgggaatgtcattttcaccgccactccacttgctgaggcaggcaaggtgaccagtgggctggcagatggagcagcagtcatccaagaggcgctagataggatgaacgatagctactgccgctcagcattggactacctggagctgcagcctgatttatcagcattggtccgtggagcacacactttccggtgtccgaacctcgggctcaccagctgggtgcgcttgccaattcatgatgcagattttggatggggaagaccagtgttcatgggtcctggtggcatcgcctatgaagggctggcgtttgtcctcccaagcgcgaacaaggatggtagcctatccatagccatctcattgcaggctgagcacatggagaagttcaggaagctgatcttcgaggtgtaagcagactacttatgttatgtcagggagaagttgtagagctagagttctcaggtaaaataccttcaagtgagtcatgggggctatgctcttgctcctgttgagcaaattgtctggccacgttctcttgtaccttagcttgcaaggatatttggccatcaccacagccgtgtgacgatgtgagcaaccaataatgagctgtttttttgttttcgtttaggataggaatcaacaatgaagaaaaggtgctgtattctgtgaaactacatggcagtgttgttcttaccaaaaatacatgacaagtgaattgggtcaagttattgcctgttgtagctcaagtcgatagatgaacatcattgtacagtacgaatgtacgatacgactataacagcctgattgcctatgaactgcaagtaaatgcatgtgaataactgaatatgtgatcgtgactgatatttgttgcttgattgcctccatcaaacgtatatgtgatcttgactgatattcgttgcttgattgcttccatcaaagctgcattcctggtgtttttcgttgcaaccactccttgccatggatatccaggcttgtttatttgcaggcctcgcccatggcggcgattcatgtcctctctctcacacgcatactacatgttctctgaccttttgttccaaagagaggaaaaaaacagcggagaagcatccgttccgtttctagtgtttgggtgggggtaggcctactgcgactgccatgtgggacacacacgacaaggcgacccccacatcctccatgccgttcaaaacttcgcgacacgaagcccgaggagcagggggtttcgtcctccttcgccgcctccgcctccccccccnnnnnaggccacctccctcactcaccgcctctccccccactccccctctcgatacacgatcaggcgacacgccgtcccctccttccttaccccgcgtagcctagtggcttctcatcgccaccgccgccgccatgccgtccgcgccccgctctccgcgatttcaaacgttcctcgtccggtgcgccgccgacggggcggcggacgtgggatgctgcctcaacggtcaaccctgcggattgccggtgctgggccgccgtgggcggcgccgttgcgcgctggcctcccgcggccgcggcctcggaggctctccctgataccccgcgctcctccgacgcacccgtgtgctgcggccctcgtgcgctgcttcaagtgtgaaatcggtgagcacatcataactccccaaatcgcatttcagatgaactcgagaggaaaatttcaacattatttaaattcgttgcctgattacgccggcttctcgatgggaatttttgcagatacatttgcgtgtgccaccccttcttgctagacgtttcctagtgttattgctactagtagattcaagtgagatcaatcgccataattgctcatttattcaactcaaatgtgaaaatgctgaaagtctatttaacaccaaaaataataatcttagaaaaaaacaaactcgagatattttctcgtgcttctagagtattcctccagaaataaattaaaaaatacggagaaaattaaccttggatggggaatgaggtacagctagcacagtgaaaaagaaggctaggttgtgcagtgcaggctacagtgaacttagatatgcgtacgtgcatcaagccaacgtgacaaagcccatctgaatatgctcctattctttctatgcttagttacgtcatcaagctattaattgcgcctaccaccgaaagactaaccagggggtttagcaattaaccagggggtttagctattaattgcgcctaccaccgaatatgcacatattctttctaagagtatgtacaatagcatgctataagccggctgtaaccatatatcgagaagaaaaaagaagagagataaaaaagcgagctacagatttgtagccggctgcaacacggactttaagatgttatgtgtgtatgagaggtgggaccgtgtattaatggtgcagtatatttttatagttaactattgtataaatagactattagattggctatagatattttggagccagtagttggctatatattgacctcgctcttaaccccctacgaatccttcttgtttcttgagattttgttcgtgcactgctgcattggattctgtagttaccagtaacaaacttcctaatgtggtcaggttaaacccctcgcgaaaggcgcgggcggggggcttgtccggacgcgcgcgagccgagccggagccgaagccgttgctggtccgagccgagccgagccgagccgagcgaggcgtggggggtggttggtgttggtggtgacgcccgggtagtataagtgaaggccccctcagttgcatggaaggcgaccgcttgcgctaaggccaaaggtgaggagatctctccctctccctctctctctctctctcctcccatctctccctctcctctgaatttttgttcgtttgcttccaccgatcagaagcctctcttcctcgcgggggaacctgtgaattctcgatctatcgcctctcttcgtgcttcgatttcgctgtgcttgatctcgctctctcgctcgctcttgcggccgcgcgtctgtgttctactggtgttggtaacgtcgatcgctcgctcgctcgctgctggtgtttctcgtcatcgtgcggtggggggtgcgtgcgtgcgtgctactggtttggtaagcccgctccgttcttgtcgtcgtgtgtgttcttgcgtgcttctgaccttctgttgctgatgctgacgatggttttcttctcgggttttggtgccgttggttttgctgctactggtggtggttttcgtggatgggatgaactgaagttgccggaggcggacgagcaccgcgattccatggtgatctccgttcgcctccgtgtttgcaactcccacgggttttgctcgttccaccgtcggatcgaagcgtcctcttgtcgttctcgtctactagatcccttcggtgtacggtgcaagagcttcgtctctcttttttaggcccttcagtctccaaaaagttcgtgagatttttacccttcttagatcttctggtgttcgcgtgttcattatcgttgcttttttggctgctgtttcagtcgtgatcggtggttttcttggaggaggctgcatccgagtcttctcggaattaactcggtgattttttgttcttcccaccatctgttcctggatgcatctctttctttttttcttttttttttacggtgctacacagatgcgcaatggcaacacgagggtggctgcttcgtctcgatctctcgcttgtttccatttgaaactattttctgttccggaatgttcgagatcgccatttcttcatgtgggtttagggttttagaacgtgtaggcttgtaacatcctttcctatcgttgggcttctgctgcgattgctggtcttgttgggcgagcggaaactggatgtctctgcccgtgctttttacctgttatttggtttaattttctgctttttatatgccaaatcttcattaggattcccttcttgctgaccgagttattttttttcctgcaagatcgacgcgttctgtttattaagcgtattaacacttttccattttgttgccagtttccgggggttgtgcactactgcagtgttacattgttcggcagttcgtttttggtaaacatctatccatccttagaccatagtagaactgaaatttgggaccgcagagttttctccccctcgtttattcttgttcttgaatgctagattcgagaatctatgattatacttccttttaatcaattccctaaattagtcgttaccatatgttttgattatacttcctcgagtgaatttcttcattcttcagattgtctggtttattcttgcaagatgattgtaatcttgtctactttttgtatgatgcagttgtgtttgttttcacttccctctgttggaatgcactgataaaatttactattatgctgtgctaaatttctatgtattttttactgtatcatcatagttcaccttaggtctaactttcatgctagatcttgggttcaaaatgatggcatttgtgtatcttgaagattataaatgcaagatataaaaagaagaaaaaaaaatcctggaatgcatccgtgggacctgtgtctaccaaaaaattgctttgtatggactgctttagagtcatgagtcatctttgcttgctcgctcatcaacaatatgtgtccaaaatattggagttatgctttgagctttgcaaacagtggcataccgcgtatctattttttgtttctgcaaaatgcagttcaaattcaagctagttaacctttctattcattctgccccaataattcctattcgtattttcaccgttacttctagtatttaggtgatctgtaacctgatcttagtatggaatttaaggatattttattcctattattatgtttcagcgaagcagactccgctatggctcaacctcaacgtcccctccaagttcctgacataacaaagtctactcattctggagggaacactgtacttgcttatgcttcatcagctatgcaaggataccgtagcaccatggaagatgccgtgagtaaccttccagtcttttgtaggagaaatggggggttggcttgcaactaattttggtgaaattctaaaggctaatttgtgtactcttctattctccagcatgcgactattgaaaatcttgatgctctcactaacacgtcattctttggtgtttatgatggccatggaggtttgatcttcaatctcatccccatataaacagcaaaattcaaatttattgtactgattgaggggatactcccttctcattgtatagggcatattttctttaggcatgctcattcttctttaaagctacactttcaactttgatgtctcacataatatattgttcatagctacaaaaccaatatgacgagaaagcactttgactaattgttggtcaaaacctacaaagtttgacttcttgaaaagtatgctcaccctacatagtacataatgtggggggaggactaggctagtaaaatttataatatccatgtacatgcaaccttcattgcactcaagagtaatgttgcgcaatggttatgtaagatgagtatctcaattatttaacttctatttcaggttctgctgtagcaaggtattgcgcaaatcacttgcacaataaggttttggagcaagaagattttagcagtaaccttgctaatgcattgaggcaatcctttttcaggttgtttttacagctagttaatccattaactctatattttgatgccacatgagttctttttataagaatgtaagaaacaaccatcgccacattggtgttcattattgcacctgttgtgcatccaaatataaaatatgtaatcctttttcctccttaattgttgcagaatggatgagatgttgagaaatcaggcggcaagcaaggaattaactgagtatggtagtggcaacgagtattggagaacagctgggcggtcttggctcagatgtgctccttgtgtgctggtaatatctcaattgttctgtagatcgagaatctaaggtttttatatttttgttatttacttcaagttggtttttgttttccagggacctgtctattgtggaccattagcagaaggatgtacagcatgtgtggttctcattagaaatacgcagatcgttgttggaaatgctggtgatgctcgttgtgtaatctcaaggaatggtcaggtgcagtgactacttttgttttcaaatgcctagctggtatttcctttttcataatggatgatgcactctaatgtcacctaactattctgtttatttctgttgtattcgaaggcaatcgctttatccaatgatcacaaaccaaattttccggaggaaactcagagaatagtagctgcaggaggttccgtatctttttctaggggttcccaccgtgttaataatggaattgcagtatcaagagcaatcggtatagcttatatgtttgttggcggtgtgaggtcatacacaaacaatttaatgtgttgtaactggtattcttcttctttatacaggggatttatcttacaagaacaacaaaaagttgcgtcctgaacaacaattgctgacttgttctcctgaaattcgagctgtaaggataactacgttgtgttattgaagttaagtttgtcccactggatatgagctgatgcaaaatgatccccttttgtctctggcaggaccaattaactgatgataccgagtttcttgttatagcatgtgatggagtctggtaagtcctcagctaaaagtatcagaaacagttcttatatttttctcccatgttcatgatttcttgcagaatataggaactccaaatgacaattctctctcgtacgcttatttgtttgttcaaaatatttaccgacaaaatttgcagattttgttcagctcagtttgatttactgactaggctactttaccaccatgtacataaagtcattttgtacagttgttgaaccggtgggtctaattcctttcgttagtttagtgtgatgatagcattggagaggtcaaatgtctgcacctccctatatatgggttcggatgctttattgtgtccagatgactattaacttggtggcatgaatttcagtttcacctgttcagttcgatggaaatgaccatcgaatatatctaatttatatcataaggactaaacttgaagttcctggatgaggaaattatttatgaaacctgatggagtggtgataggaatttcaccctgcctgaccattactctttgacacaattaatgtaacttgcagctgtttgctctatatttacatattttttttggttttgtagggatgtcttggcaaaccaggctgtggttgattttgtacgccttcacttaaacaatgtgagtgacattccccgccccctctccagtgatacactgtaacagtaaccttgctaccagatgaggaaaatttatccgtgtgcagattatgcctgtagaaatgtcttcatactgagaattataattttgtccagcatatcttgccctgaatgtagctctgacatttagcacagactatcctctaaatgggatggtgcctggcctagttaaataattttctgtcggattgccgtttgtatagtctaaaaatggaagcgtgtgcaccatgttttgcaccttgtccatttacagttatatgttgttattccttttgccttgacatatatgtatgatgtgaccaacacagggggtggagctgtcggtaatctgcgagagccttcttcaggaggccattacacgagacccaccatcgacggacaacatgagcgtcatactggttcggttcctgcacccagagggcaacaggggggcgagggcggctacttccagcaccagtaccggcaccgtccccagccgccacagcaaaagcatatcgctttgatctcgatccttctcatgcggagatgggggtgaaccttggatttactccttcgtaggattgctttccattgatgactagtcttgtcgtacttggtgcattgacgacggagatttggcctggaggaggggtcgcttgaattcgttgcacattcctttctgatcctgtttagtctcgtggaagaaaatgctttaattgactagtggtactcttttggtaaaatgccaagctgcctttacagactagtagttcattctgccttttatgatctcttctgctttttatgatctctcttcatgctttgatctgaattccctgatgaagcctacatgaacgcatgccatgctattttgttcactttgaatacactgtgctgtgcaagtaggcattctcagttgctctgcattcagaatagcagggagattttggttcgtgtttcaatctcggccatgcatgatgttagttgtggtccttgtggaagcaacctggatttctgggatcctctgaaccgagtgctgctagctctgtcatcaggagattgttttggaggagattgattgttgctgcaactagtggcgtgaccggctattgtctccgttctatccgctgcgtgcagagagggccaggactcgtattgccggcagtggcgaactggcgggtgacggccctcctcaggatcgtcggcgaggactcgtttctgttacttgttactacctgtatgactgtatccccggtcgccgccgcgggatcgccggagctccgcggccgtcctgagttggggcaggggagagaagggaacaaactggaagactgaaaagatggggaaagtattcataattgacccctacagagcatgccgctgtcaagggtagcggtccggaattttgcaaattagactctgaacgatctgttcagttcatggcaaggagaaattttcgattttctcatcaatggctacttggtttaacagactagctctgaatcggatcgcgtttcattcgtgtcctccccgctcagcgcgcggcggcttagggtgagtggtgcggccactccggcgaggacgtcggcgttgtgtggccgaaccgaacgccaaaggaaagataggagtagcatctcccatttctgccgtgacacctcaatccatttcgaatctcaacgttgtggccccgccacgcaaacgtgcaagtaatttcaggtggctgtattataaagccttgacagatgtagttctagcttcaccaacaaatcaagaatcatgtcagttacatagtgaggtcaacaattgatctcttaacacaaacagcaacatggaaaccaagctaaggtaccagatcataatgtaagaatgcttgatcagatcattatagtactaacttgaaaaactgggatagtaaagcaaaattttgggcatgcaaagaaaatactagctggctcgtaaagcaatcaacggtacaatcaagtgatcaactgcaaagcatataatagctcacgataagtcacttgcattatatcaaattcatggaagtgtgcagcaaaatagtgataacttagccactgaggcattcgctaagtaatagctacaaaactccaatcacatagagaccaggacacaaaagactactgcagcaccctaacttagatgatgccaatcttgttggccacgtcgagagcatcgtagtctggtgtcagcttcacgtaagccttcttcttcccatcaggcctggaagacaagtagggtcagttaactacactacctagcaaatcaagcgataaaatgaagtatgaaggaaagtgctaacctgatcagagtgttcactttctttgcctggatgtcgtacatcttcttgacagcagccttgatcttcttcttgtcagccttaaggtcaacaatgaagaccagagtgttgttgtcttcgatcttcttcattgcggattcagtggtaaggggatacttaaggatctggtactgatcaagcttgttcctcccaggggtactgactcttgggtacttggggtccctagacttcttcaaggtcttggggcggtgaaatgtcacggatgtgcggatcttcttggtcgtcttcttggctgtcccagacttaacagccttggctgccttcaaggcttgggccttggcatcacccttcttggcaggagcagctagacacaaaataaaacaatcagttcatgcatcttaattaagcaccaagctgaggttaaaaaagccaggcagaaatggattcatagactaattatacaacccgactacaggaatacactcatttccaatggaccatattcatcaatgcttagcaattcaatacttattttaaacaaatatgcataaaagaacttattcagtactaagaccttatatagtgcaagcgagactacataataatatgatgtacaaaactagaaatagttaaaaacaaccaatatgaagcaatttgcacatggtctgaaatcaaaagaacatgtaaacatgatccagcaatatcatctgtgtacctttaggagccattggagcttcacagggctgcctcttgaactgcacacaaagagaacagtgatatcagaagtatgaaacagaaaaactaaacaatacaccattgcgaattcagctatttcataatacattactaatatagaaagagaaagccacctaactaagcatagaactgcttcacagtagagtcgttatacacttcaggaggaaaaggtatcttgctcacacatttcacattagccaagtaaatctaaataagcaatcaggcaaaagttcggccctaccatttcagtaagtataagagtactagtaacaggctaacagcaacgatacatcctatgtggtaatcaaaatgtatcctgtattataatccaaacagggtaatttctgatgtgaaaccaatcaaccaccaaaagctaaccaagacaacagattcagaactcacacaaaaaaaaaaccaccttaatagtcaacaaacaactacatcaagttcaaatcaaccataacgagcacactaatatcgccagcatccctaaacatcacccacagttctaaagattcaccgtactagactgtgtaacacgccatcctaaattgaatctccagaagaaaagcaccaactactggatgagcaacgacctgaaatccactacaagaaatcgacgaaaagcgcgcgcaagtagcggatccagcctcgccctcagattaagggagagacgcgagctccatcccgcgcggctacagagcacagaaatgcgcttgactaagacgaacacgagcacgaggacggcgggggcggaggtggtggtagttgcggcgggggacgcttaccttacctctccgggacggcggcggcggacgcgaagcgaggagggagacgacggctgaggagaaaaccctagcggcctcgcggggcggcgacttataagacggacgcgagctgagctgctcccctctagggttcaggcgggctgggccggagccaccgcggcgagaggctgcgtcggcccatcatctcatgatggattagtaagggaaaaaagtacaccaaaggtccctcaacttgtcatcgggatacaaaagcatcctcgaaccacaaaaccaaatatacggggtgccttaactatacaaaaccggccacccgagatctttttttttttttttggtggttttaacccagtattggcctacgtggcgcgtgggacccacatgtcatcgtgccacgtaactcctttcccccctcttctctccctttctcccccctctctctctctcacactcttctctcgcagtcgcatgccggccgacgggtagggagcagacgcccgggcggcggccggcggaccgcagcgtgcgaaggcgtcctcgccctcgtcttcgtatgccgaggacgagcgccgcgttgaggccttccaccagcggttcggcaccggcgcgacggagatgccaacttgcttggcaccgctcgccgccgccctagtagcagcagcagcaaggcaaattagcgtgcacgcgacatgcgcgaccgtggcaacgacggcttgcgagccggcgagctgatgccgtcgctccggcgcgccatgttcgagctagcttctccagtaggcgcgatgttcgagccgcaggagttgcaagcgaaaaaaccctactagccaccagcccacaactggcctggacgcgccaccgcagctggagatggagatggaggacatcgaggacgtgctggggctggctaggctcaccggcggcgaggcgccttcggggctccgtctcccgctcgccgccgtcgccggtccgctcgcccacgcgacatggaggacgctgccgctccccatccgccggcgccgtgcgcgcgtcctcctgccaccaccgccgcttcgctggtcgccgtgcgcttgcacgctgcctccgccggccgccgcttagccccgctcgccgccgtccgttgctactccgtcacggcaaagagaactaaaaaaagaagagaaaaaaaaaagaaagggaaaagttggcgtggcacgctggcatgtgggtcccatgctaactcagccgtagaccaaaaccggggtcaaagccgctgaaggatctcgggtgaccggttttgtatatttaagggaccccgcatatctgggtttgtggtttgaggatgtttttaatatcccgatgacaaattgtgggaccttcggtgtactttttccattagtaagttctctcgtggcccaatactctcttgatgggcctgaagcctcggcctaccaacggcagcgaactccccaaatcgccactaggccctccccggctggattgttcaccctttcttttcttctgaaaacttattttataaatagattaaaaaaattatttcgagaatagaccttttccacggtcccaacgttaatgatattgttgtccaacatgacggtatcagacattgatagtgtccccttaattttctcgtggaagctaaatcatttacataaagggatggcttgctgctgagaacttatgtgtttaaagacttatttttaattataaaatattttcaaataggttctttttgctaacaacactagcgccaatgaagttggagctgcgaaaagatccattctagaatattttttagggatctattcgtaaacaaactttcaaaaaggtgtaaactaaaaaaataatccatcccacaatgattcaccccgatccggttcgccacgtcacccccacgcaccacgctacttcccagcgtggcattgttcgcggagatcccttttcctcgcacgcgcactcacctcacctcacctcacacgccgccttcccgacgctgacagccgggccccaccacagacctcgacggccatggaccacgatcccaaggagcggctcctcctgccgccccgcgccgcggcggcggcggcggccaatgggccccaccgccgcgccgcgcccgcggcgggcggcggcgggggcggcgtggccatcgacgtccacgggctgaagaggcgcggcggcgggcggcggtcgtgggtgcgcgtggacgcggcgacgggggcgtcggaggcggtggaggtcgccaagccggcgctcatgcggcggctcgacctgcccgcgcgcgacctccgcctcctcgacccgctcttcgtctacccctccgcgatcctcgggcgcgagcgcgccgtcgtctgcaacctcgagcggatacggtgcatcatcaccgccgacgaggcgctcatcctgcgcgaccccgacgtggcggggggaggagctgagacggaggaggccgtgcggaggtacgtcgctgagctgcagcgccgcctcgtggaccgcgccgacgatctgccgttcgagttcatcgccctggaggtcgcgctcgaagctgcctgctcgttcctcgacgcacaggtgccactgcgtattatctggaaacctttgcttgcgaattattgatttcattaacaattgagaagtattgacttgcgtggcgtctgctactactacttcattaacaattgcactgctctagcaattatgatttaatataaagtgaagcatttgcatctgcaatgtctattagaccagtagattccactaaacgatatctttttttacttaccaggacactgtatgatgtaaacaatagcttttattttagctattctctgtttaaacagcggtaggaaggtgacatgtgaatcaggcagtgggcaagatcactgtccacaacgttcattatgtcgatactaagtattcatatgatcttacattgttgcatacaactaaacggtagtgtctgaccccaatgataaaagttcaggaatgtagcaactactaatttttcaggatctcatacttagttgttcctttgccttcaagagtgattgcctataacctgaatgtgaacaaaatgaagtaatgcatcacagatttgctgatcaattggcaaatcctgcagtgatcgtcttgtgctacgctcttttaatagtgttcttttgtgcataatgatacggtatctaactggagaaccaaaaacatttgcatatttgtcaggctgtcgaattggaggctgacgcttatcctttactggatgaattgacaacgaaaatcagtacccttaacttggaacgtgtgcggcgcctaaagagtaagctggttgcattgactagaagggtccaaaaggtaaatggactgtgtcaatgtagttttgtttttggcaaacattaaattggttttcaataattggtctatttcccccattaaggtcagagatgagatagagcagctgatggacgacgatggtgatatggctgaaatgtacctcacagagaagaagaggaggatggaagcatcattgctagaggagcaggcgtttcaggggatgggcaatagtggatttggttcatctttctctgctccagtttcgccagtttcctcaccccctgcttctcgaaggcttgagaaggaattgagttttgccagaagtaggcatgacagcttcaagagtgcagacagtagtcagtacagcatagaagaacttgaaatgttgttagaggcttatttcgtggtcattgattacaccctcagcaagttaacttcggtacgaagcctcgctttttatgcccttctgtttattttttacaactacatgggctaataaattttatgtttatatatatatatatatatatatatatatatatatatatatatatatatatatatatatatatatatatatatatatatatatatatatattccaacagctgaaggagtatattgatgatacagaggatttcatcaacatacaactggtatagtccccaaatatcttcttcatacttgatagttaatttggtagcagatcaatttccaatctcacaacagaattggcttgtttcttatccaatactgcgagtgcttgcttctcatctgaaactgctatttaatttctctatactcaaagtaaaccgtatgcctcttgccttgtgtattcttgaaactgatatggcaaatgcataattgttggaatcaggagtacaattatctgaccatcatactatgtttactttgacatatatatagcttcttttaacccgtcatttagttgttacagttgactagaaaaaggcacaagacaaactaagatacattcacaagtgtctccaaatattatctaaaaaggtgtctccaaatgggaatgatagattgtactaaagaaaaaatattggacaacgttactgctgattactccctagcattttggaggatgcatgataatacagtaagactaagttagtaaatataaagtataatccgctcacaataacattagttccatttaagctaatgaaaatctattaacatgctaactgagattaacttaaagttgggactggggtgagacagtagacagattgtaagttgggtcagatgtcagaagattacaacagttgacaggctgttggagcatgtggttagcttattttcaatgtcaacaaaaagatcttctgtatcactacatctgttcactataacttcaaatgtctgtaggccagattttttccctattacagaggacagccagtggtcagtttctgtacaacatgcatgtttgcatatgccccttattcaccaatattctggttggtattataggatgcacaatcgtattctgctgtggtggtatttcttttgcacaaagggcctgttggtaagaataaaccgaaggtcctatcttagactaacatcattacagatatgggtttccaccatgtatttaccccagatatcatgtctatcatatatttctgcaaggtttagtagctcggctagagatatgatttcacagactttcatattgctgatattagcagtgtgcaactgctattaggttcagtatgtaagagaaatgaaagttgtttttcatttcttttagcctgtttggtcactctctatctggacaagaaaatatgctcacatgatcatcacaaatgttgttcttacaggacaacgtccgaaaccaactgatccaatttgaactgctgctgaccacggctacattcgtggtggccatcttcggagttgtctcgggagtttttggcatgaactttgaggtggacttgtttaatgtaccacatgcgttcgaatggacgcttgtcattacaggcgtatgcggcttagtcatattctgctgcttcatctggtacttcaagaagagaaggtttttccccttgtaaaatggatttccctgttcctcccccccccccccccccccctcttttcagttttctactgcagcgtgcagacgctgcactggaaatttatcgtctttcagctttgccagcacgcaattgtacatacattttccctccttgtttcaatgaaagatacctgtagatcatatcgtgatggagttgcatcggctgcaaatgggagagcttatacttttcaagcatacgtcgctgccgataaggtagcctcgtacatctggcacacgcatcttttgttgttgtgacactgttgctctgtaagacaaacgtactggatcagtgttgttctctcggggaagtacttgcatgtgttttagccgtatgcgttggtgtattcctcagtggtagtgtggtactggtgccctacttgctctgaccttgtcttcacgtcagcaatggcggatgccgatgccgtgcagggtagacatgcagtaacactgtactcctgtttggtagcacatgcgcatccatgacaagaaaacaactggatgagcaggctcctatagtccggctacatgataatacaaggagtccactggagtactggaccaatgtgtgccaaatttttttgctgatgcttctctcatctgggaccagcatgtggtggctgtagtcattactggatgtctgattgctaccaagatccaaaagtcatggtgtggtaacagaagcctgtcctttattgcgcccctcagaaatttctatgtttatgtaatgtggtgttgctattgttttactatgcaccaattaaccggttttccggacaaatcttgctccctgtctggaacacagaaattttacaggactttcacaaggtatttgtaaagtccccggaagaactaataaaaactctccatctctaattttgtattgcgttgaaatactagcccatctctaatgcaaagtgcttaaggaagtcctcataaaaaataaccattttatcttgccatgtaggatgagatattttagggtctattcggtttggaaagaatttcacgagaactttgaaggattttttgtaaaaataatgtaaaattcatacgctcccgaaggagtcgtttaatcctgaaagtatcaatgattaactaagcaccaatacgtagcaggtgctgtaaaacttctcttggctactttgatttaaggaactagatgaagatatggatacttctattcgagtggagagttcttatatagatggttaattacgcagcctatatattaacacacttgtgttttttagtttctagcagctacatcattttctataatccttggccctaaaaacaagtccaaatttttactaagattatgaaaatatatagctgtatttaaaaagaacaaaaccagaagctgaaaatttacacccaacttttctatactctcatcagctacttctcagaattttaaactcaataagacctatattaacactcaccatacattgagaaggcttaggccctatttggcacaacttcaaatataagatttttcggtgttgggtgttgagtgttcctaatttcataaatccatgaatctggatatgcaattactttgataacatttgaataatttattttgttcctgtttgaaattaaatataaatatttaaaccactataatttaatacgtaaagaaacagcaactaggttggatataatatctggtgacaaacaatacctgcatatccgcatattattgcgccagaacagcaaccaccgttctctcacctcaaactctccaaagttgaaacaaacaggcgcacaccgctaggccaaaactactctctgcctctctgaaccaaatctaccgctaaagaaagggaaaaaagaaaaaaaaaacagcgagctcccaccacccaccaataccagcggcagtaaattttgagctgcggctgctgttgctgcttggactccacctcggcacctcgcgttccccttcccccctcacctcgcctagggtttcgtctcggctcgcgcgccgcggcgccattgctacagctctgctacatctctgggtcgtgcgtcgctgatgatgcccccgaggttttgtgattaagctcttggtctcgtctccgcgagctcagctcagagtgggaggcttttttttgggggggcgttgcttggggtattatgggtggaggcgggcggctgaactgttcctgggcaatgccggggaggcccggtgccgattgctagggttttgctcgtggattcgcgtggggaggcggggatcgcttggaatgcgtgggtttcgtgcaatctactgcttgctttgaccccccaatttggtctcgattcatcaggaggggggggggggggttctagcnacgcttgtgggaagcggagctgtggccgcaatgtccggggctaacgcgagggggcggctctcgccggcttccggcggcggtggagactctgagccgcggtctgcggggagcaggacgcggtcggtttccgctacaaggggacggaagccgtcgccgaggcctgggagggatgcggcggcggcggcggcggaggagaagaagcccgccgcggtgcccacattgctgccctcgctcagtgtgccggcagggatgcgcaggcaggagctgctgctgcgctcggggctgtcgctcgacgcgtcgtgctcgtcggacgcatccacggactcgttctgcagccgggcgtccacggggcggattgggaggccgacgtttggggctaggaagaagaagactctctgtcagactgatcacaagattgtttccatgctggaaagggaggttggattggcttctgctaatgatgtgcctggtctgaagaggaggtgttcatgggtgacagctaatactggtgcgtgttcccgattcgcttgcatttttcagccagtgtcgacataaatttatcctgcattgtctctagtacagttatttttgttcgatggttttgttgcagagaggatataatcatatgattcatcaggactaaaatttagaacaaaaggcccaccatttgtgagttagaaatgctagatcctaaagaccatgcactgggtaaaaaatggccagagcatattctgtcttctgggcagaccccgatcttcaagattctaaatgttacagaaatgttttctgtatgtggttacattactatgttttatgatggtgcgggtgtagacatgtagctagccactacaatcacaaggagttatactaagtaaaatctgtcattcttgtgaaagaagtaacatcacttttcgcgaacacaaagaagtaacatcacactgtagtcatcttgtttcatgttgcaatcctgtatacagacctttaaggttgaataaatcttctctagggtggggtggggatgggagccgagaacattttgtggtgaccaactctaagaagcttgctgttgaaatgaccatatctttgggtattacccatatctttgcatttcacagtgcctgcacgcaggccgatccatgtctctcataaacacaagaatgcattaattcataaacttgtgagttttataagaaacatgtgttagtaacaaaacgggatgaaattatgcccatgatggtggaatcatttttcatctgtcttgccaatttataagactgacattgaacttgagcgagacaaggtcaggtcctcctcttttcatcttttcttgtttactgaatatattttttggtactaaggacttgggtaataacaaattttctaaaggacctatgccaagtaatctctattttgtttatcaaactgatcttatgtagcatatattttcatatcttaacacatgagcactcattgcttacaagtgcagaaccctgttatgctgcatttcatgacgaagaatggggagttccagttcatgatgacaagtatgtgaatatcatcaaccttgatatgatactcttccatttggtaaaagaatcaagtgtaaattactctattactttcagggtgttgtttgagttgctggtgctctcaggtgcattggctgaacttacatggccaacaattctgaacaagagacctatattcaggtaacattttgcatttctgatgtacttgaacctgtagtactaggtgttggcaaatcccaaataacatattcaagtatgtctcacagggaggttttcatggattttgaccctgtattggtctctaaactaagtgaaaagaagattattgcacctggaagtcctagcagtaccttgttatctgaacaaaaactgcgtggtgtcattgaaaatgcacgccaaatactcaaggttggccctttacactcttgaaccttttaattgcataaagaggtctctagttcatttcttggaataagaatgatacaaatcacgctttaagttctttggtaaccccctcctgatataacattatctcctgtaaagtcttcataaaatttggtaaccccatcccgaagcaaagttttttggctttaccttggcgtttcagtgtccgattcagttttcatcatgcttttcttaaagcaaaaaaacgtaggatggttacccaaagacattcctgagctacacagtggcttatctaatccattgtgcttatcattgcagattgtagaggagtttggaacgtttgataagtattgttggagctttgtgaacaacaaacctattttgagcagattcaggtatccccgccaggttcctgtcaaaacatctaaagcggatgcgataagcaaagatttggttcgcagggggttccgtagcgtaggcccaacagttgtctacacgtttatgcaagtttcaggcatgaccaatgaccacttgatctcctgctaccggtttgctgaatgcgctgctgcagcaactggttctaacacaactgttgggagcgaaacgaattcagacagtagcaatcgtgccacggaacagcagatgaatggaaccaatggactagctgctgatattgcacgtacaatagatgaacttagcatttcatagcgaatagggggaaatgctcaaatgatgtataagcatgtgtgtattttgtttatcgtagcgtttaggtgtggtctgatcgttgttacttgtcacgttgtagcgtaggacattttagactttagcatttcaagacaaatgaaacggcggcatgtaatgatgtatattctttctttgtgatgcttgtttccaaacctgcagtactgagttggcatgtgaagttcaccctcgcttttgtcagatctttgaattgttagcatgtattgtgaagttcacccttgcttttatcagatctctgaattgctagcatgtatagtgtttagcgcgatagcatcccgtgttgtgaagccttcttctgtgggaattaaaatgtaacgatgcttgaattgatttgtggaagaaatatggcagttttccattaatcatgtaatcatgcacggattttattaaactctgggggtattgcaatttcttcgtcgcagaacaaaattctcccttctgatgagcagtgctacctagcaaaatacagaagcctttgtacaacttagatgagatgacaaaacgaactgatgatgaaaatttcagttcctctatttttctttctttcaaaattgagcagacttatgtgttccatgacaaacttaatcggggcacaggaatgactcacggatcaatcgactatcatcaggaagaatggcggctgcagaccgctatcctgtagcaagtcctgttgtctgaatcgaactgccccccaaaaattggctgaagaaaattgtcaggcgggttcagattaactgtaatcgcgacccaggtggggccacgagatcaaggagcaacccagcggaggaggatatactcacatccatggtcatggagagctcgccggagccaagagaatagctccacgctccacgctccacgcagaacagaatcgcccagcccagcccagcggtccacggaccgtgcagaatgctacaggctccaaaccaatccaaccgcgcgatggcgccggcgcggtcgccggaaaaagaaaaaggtcaaagagagcatcaaagaatccgcgcgcgcgcgacgagcctaccctatctgaacactaatcgcgagctcaactcaccgcgaaacagaggggacgacgaggaagaacaatagcatctatcgctcccttccacctccccgttgccatcgttgcgtttcaagctagttccgatcgctgccagcccgtgtgctgctccgtccatttacggtacagtacacttaattttgctccataaacttgatcagaacaagtgaaatttttccaggcgaagaatagtagtcaagttatggttgcagcgcgcgacttgattaattagcctgggaaatctagaataccagacgagagcaagctatggtttcagacagacgtcagtgtatacgttgcatgcgaaagcaagatttcattcgaaccatatacgcattcacaaatcaacctttctgatttgataaaccatcagttgcaagttgcaacaactagcatcttgatttagcttggattcaagagattttttgggcaaattaattgagcctgatcaaaagatagcatgttgattgagtactatcttattaaaaggcatcaccgagaaaacgatagaccacgtcgaagcagccattgctttctccaagaatctcaaataaagcgacaattcagacattgatcagcagctagctagctagagggtgtgatacagattcatcgatgcaccatggcaagtacatatgttgcatgcatgcatggtaaatatgcatcgtaaggaagatatgtatcccggtgctttaaaatacaaaagaaaagggctcgtagcatcaagtattatttaggcggagagaattgattcaattgtttggaaacacatcatattctcatctacacaatcaattaaaacgacagaacatagctaataattactcttaatttcagtcatgtgcaacaaatatgatgggtgcttaaaaatatacaaaggactagcttgtagtatgcatcaatcctttataatctgcgatcgaattgagttgctagaacatatattgtccacgacaatttgtttttctccaagatcatatatattctgcaaaatcaactaaaatggaagaacatagccatcagaacgaagatttgacatagttccagttcacaagtgtagcctagtggttacaagagcctcagtagcatctaaggtcctgggttcgactcctcatggaagcgaatttttcaggatttaatggcattgtgctttcagtggtaggaatttgccggcccagtcttcgaagatgctcataggggtagggtttgcgtgcgtgtgttcataggggtgggtgcgcgtgcgttgtactgtgtaattctcaaacaaaaaagtatagcttttgaatagatattgttgaatagatttgacatatatagttcctgttcacaagtatatggttgaacaggaactatcatcagaacgaagatttgacatactcaaacgaagattttactccatactcaatcatatctattcaaaactatgtttgagtatgaagtaaaacaaagacgatcagctaaggccacatgttgataacaatatctccctttctttcatcttaactaattgatttatgatcaggttacaaatagaacacaaaagatgcaaccatttcgtgtacatatatacgctctaaagtatagtgcaaaatcgattcccggccctacttaaacctttgacatatatagttttttttttaaggacggactagttaaaatctctgtacctacaaaacaatactcacagcaagtggatgaaatttatcaggtgtacatatttgcagttttaattaactcggcattatctccaagatatatatatatatagataaattcttgtcttatgatttttgccaagaactagctagctggaaactgatgataatttcaaagagcttaggcctcgtttggctaatgggatagggaaatgatttcccacccattaaaagacatctttaaatcctaaccattcattcttcctcttccacttaatcctaacccttcattcatttcccaatcccaatcccacctctcatttcccattatccaaacacattcttatagttaattgaatataagtacctttcaaatgtgcgggaaaactgattatatattagccacccatatataaacttagtacctttcaaatgtgctgttggccttaagaaaaatcaatggacagtttatgcacataaaccacatttggttaatatcataaaataacacaaaatgaaaaaagaacttttattgtagagttttcttcccacatggatttactccaaattaattgaaaaaaaagggtaagaaatgccttggttagttttcacgaacacaatggtaaattagtatataagataatgttacatcaattatattcatgatgtcctcaattaaagtgaatgataaaacttggtaaaattactttatgatgcattatacttaattatttaaccttatgcttcatttaaataatccttgcgtgacacatttaaaacggataaattcttagttctcattaaatattttatttacaaatgggaaacgggaagaagtatgagatgaataaattaattcatggtatatgcttttctaaacatgatcgtatatgtttagctaatcctcccatttttttaatcaaacgcatggattaaggatgccggtcataaaccaagaatttactagaactaattagtaagtggccaaaattaaagtaaaattcgtgcatgatgttaattaatgccatggaatcgaggggggatcgataatccaagagatagtcatatatatataattgttggattaaaaaaaaagataatgtggcatgcataagatagagacatgcatggagtactccaataaaattagatgcagcaaagtgatcattaacatgtttgtgaaaagactttaattaggttatgcatgaatgatcaatttcatgtgcatgctcgagttcttgacttataaaaaccagcagcaggtatgcatgtaagatccatgatccagtgttagtaactgattctttgatatatacttataaacaagatatttatgggcagtggaaaaatgaacaagagaggagagatatcgtactttgcatcgataaggtgtgacttaactacgacccatagactttcaagtggaccagtaacaactgaaattgccacggaacctagctagaacaatatgctatctgagatattcctattagacatgcatgaattgaagtgagcagttaaaaatatcaattgctaactatcggcacataaattctatacttatcgcatgcaatattgcatactaacttaggtactttcacaatatatatacatttaaatttgtgaaaaaaaacaatgcattcacttagacctcacccatttcagcagagaaaccagctactagcatatttgacacttgctagtttttggtgtattatctcaccgtgcatgactagttgcactgtaaacttaatgcatgccttctctagctatgtcattagtagaccgactcttagccaaacttcattgttatctgcatccagctagcgcgtgcacatcaaatcactttatcaggacaacaaaaatccaggcaatatttcaccttaattaaggaaaaatttaagtcgaaccacttggcctctatactcacaatattccaatatctcaaaaataaattcagattttcaagactcgtatcagcaagtacatttgctatagcttagctttgtccatggactacatatatcgagcaattaatcctgtggccttaatttttttttcaaagacttgaatcttgtggcctggagagtttcttccgatcttgtcacaggagcccagcaaattaaactcaagtcaaactagtgggggatatatatggactctgaaccgagagagggtggtaagtacgagcaccatgaatggaacagtggcccaacagtatcctacatttttggagccattgggggacaatgcatcgttgcaccattactccctactttgaatgccagagcgagatgtgaggtgttaattctcaagaacatggaggaccagcagacagcagaagataactgactgatgataaggggaagccgcccaagcagatctgggtctccgtactgttcctgcctgtcctccttcctcctcctcctctcctccgatcctcatcatctagctagctgatctctccacacttgtgtgcttaatttgactgtaacactggatggggcgctacagaagaagatcgaagctaggaacaagttgaaacaagttaaaagatctcgatctggttaaaatttcaaacatgccctgggagattcctgcgatgatttgcttctcccaagagccaagatccatcaatggcgcagtaaatattgcatttccttcccaagaaggggaatggaaaagatggctagtactagcaggtactagtacaactagtagctaggctcctcgcaaaagatgaagagaagggcgtcgtacgaattgacgcaggagatatggaaaacagcaacagcaagcgctggtactcctacggtacaggcatcaacaccgactccaattccccatccgaacagtgccatgctagtactactcctctagttggattacccaaaagaacacgaacgaaatgtttttcgccgagattttagaaggagtcgagtacaaatagcttggcaaactagaaaaaccgaggatacacaccgcctcacggcgctggaacacgaacgaaaaatcgcagaaatgcatcaattcgattgtgagagatctagaacctggcaactgcgcctatgcacgattgcgccggagaagaggggatcgaattaatctaaagagcctagagactcggaacagctcatggcgcgcggagcagtacaggggattccgtcggcgaccggccggccggcgaggggccgagaggccagcttagctagccgcgggagggggagaaaacggccggcaccggatgacagaaagagcagtgagcacgcggccgcgacggcacgcccgccggtgccgtcacgcccggccgtgtgctcactctcttctgtcacctcgcgccaccggcccgcccgcccgccggccggagacaccgccatcctccacacccactcacgctcgcctagctagctagctcacacccccacgatgaaacccgcggacacacacatacctcgccgcgcgcgcgagcgcgtgaagagaccgcaacgtacaccaaccacacggcgacggatcgcggtcgagaagctgaggcgtgcacaccggaccggcccaccggccagtggatttatataggcagggggaggcgagagcgcgaggagggggaggtgcaccggaggtggtggtggtgggccagctgcgaaggtagcatgcgctagcctggacctggactagctagctagctactagcaagtagcagcagcaagctcgaccgggaagggcgcggggctagggtttccatcccggtggtcaggtgggttagtgggtgtctggcgtggtggctgcgcgccatgcatgaccaagccgcgccgcgcgctagctgacctgcggcgaattgaggtgggcgcgcgagcaagctaggctggcgtgggaattagtcgtgacagtgtggctgtgctgctggggcggacgaccgatcggcccagctaagctaaggttaacatcagagccgcgccggtattgctcccaaattggggaattagggtggtggggttgctctccaggagagaagggtattaatatggggagggccagtacgggcttgacacggagcacatgcatgcccccacatcgcgcggctaagctaacccttgcggttgagggctgtacaacaatatagtgtcaaagttaatttgcacttttcttttcgaggagagtacacatcagtttttctttttgaaaaaaaaattcctagggtgttcacagtctaaaagatgaagttaatgtttcatggtaaaatgatgtgttaactttcatattttacactattatttcgggttgaattgattcacgagatggcgtgttacacttttaactttaacctaaatgatgaagacatgtcctatcgacagctatcccatcagctaaagcatctcaatcatggttgaacacatcctcgtttagttttatgaagacaattttatcttagttacttctacatggtatgactttaaaatgatccgcacttaaaggttatattcaatcgtaagtagtgacacgcttttatggcatgctaggtactttaactttatttgttcaagcacctgaaagaatcatcctccatgacccatagggcaagagaactcctacaatattcctaataaccatcccaatgcacgggttgctcaatcacagacacaattaatggagatactaacaaatatattgccataagaggatagaactcataggtgttctctaaattattatcatttcgtacagaccccaacatgacatagcagtaaatgcatatattgcaaaaagatagcaagatttcagttcttatatcattggatatttgatcaagtgttcgctcagaaacaaccactgttgtcttacgtaaggttagtttatcatatgggcgcgacgcccgtgggctggcatggaaggtaatgattattctactttagtttaatcatggttttagttttagcccctcaaaacttaaatttaatttatttggtttcactttgtttcaaaagttccaatagtatttggtttttcactataatgtgttgcaaatatatagtaacgggcacccatccctgtacagagaaatggatgagagatgcacgcgggcatgggcgcctagctagctagccagccacagcggatctaccgagctctgcgctaacgaccaccagggaagtgaagtccagcattctggaatgccctccatcgctgcatgtctctgcatatgctgatgcaatttgacggtaccaacacgatgtgtgccaaggctgtagttgcaacggtaggagactaggagtgtactccggtcctcactagttataagccctatacatagctagctgtagctggtgagtggcatgcatgcctcccctgtggatttatgtatctgattccgaattttgccccaacccaaccccaaggcatgaaccatgcccctctgcagctcttcttcgtatgactatagtactacatgtagcgtccattggccgttgctagcaggagctaatgtggcatgctctcaatgaataactgaaagtcaggaagcataggaatagtgacattgttgatggcgcaggtatggtactcctccaacatgtatataaaacaaacctagcacaagatatggcatatcctaatactacaaatccgaatagaaagttgtccatattcatagtacaaggatgtgtcacatctcctattagtgttttttttaatggaacaaagggttatacccaagtactctggcttcgacgtcccgtacacaagtaggtttggctcatgtcaagtcgtacgtgtcaaccagagccggctctctataggccctaatagagaccttgtaataggccctcaagaccaaatatatttttacttgtaatatatacgtgttataaatcatatagtgtcgaaaatgatgtaaataaacattataaacacctaacttacgatgtaaattaatcaacgagaacaaaacaaaatcctagcccaattttcagactaaatataattaagcaaatgagaagatcacaaaactcactctaaacactaaccacgatgaaataaggtgtgaccacatgggagtcagacgtgaggataggcaacaacatcctactagctgggttggttcgtgatgggccccatataggcttgggccctaggcggtcgcatgaccggcctagagctctaagatggcccacccagcggtatgttaattcttttggcatctttacctcatcaaaattcatacgcggataatatgttacgtatactaccccttctcttatgttctacgagtactgtaagtagtacttaaagaaagttgagccacaagaattgagacggtaagtgaggatggaatatagaagccataaaaagttaattattccattcgttgcaaaatacaacaatataaagtgtatatcaaatatgataaattttcacccatattcttttatctatcattcacccacttccactattcaaattctccacctaccttttcttttcaaccaatcacaatcttctctcgttcaatttcacctacctgattacttcaatcctaaaactctttatgatttaggatgggtggggtactactggcttgattgttatagcttcagctccacttctcctataactagaacccaactaaacaatttaagtttttttttcaaaattttcctagctttgttactcactaccagcttctcgaaatatcaaattcctcgaagaggaccttttgcgtcaggatcctgaatatgggcatacacttgtggtggtgtgcgtgcatgcatggcctgctggtaatcttgaaagcatgcaaaagttaactctctttttcgtctccaaaagtaagagccctgtagatttagagctagctggatcaatgatcaatgagagcaggtataatagcatactataaacatattttgagaagataaaaaatgagagagaatagtagcgggctactgatttatagctagctacagcatggacttcaaaatacatatgtgtatgacaagtgggaccaggtattaaattgtgtactatatgttataggtaactattatatgaattaactattgactatagatgatttagagtgagtagttagctatactattaaaattgctgaaagggacgcggttaaaaaggacgcatcctggccagctgccacttgacttgctacttgccagagccagcgctgcgctcacgcattaacaaatttggcacgctagctacctcggtgtggtccttgatcagttttattctccatttaccctttgatcaaagcaggctcaaaaacaatatatgtgccggtacaactaagcaattaaactgaacaaagcgttttcgtggtccctttaattcgaacgaatacattgtacacagcacagtacagtgcatgcatgcgcatatgtgcatgtaaatatatatgtgcatgcgcaacatgtacggcgtcaagcgtgcgtggtgctagcttagcctagtattgtaggagtactagctaactaaagattagttagtgttgagaacactaatcaaagcttaatttttgtataggaccagtgttattctcgatcgccggatgatgctctagtccagggtgtggtgtgcatgctaacgcattacgcatgcctaatgatggtccagggtcgtagtgtgttgtgcctttttcaaaccgatggagcagcacttagtccatggcctttccgtgagctttaatttgtcgattgttaacaaccgaggtgggcaacattggttaattttagccagaacggtaacaaaagaaacgtgagacagacacacagcccaagatcgatcgagagctagagaccatcaaattgaaaattaatgtgcaacaaaaaatcaagcaattaatcccgtttaatttagtttccttcgttccaaagaggctgggcatctaattgcccggtagggagctggagatgaaaccgacccaagaaacgtaacagtacgtgcaaggtgcaacacgtccacacacgcctgggagcgagcaggatcgatcgacaggcgtatcccggtcgatcgatcggcatcttgtcttctctcttttcaccgattcctttgatcagcttgtgggggccgtacgtacgtgtccgtggctagctttaattccgtgcgtgattggtgcagtctggtacgacctggcgtcctgcaggccacatgacacagagtgcgcgtgggcgcgcatgcacacacgcacccccctgctgcaccgctgcacgtacgtacgtacgtactccctccccgctcaccgcggcgcggccgccgcggtaaccagccaggagcccaggaggccacgacgacgcgcgcgtactcctccatccatcggtgcggtgccgagagcgagaaccccggtgtcctcctaaccccggacgcgcgcgcccgctcgcgctcgcggtcgcgcacggcgtcctgcagcctgcagcgcgctcgcgctggccggtgtaagccagctagcgcgtggcctgcaggctgcagccctgcaccgttgcacggcaggagcgggcgatcgagcggccgcgccggctggagtgtatgatgcgtggatcgatcacagtctcacggatcatgtgcgcgtttccacgattccactgtgtattgtgtgggaattaatgcccacatgaccgaacgtggtttgctccagaggaggagggtgctcgatccagaggtgacctctgcggcgcagcgaggcatgcatgcaggccggacagatgaagggatgtggagtagacgacgacgtacggacgtatttactgcatggtgtacgaaagactcccggattggaaaccacgagcctgcctatattaggaagttttcaggtcaggccgggcagaaatgattatactggatttttcattaaagcaccggatcgacatgcatgcatgcatgtagcggccatggcatcattacaaaacacgaatgattactgtttgtgctgcagtcaggatttactgtaccgttctgaaagtgaaaatggtttgcaaaaaccaaatgactatgaaaactagcaaaaagaaaaagaaatggattttacaaattacaaaccgaccaccaacggtttcacaaactgaatgtttttcacgaaaaccgatcatatttattaatcctagctgcagttaggtgctgcccatacatgacatagatacatatctctctggcgcacatgtgaaaccatatgttcagtggctgataccacaccaataatattacagacaatttctactgctgtggcatcacagtccacacacatccaattaagcaacaagcacatatagctctaatcaatttgaactgagtccaatccaactccattcatgaaaaaataactatataaggtatattattactgtccaagagagctttggccataaatttctgttacactatttcacttacagtaattttttttttgcaaaattaaatattattggattaatcgttgttcaaagcatagaactggacagtgaaaaaacgtcttgtatttcttctgaacgttatgttgaaactattttttccttgtgtcaccaagaggtccaagatgaagctagcatttacaacaaactattttaatgatagataatgcacccatcgataataagctgcatgcgctgacttcgttaatcttaaattatatgctctttttaaaaaggtgcgaatgctatttatcaacaagcaaccctgtccgagcagttcataaagttctagtctagtatcttgaaggcatgccactataatagagtatgcacgcacatatataagcatctgtaattgtactttgtttcggacaagaaaatcgcgcgtggaagaacacaaaagcaatagtgcatcttactagtacattatactatatatcaaatgggccatggccggagcctggttcatggcacttggctaagtgaactatctgggcttcaccaaacatctaactgggcctaaccataaccagaagtccagaacgcaagataagcaggatgacgaagcagagagagaacgtacgccatgatcgccaattcgccattggtgaaagaaaacaaaaaccttccgggcgttggggactgtggccccggcgagaggagaggggactgaggacaggcagaaacggagcagcaggctggggtaggggaggctttatgatctgttgtccactggatgatagaatcgcatgtgcggtgcagacacatgaatgccggcctgctcgacgaagacgcagcaggaagagtacttgggctgtgtttacttcacaccaaaattgaaagtttggttgaaattgaaacggtgtgacggaaaaattaaaagtttgtatgtgtaggaaagttttgatataatggaaaagttggaagtttgaagaaaaactttagaactaaacacggtattgtacacacactcgtcgctccaaattctaccctgcctgcatgcagttcttcaatgcacaaaatgtttggtgtgtactacgagagagtgatgaggtgtacttgcctccgaattccggaattttgtaactcgaaaggattcattttggtactggcataaattcaggttgagtttcacctcaagcaaagtaattcgtgcggtagttcgattctgaatttctgatactactggtactgtagagactgactctgcttgaaaattacgtaggaaacctgactttctgacaacgcaagaacctctcttaagcaatgaaacaaccaatcagcaaagacagctaacatattctgaataccctgatttcaaacgtgccagacatcataatgaggtgatcatttttttagataggcatcataatcagatagtttgatgtgccatcactcataataccatgctaatgcagcacatctttttcgtgtatgctttacgtcaagtatgaaaaattccacgagtaggccagtctgataataagcttctgctgcgcatctccgacctgtcctgtgtgccttccgttccaagttgagctatagataagaagtttggactgtggatgtgcacataagcacccaccaactccacaaaagcaaaagctcacccacttacccctgcattggctctcagcatgagttgcatcagttgctagtagctctgatgggttataaagttgcctcccatttggatgagagattgagagcactcagcaccagtggcaatgtggtttccactgccagtgatcgatgcatctagacttctcatgaagaacagagcagtatcagtagagcaccaatcagttattagtagtagtactcagaaagcaattcatctgaatttggtttggttcaagaaggaataacataacaatctctttaagaagataaggaaaagagtaggtttttgaaaaactacggagacttttattttttgacgcaaaactacggagactttgaccaaaagtatcacaaaactaagtagaaacccaagcaatattctgaaagatagataaaacaagacactgaaatgcagtcctttcccatacttacgtatgaaaacagaggcatcttgagaagagctcagctggatatggacaaatggtgatatggaacctcctcattaacccaagcaatattctgaaagatggataaaacaagacactgaaatgcagtcttttcccatacttcagtatgaaatcagaagcatcttgagaagagctcagctggatatggacaaatggtgatatggaacctcctcattgagtgcagtacgaaagatctgtcggtgcttaatcattcacatacttacttgagaatcaacgtacaatgattttgacagaacaacacctgacgcagacaccagcaacgcgtgatgcgtctctatgtaccctgtaaaatactagtatgaaacagtagaaaggcaggaaaattcagtacaagatggcaaaaggcaatgcccctggaatgcagtcgaatatgcatctttttgtctgtgttagaaaagaaattcaggtacagtcaagttattaagttggaaggttacagttcttgagtaatcttttggtctctgcactaaatcactataatttctttttttgtttccttctgttgagtgagaatttgcaagtttgaagaagaatgacaaagaaagaaacaaagaaggtgacacatgacaaacttcagtagactgcagactgtagtccactggtgggcggtcagatgatcggcggcggcggcgtctcccagacgtcgaacacattctcctcgttgtgcagggcgaagaggcgatcgcctccgatggagaagtcgcagatggcgccgccgtggctcctccgcagcgtggacgtcaggacgcactctgggccactgaagacggagatgctgtcgttcatcgacgagaagagctgcccgccgtgcgtggcgagcttcgggtagcagctctcctcgctgggcaccttccggttcatgaacttgctccgggagctccaccgcacgccgccggcgttgctcctcaggtcgaggaacccgaggtcgtcgtactggttgatcacgcagacggaccgctcgtcctccatggcgatggcgtggagcacgcgcttgtcgtcgagcgacgcggccatgccggcgtcggaccacgaccaggccacgttcttgtcccggaaatcgagcaggccgatgaaacagttgtcggtcttggggaacagggtcgccaccatgagcgcgttggtggcgtccagccattggagcttgtcggcgtcgcccaaggcgcagccaggcggctcgtagaagaagtcggcctgctcgccggtggcgcggtcccagacgccgatgccgtactcgttgagcctgcccttgcagctggcgaagatgctcgagtcctggtcgaacgccagcgcgccggcggtgaaggacttggcctggcggtcgtgcgcgacgcggaagcggtgccgcaggtccccggagacggcggagaacgcggccatcccgccgtcgcacttccccaggcgctcgcgcgcggcgatcaggagcgtggcctcgtcgaggtacgccacgtcgttgacctgcgagtggtcgagcgacaccgggcggcgctcgtcgagcatccagttgtagacgtgcacggcgcccccgtgcgcgacgcagcaccccccgtcgggcgcggcgcggatggccgtgccgtccccgggcgcccgccctggcaccgacgccgcgaggcggaggcggtcgccgtcgaacgcgccccaccgcgcggcgcggacgtggtcgaggagcccgtagtagagcgcttccctgtagagcagcttctccggcagctgcggcggcacgtgcaggctccccgtgcggagcaggtcgagcagcaccgcgaagcacgccgggttccggtcgatgaaatattccgccacgcctcctcctcctcctccaccaccaccgccgccgccgccgccggcggtgggggcaaggttccaggacgagtccagcagcgccccgagcatggactccctcccggcgttggcgagcgtggtggtggtcgtctcgaacacctgcccgcccacgttgaaccgcacccgcccgcctcccatcctctctcctccttcccccagcaagcaacccgatcaccaattcaccatcagtccatcatcatctccaggattccgcgcccaaatcgagtgggggaatcgtgcgtgcctcgagagaaattgggttgggttgggggagaagacgagagacggatttgtttgctatgtacgcagcgcgcgccagcgacgggacggagcggacggggagacagtcgggcgaggcgacccaaccggtggtgtttgctttgacgtgacgacggaatttagactgaagaaatggccactctaaaatgaacttttgtcccaatcaatcgatcacagacgggaaaaaaatacttcctagtacaacctaataatgtaaagattttttaaagagacatgagtattacgaaaatatttgaaaatagttggataaatgttttgattgagaaaatacatgaaaagaatgattatgattgtggattagactcgctcacgttagatgcaacggccagcgactagcgtgcgaggcagacacatcgtgtcgtccggagcacatagccagctgccagcatagttaggctgtgtttagttcaacgtaaattttatattttggttgaaattagagatgatgtgactaaaaaattgtgtatatgacagagtgatgtgatggaaaagtactgaagtttggatcaaaatttagatctaaacacagccttacagggaaggtcagcttcgctctctccaatcatcgcgttcgctacggcgggcgggccgaatctttctgccgcctcgcctcgttgcgctcgctcgcgcgggttttaatcgttgcgttgacctccttttgctgctcttcctgctcctgtcgggatcgtggctggattgctggaaatggcgcggcgagttgggcgaccggcaccgcggctagcttggtcgcttccggttgttggggcctttttccagggcagattctacagcagtggagactggagagaggaaaatggagacccccgtcgatgaaacgatgtggacgctcatcgtgcccgtgaggggatcagaagtgcaggacacacacacacacgttgacatctctcatctttgcatgttacagtatggggcagtagtacaggcgtgtatgaatgcgcagagacatggtcaatcctgattcctgagtccggctaatttgaatggttggtggtttggtgccacggtcagctcaccataatattcgcacagagaagaatttatggacagtggactataaagatgcaagttgtaatccatagcatttacatttataatttatagtattagaatgtgctatatgtcatattaagtctgtttttctatagtacgaaaaaggtatggagtatccgtattacatcatacaccgatttgttttttatgaaacaaaaagaaatacaactaaagagcatccctggaaggccaaaaagtacggagaaattaagcgatcaaatcaacttgtagtgttgtgtattataacatgggagcatctcaatagaaactaaaattttcagcaagtagtaactaggaactgcaaaacatgtaaagagagatttagcgttacaaaacagcgtattagagaccaggtgcgacttgcgagtaataaggctctgtttggatcacagccaaacattgccacgccacagcgtggcttgccacagacctgtggcggaccttctccccgcctcaaaaatcactgctgtggtgctatggcattcaatggctaccaaccaaacagagcctaactcaatataataaatgcaccgagactaaaatattcctttccaaatatataacctaagattggatttgtccaaatccctattagtggaaatatataagattagatttgtctagattggttatagtgaaaaatgtctaatccgtcctagattgagttgataaaactttccttttgaacaagactattatcaaaatttaaaaattttaactataaataatgtctaaaatatttagtattttaaaagtatggtggtcatatgtatagattgatcttaaaaattgcttcaacaaaatcatatatttatttatattttatattatattataataaaaattttcgtcaatattgttttttaaagactatatccttataaaaagattttatcagtccggagaggtattttttaaaacagagggagtacaacttatggttggtaccaaaacagaagaaaaattaagaggatatataaacggataagaggatatctaaacagagaaaaaaatgagagaaatagggtgacattggtgcagaccgcaaaaacatgaaatcgatcgagaggaatgatttgtgcaacaatgcagaaaggcaaaggatgatgatatgaactacgacatttctctccattcatgcttgctgcaaaattgacgtctcaaatagctccagcagaaaatacaatctaataagggttgaacgacagcaagcaagaaaccatatttgctagaggctcacagctgaccacaaggaacaaaagtaacacctacattacaactaccactgcaactgctacaactaccagctgtttcgtgacggtcgattagggcaagacttggcaggcaaccagccaagggatggaagccatataaattgctaggctgctcatgccaaaaaccttcagactgcatgcctcataagtaccccttggaagaactgcacaaggccagagcaaattagttatgagccttccttctgcgcttctttccagtagaaattttagcagacacatgctcttcctcttcagatgactcgccttctttctccttttgctttcttttggtcgaaagaccatttgtcttggatccatcagcagctttgggagtgcttgcaccttttggatttgatccgctggatttagcttcatcttttgaatccttgtgtttgctgccaccatcattttttgatttgcttgcgcttttagtgttaccagtctcatccttgttgcttccctttagcaggccatcctttgtcttgccagtggatcgagatgatcttccaccttcattcttgagggcactgccacttttaggtgtcttggatatatcttcatcatcgttttctgcacttttccccttcaaaggactgtcatcattttgtgaactattgctggagcgcacacctttagggcgtcctcttttcttgggaggatcagcgacatcagtgccacgatgtttcccactgcatacaaaacaagacaacagtttcagttaaggtgttgcatgtaggctggatcaatatggcacatccatatgaaaagaacctgctgggtgtttctatttttccttcctttgtttgctcacccaagctaactctaccccttctgccgtgcggcctggtaaaaatgatcaaagaactcaaatatataaaaagaaagaaaacaaaaccatattataaaggataatagctgatgatgaacgaaactggagcattaggtaacatctgccagcagtatgcatgtcgcagcaaaatgaacaaataaattatgtgattacagttggaactcctgatcataaatagtaaagttacaatacaaacagaaacacagtaaatcttataatctatatggtagaaacataaactgaagataatggatgctgggaataatccaatcaaccacaactcaaagctcagaaaatcaaggtcattcatgctagagcaacttattttgtctccgttaacccattcaagaagcattccaagcatcttgaacccccatatcaaagattcaagataaggagattgcaggtttataggaatgacaatccgaatcatataaaagattttagtgctgatgtaactaagaaagtcatcaaaactttaagaggatatcgatgatgcaaagtagaatatttatttacatacatatcagacgatgcgtcaggattgttgtctcgcccctgcaggtagcagatgaatcagaaagtggctagaaaggatagataatggcgtcaaactgcatggacatacctcatcaatgaattcccatttttcattcttaaggtgtaggcgttcaacatctccatcatcataaacaacctgggtgccaaaaaaatgaaggtatccaaagatgaaactgagctcaaaaaaaaaactagcatttgtagtgatttggacagcaaaaaggcataagtcagagctcatttcccaatgcacaccttgtgcttttttgaagcaacatcaaatgactcaacaacacctttatagaacctgcagagcaagaaacagattcagaacaagccaaacaacacaccagtaaaactcatgtaagaaatcacatatcgtagcaaaaaagagtgaggagaccaggatagataaaatataggtgtgtaactcaatctagaatgaataattgtactgcatatattattaaagaaaaggtacatatttagaaacatcatatcaaagtaacgaataatgcaactgaagcgtcgtctgcaaaagaatatgccatgtcaatctagatcaagaaatttatttagaaaataatgttcatacatatgaaaatatcatcataaccaatgaagcaatgggtactagttagcctacaaacacaatcttaacaaactcctacatttgagaaacataaatgatggttatagaacttactttctgtcatcaggccaccacactttgattcttgagccaacaagatttcctttaagaattttgttcttcttgggctggggagtctgatgaaagcaaagaaaaagatttgaacaactgaaacagaaatcagcttgcaacaagactattcactaacagcaataagaatcaagtatgcatatacctcttcagcttcctgtgcacgtttcctttttgagcccccactgtcacctgcctggcctttgtttttacctgttttggccgaagacttgggagatacgatatcctgcgttatgataaaacagtcattgtggtcgatcatcatcatcgcatgcacaaacatttcaacacaaacccatcagatttacaccaaatgcaaataaagctctatgaatttcgccgtagatacaaaatagttggtggcaggttgccaagccaatcaggaagttaaaaggatgaaaggcagagaagtttaaaaatatgagagccatcgacccaacatgttatagttttggaaagcataaaatgttttgaggttccactatttctaaataacactcctaccaggaaaccttagaacatggagtcagacagatataaaactatgaatatgtaaaacagaaatccaaccttctgctagtgatatacttatgcacgacctatgtgcaaagcaaaacctcaaatcatctactgttgacaaagaaactacctttaaactgagatcctcatcagtgtcttcatcgggtggagtatcttcctgctgtttcaaattttccttctgcttcttcttcgaagattccccttcaccagtctttttgaatgaagacttgatatcatcatctttagctagtcgccttgtagcccttccaccagaatcactaactgcgtcagcttttttagactctaaacctgatactttgccttttccaacattcttcttctcatgcgactttgatgcaggaggccggccccgctttcccttgccagcaggtgtgttatcaacatgtttcgatttgtcatcagcagctctattcccagtctctggtggcagcttattatccccatcatcagtctctggggataactccctagagactaaaatatcctcgttgttgttaacagccttagaatgatcaaccacttcagaatcagtggaagtatcaagtttatggcttttctttaaattgtgatcagatggcttttcaggctctgtggtgattggttctggtatttctttagcaccggatatcaaatcatcagtgtcttttgcctgattgtcatcagaaggcagttcagccttcttatcagaagaggatggtccacttggagacttgaccctgtctattaaagcacaaccattgctaaccgccgaagtggaagtattgtttggaggagtaccgtcttttccagggcaattggcatcttgctctaattttgatgattcctaaggaataaaatatgttcattgtgatatctatctcactttcaagaacttcagattgaatgtcagtagcgacatacctgagctgactcatctgaaacaatcttatgagataatttcccatcagccacctgcatcacaagctttcatagtcagcttggctgaaataaactaattagtatatcagaagaacattggccggtatgatatcatatcagattgagagaatttacactacaaacttttacagatcacacagttgataacaccaggtcatggaccattctattgactctaccagaaaccaaaaaatatactaacatacaatcaagcatatctttgaataacaccaaaaaaacaaaattaatcccaagaccactgcttgatatttcacagttgatactttttcagtcaatataactttcaaccgctaagacagcattccagggtccaaattctagttattacctgatgggcaacgtgacattttaaatttaacatacatattactccagaaagaatgccatagaattgcctgtcaaaatagtttatatacagcatgatatttaaattaaaatacagttgatcatacaaagaaatgcctgtcaaaacatttctatgtctcgtgttcctctcccaagtcccagtggtggctatatagcataaaccatattatacctctatagagtgacagatctaaccatttccagtagcaaatagttgaactcaatgtgtaagactaaaaatatgtgttaaaggttgaccacctctaataaaaagaacatgagcagtctttgcccatttgaacacatctgaaaatacattgagaatgccacaaaatgcactaactctatggtgagcaaaccttaattaatattcaaaaaggaaatttgttagtagtttgactgaccatatcctttccaggggcatcagaattgtcggctactccagcatctaaagcatcttcgaacaatgatgtaacaacttcgctgtactcatccaagggagtgccccgaagtaaaggagtaaacactggctttaacttctcataacacttattaattaccttctctgcaagttcgaaagatgctggaagagtttcctacagagcaaatttgaaattttagtgaagatgatcagatctattaattttaatatgaaagatgtaagtgaattcgaattactttttcttcctttttaaggttcttcagaaggtaagatgctagatcttgaagcaggcaggatggcatatcttgctggacatcttcgctctcatcaattacaaacttcatcacagtttccatcgaggtgatgacattctcttgatgagtattgctgaaataaatataacaaagtaatgaattataggataaagaagacttaagaaaattaacagaacatacgcagggcagaaccatgaacatagacataaagcaaatatacacaggaaaacacataggaactattgtgactttatgagttttcacgtcaaagcaaattgtgaactgtgtaaacttgttggaacaaatcatcatgcatgcttttgcacattattatgtgataagagaaaagcagaaattagcaggttctagacaaacagacagaggacaacaaaggattaaaattacttcatggcagattgtgccattatattttacgcagggaacaaccgcttgtcggttttaaaataaatgatgaacataagctaacaatgaaaaactggggaatgggatatggcaactcctcggtatgtaaaatttagcatcgatatgcatgtaaaaaatgttattccccaaagatttgcaatcagaactgatagctgcggtcaatttggtgcttcaagtaaaaaatcaaacgcaacaacgcccaatgatatcgacaaaccatagtaatactaatacatgatgtttcccttaaagtaatcttaactggtgagtgtaattgcaaatgcagttctaacttcttctccatgtacataatcatgccaaattagcagcataatattaatcaggcatcttgcaagtcaataccagaaccacaacatatccctagtcaatttaagaacccgaaagaatcggcattctcaaggtgaagaaaatacgaaatgaaccagcaaaagaagttacacacgatatggttctgaagaagtggtgaaacatgtcccgtatcagatcgtcgcagtcaagatctagcatcaagacacagctccggaccttcgcaacggtttcaagcatcgcaaccctccttgcataggaggggctttccatatcatccaacttctcaaaggcctcaacaactctggtaaatacatcctgcaacaaagcaagtgacaatggtcagtgtgagcaggcacaacaattccgtagcgataaatcttgcagcagagccagtgacaagggtcactacaagcaagcacaacaattccatgacgacaagaagacatttaccttcatgacatcatcgtcatagggggcctccggggcagtgatcctggtaacctccgttaaacaggaggcaacagcaagctttatgtcagggacactgtgatccagtaactccttcttaatcagagcactcattgttggccggagagccttgtgcatgctctccggcggcgactggtcaaccctggccaaccaggtttctgcctcctgcataaacgaatgagcagttctaagtttctacccaattaataaataaataaaacattctatttatacagatccaaacagcgaggattaaacttcacatcaatataacaaccagtacatcctatcatgccaggctccaatctccacggcaacctagaaacgaacaacgcgagagaaaataataagaagaaaaaaaaaagcagggtcaggggcgctcacctcgattaatctgagcagctcgtcgtcggcgtccgggagcgaggtgaagcgggcgccgatgtcgcgaagcctccgctccacctccatgtgcgcgccgtcggacgccatcacggcggggcgcgcgcggtgccgccccagcgggagagcccgcgcgaagatctaccccgagcaggaggaggaggaggagggggagacagttagggtttcgcgaggggactggagggggagggggagggggaggagagggcgagagcagcggtagtggggggtgggagatgcgatagagatggagtgtgttaagatttgagaaccagattttcccctctcaagtttttcggatcccaaactgttttttttttcctccccttttccctcctcccctctcgcagctattcgttcggatgtcatctcgacgactctcgctggggtttgggttgggcctttgggccaaaatcgaaaggcccgtcaaccgattgattgcgttaactgagttataaaaaaacaagattcaaccacaatggcacagtataacacaacaatgtttgtgaaaaaaatatattagtgtgcatatcgttagctttcctaccagcctactaataaaattttacgtcgtttggaaaaagctaaaaatgttttgcggcattgaggttccatatttgaaagtgcagaaattgagagatgatttgattgttaaagttgttttgaggatccctgttatcttggctcttaaaaaagctgggtcaatctgaggaacgatctatgttctttaaataaagttatttgagggttattaagacatccaatacatgtggtgggagatgtgtgagatatataaaatgactctggtctctatataaggtttataatcatatactatgaaatctattactctgtctgatcaaatttatttgacataagtcgggtatttctagctagatgggtattgtatttgtcacatacaaacatatctggacaaccaggcgaagtgactttttacagagccgctcatatcgtatagcacataatatgttcatatgtggtagatttagaccacgggtaacttagagaaaagatataagagaaaagagagaggaatacatttgtgaatataaaaacaactgattaacatggcatgtgaaaatcagtttgttgatgttgcgttacagaggaacaaataacagcgtagtataaaaaattgttgcgatgcggtttcttgcataacatggagcccaaacaaatactaggtttattatacaaaataatcagtaaacattttgaatttaaaataaaaaaagaacatctacacccatgctttctcgagtacccctacacttatctacttaacatgtgctttctctattagatctaagatttgaacttaagaaacacataaaaagacaatcagatgatatagcatataccgaaaaagttattgataattgggtagtctactataataaacctttgattaaaatatcggatatcgctaactcaatcctttgtttggaaaaatggcatgatatatcgaagaaaattacatgaggccggtcctaatcttctggatggcatgtggtgcttgagctaagtcatcagcgctatatttgatctgatgatgttggcaaaagtggcaaacacgttgttggtgaccaacaagggagaaaccggggaaaagaggaacatggcgagaaagatgaggaaaaacgtggaagaaggatgactagaaagataacccagcatgaacaattaattaatacgatggatgtggaaatcacagaggaatttcttcttcgttacccaatggatcagatttaatcatgatttgattgggtagtttaggatatgccaaatattgtccccacctgtgtagtaatctacaactatattcacctgtaagcgtagaatccattttttttcaaggaacaatgcattgaagtgataaacaatatagattgattcagggaacatatggcacatccttttgcacaaggggaacaaattattgggacaaaacgacctagaggatgagagaatatcaaactcttccttattcctttagctattattaacaacacattatatggggatgactatgactcctagtcggtatgcatcatccgacaaaagtgcattttcattcgatggattgattcatcgcccaagctaaccatggagctatggtttcttggcaaaccgcccttagagacccgcaggggggggggaggggggatatatcggatatatgaagtgactagagtagaccaagtctattagcgatactttgaactataactttattaatgccgaaagcaaaagataaaatagcaaactatcctgatcaagtaccatatgaaaagaacattgcaagccaagtcatgccaatctaaggagcgcaaacaaagtacgaagatcacggtatatacgagcactccctacagaaataaagcaaactttatgaaataattagggcatatgactcattgagattttaagtcaagcaagtagctagactagactaatctagatagcttaccatatttatatcttatcttactgaaataatgcacaataattagggaaaaagtaatattacaaaggacaagatttatatacttaataccgttgagcactgaagaaagaaatagaaagggtgcaagggttacaggagagtgtgaacatgtagctaagggatttctcataaatgtaaaagcatttttgttcttaaaaatgtataaaaaccatttcccatcttacaatttgtgattgcattttttggaaaaaaaaaagagaaggaatccacaaaagtgcccaacacaaagcttcgaccattgccgtcccaagcgttcaaattttccacctcgaggcctacgggcggcctgtacgatttacctgttggttcggtcgctccgttcctccggcttccgcctttcctcgtcgcggctatacggctattatacctaccagccaccacaccacccttttcccacacttctccactgactcctcgagatggatcccgcgccggcgacccctcgctggaacctggagcggccgtacctcaccggccgcttccatcaggtacgcctcccttctctcctcctcctcctcctcctcccctgtctcggctgcccccattgccgcctccgcctcatccaccctcgcgctctctctctcgcaggaggccaaggtggctgcggcggcgcagggggccggatccaagccttactccctcgactccttcaggtgattcgccggttaaaatttcgcgcgattttttttttggtgctcgcctcgtggtttttctgatgccccggagttcgtttgaatctgcagccgcggcggcggcggcggcggcggcgctgagagtgtcatcggatcgtacgccgtctcagtgcaggtaccggtagcttgtacttttaggttgtttagctggcttaattggcttcgagcgactacttttttaatggaccgatgctagggtttaggttccggttccgcgcttctacttcgagctcaatggttcgggttaattggaagaattcgtcgtgttttttttctctctacatgtgcatgaactgtaaattgttgttaaccagagtctggattggagctaggaatgttattgaacactgtattttgattttttggactgcctacttccttgaattcagaaaacaatattatgtaacggtgctaggttagaattttcttttgatattttggttcatgtggtcaatgtagtgtgagtagatataatttcagataataaaatattttgttacataactcgaatcttctgtttgaatttgagtgattctcagagtttgttggtcggtggtgttcatgacatactgacatgccgtgctaagtacaacatatttgttgtaacaatgtcacaaaatagctgcattttcactatgttgctttaagcagctattctatgaggctcaatattgtaatatcttcattttgcacatctttaaaattatctgaagtaatttagctttcacaaacaactgaaaagtgtaactccaacctatctgttattgatttgcaggagcttttggtcattgatgatttgttatcagctcttgtgggtattgagggacgatacatttcgattaagagagtacggggaaaggaggggtatgttgtcttccagattgattcttcaatggaccttgcactccaggtaaggcctgaagagtacaacaactggatcatgaattgcctccaaaaaggcagatgcgtttggtacttaactctttgggtttttgcaggaattaactcgtcggatttttcccttatgtgaggattttgtcttggtataccattttgtggagtccagatcacatttcaagagtggcctggtcaaccatgctctagctgcagcattgagggcattcctcttggtaaactccctctttcgagccaggaatattttaattaatttgccttgactacaagctttcttatgtttggaaaaggtggcaaaaacgaatatactaacaatttcatattatatagtaaaaacagtaatgcctgaatcatgagttcaagtgttcagttgtttattctgacatggaaacatttgcataaattgtattggtagagagtaatcttattacattatccttaaattaaaagaaggcctatgttttccagtattggtcctcatatgtgtatttggcacgaagttaagtgttttatttgtttatcaggattatcaggcaatggttgctcaactggagcaccagttccgtcttgggagactgtcagttcaaggattgtggttcttttgtcaggtgagttttatttactgcattaattatttatcctgatttgattatcattttaagcacagcaagtcctgatgtgctttttggcagaggatgatgagttcattgaacgcacttgctgttctagtcgagaaagctatctccaataacaccagtggttctgctacacttaatctacttcaaagtcaggtatttcacctctgagatacattttttttcttttgcatctctctttctccaagtacgagaatctggtgggtatgaatatcgttttcagtaggctcctgcaatccaagctgaacagactggttttcttatcggcataacatatttctttaacatagccgatttctcaacattcagttttttgttgccttttcattctggtccacatgattagctctttcatccatgtattaaattgctgtactcctttcaacataggcaaaggcaatggctggcgatagtgctgttcgatcattactggagaagatgacagagtgtgcaagtgcagcgtatcttaggatgttagaaaggttcatcatgttcatatcttattgtctttgctacttatcggttcttacattttgtgttgaagttaacaagcattttgtaattgccagttcttaattggattgtagtgttaagacttaagacttgtttagattaaaaacttaattagcttgtctgctgtattttgataatttcagcttctaatgggcttcattttaggtgggtctatgagggcgttatagatgatccttatggtgaattcttcattgctgaaaacaaatccttgcagaaggtaccgaatgacttagaatttctggcctacttaaattccatcgttctctgcattttcataagactagaatactgggtttgttatattcttaagataatcagaggctttctttgattttgataggagagccttactcaagattatgatgctaaatattggcagcaaagatacagtctaaaagatggcatccctagtttccttaccaatgttgccgccacaatactgacaactggaaaatatcttaatgttatgagagaatgtgagtacactgtccaggtatgcatgattattttctgtggttgcatcactagatgctattttatatgtgtgtgttataagaacacacttgtcttacatactatgcttaggttcccttgtcagagagttctaagctgatgggctttggttcaaaccaccaatatcttgaatgcatcaaatctgcgtatgactttgcaagtggtgaactcttgactctaatgaaagataaggttacaattgttcatagcaaatgcactattagatttcattttcttctgtggtctggattctaattttgttttatttaccgtgtagtatgatctcattgggaaactgcgatccctcaagcgatatctacttcttgaccaagtatggagaaaattgtggagaacatttactctattatgtattattactccacatcagtactctttaaaatccacactcgctgggtatattctattaatacaatgatattgatagtgacaatgcatgtcatgttgtcaacttgagtttaaacacatccatatttattttccttgtattagttctccaatttgctttctttgttttgcagggtgattttctggttcactttatggatattgcccgagaggagcttacaaagaaaccagaagaaatatctgttgaaaaacttcaggtatcctgttgtgcagtattgtctgtctgtttcttgctatagtctcatggcggaaactgatttttgactgctctggtctaagctgatccttctccagtgatatgttattccttcttcgttatatgttcttttgaatgaattgccattctatgtttgcagtctcttgttgacatcgcgttgcgaagtacggcagctgcttcagatccaagtcatgaagacttgacttgctgtgtggtaaatatatcatctatgtctcgtcaaaccgtattgtgttttgttaatcaataatatttctttgtctatttttaaacaggaaagaagttccctccttaagaaattgagcaccctgaaagacttggattgtgcatatccttcagacaagcttgtggcagctgatgttgaccatcccatgccgttaagtgtgactggcttggaaactttctgcctgagctacaaggttctatcttctgatattttttattcgttgttctaccttctgacagagaaatgatatgccaactatatatttcaggttcaatggccactatctctagtaatttcaagaaaatctttgacaaaataccagttgatttttcggctgttgttccactgcaagcatgttagtcgacaattgtgtacagcatggcaaattcaacaagtatgaatgaaccttttcttcacccccattatatcagcttaattgttttctgtttactcgttgactgatgtagaactctcaaccagggtttccgttctgtcaaaatcctaggaacaccagtcctacggtcatcaattctttgccgcagcatgctcaagtttgtaaacagccttttacattatctaacctttgaggtaaagcatccatatcaccatactaactgttaccaaaggtgaaaaattgctaaagcattcttttgggtcatcaggttcttgaaccaaattggcatttgatgcatgatcggcttcaaactgcaaggagcatagatgaggttttaacaacgttcttatgatgaagaaagatgtattgcgaaaggggtacattaccattgctgttgatgttgtttgcaggtcatacagattcatgatttcttcctgcagaagtgtctaaaagaatgcttattgttgttgcctgaactccttgtggttcgtcttcttgctcttttatatacagaagtgtttgtcgctgctgtacgttatattttcctattatctgagctctttttggagagaaaagaattaccagtgttgcaacaactttacctcctcttgttccttttaaaacttgttgctttcttgtgaaagctgaaagtaatcactgattgagttcagaattagatttcttgcgatactggcattccagtaatggaaagttaggaactaggcaggtcagtgatcaggtcatctgactgcaagataacaatggcaacttgtctctttactgttaaagaagaaagtcactgtctttaccacactgtgtatccttagcttgatttgtgtgaattatatcacccggtgactagcagttttacccttagccctctgtttcaaaaatacatggtagtttgttttacactgaaatactgtagaagattcaatgtttattttattcttattattagtatatttgtcatgtgcagaaaatcgagaagctgaaagctctgtgtctccagtatgcgacttccatccagctattgataccatccattgatgttgctaagcctgaaaatacatcaaaatctagaatgccaagatcaaaaataaaagaaaccaaaaacagaggccagcaactgaaattggcatcggaaaatgttgtaatgtcagagtcaatcttgtatgattcacatattcagtctttttcacacaatgttaattttgtatcaattgaacatcatatgatacaatcttggactgtttgctgcaggaaattcgaggcagaattcaattcagagcttcaaagtcttattcctacgctgagtaacagttcacaggcagaaccatacttgactcatcttgggcagtgcattcttggtgtgggagttgatcaatgattgctgcgcgccatgttccgcggacttcagacgattgctaagtttgcatgtgcagtgtggaattcctcatccccgtcaaggcggtgttcttgtgaatgtattgaatattgatgaaatatgcatggtatgcttcaacaagatagatagtactgtaggatttatgtagtgttagttctcttggtggtgttgggccgtgggtagtttaggcgtttctagtttgttctgtttgaagattatgattgaactcctacgaagagaaactgccctgtggtactgctgccaccaatgtaacttgaactagatgtgatgaattagtgacaccactaacaatttgtcttgggccgttgtttccttggaaaatataaaatatgtagtggaaataactatcgttgaatttaaaatgggcgtctgatatttagtacgtacatatgatttgcagtagtacattatttcccttgttttccagccacgtgcgggccgtatggtttagggcccctttgaatcgtaggaatgaaaaaactaaggaataggaaaaacgcaggattctgacaggaatgcaggtgtaaaatagaggattgaaaaatacaggaaaaacacataaatgaccgtttgattggaacataggaaaaacgcaggaatcggatgagagatataaactcaaagtaattttttcaagaggttggacctcttgctaacttttctccaaaatccctataggattacctattccataggaattttaaaggatagtatagtattcaatcctttgtttcaaagggtttcataggaaatttttccatagaattaaaatccttcaaatttcctacacttttcctacaaatcaagtgggcccttaagctgaaacggattcgcagctactacaagcctgcatggggtgcccactatcgtgcggcctgcgacgtgttgggccggaacgggattcacgggaacgtgctgcgtgtaccgacggaccgagcgaccgaccaatgatgcggtcaggctgcaacgaaagctgccttgctacctaacgccgcggactcgtccaccagataaacgtcgggtccatctccgtatcacccgcactggatccggactagtggcaatttgcctaattcactccccatacaaagcataacaaatggcaagggcataaaaaaaaagttcaatgtgtttggtgaatgctgcccttttttgtaatgtcaattcgtggtccaagctgcactagttcaagtcttgaaatacccgtgtaaaattcgcggtacatatacaacgcacatatcatatgctattatgcttattaaccaatccaaactcaaataagatgcgattttcttcaagtctcagcgatcaataaccttattctgggttaatatctatactatgctatattagtatctctgtctcactcgactctaacgttacttaaatactactcagcccaaaatataactacttcttatcctaaagtatactccatccaaaaaatacctttgtaccatttgagtacagtttctggctccatcaccaattagcctaccctcatttaacttttactcaatcctacatgaggctgtgctcggaagatgatgttgggaacaaatcttatgtacatgtaaaaaagagtacaactcattagcatatatttaattaagtattagtttaaaaacttaaaaaatatattataataatttttaaagcaacttttgtatagatttttttagagaaaaataatatcgtttaacagtttggaaaacatgagtatgaaaatcaagagaggaaaagttggaaacctacactactgaactcgaacctaaatgatctcccatttgataatgggcatggtagtttttccctttataatattgtcagtttatcctacaaagtgtatttttcttacaccaaagtgttagcgcacatagattagagtccctttgaaatatacaacttttacaaatatacaatatcttcaacattcctcaatagctatgaaatatacaaatcttacaaatatacaattctttaaaattatttattagcaagttaggaagattttaggcctccatagtttggctaaatatggataatacaccattcgacgtattagcaaaatagtaataatttataggtaaaatttttatatatacgttcttagcgatttaaatatccatattgaaaaataaatttcgatcgaaaaaatttcaaaattaacgatggggaccttaatgccaacagcctgcacccttcgttccattaaaaaaataaacttgtgactacaaacctctggcgacgttccaaaatacaaccatcagtaagattttccggcgacggcgttggcccgccgttggatcgcagggaaatccgcgtccggcgcggcacacattacacatacctccgtgctccatgactccgtgtacccacggacccaccattttcctcgccgcagtaccgcaccgacccgcagttagctcacttcccactcgcccacttcccccaccccactctgcctccggccactgccgtctctcccattccccccaaccccaccaccaccgcgaaacaacaagacgaaaatcacacgcggacgcggcccggtcactcactcacacgccgcgggacgagacgaaacggtaaagaatccggcagcagcaagcaggagagcgcgagctcggcgtccccgctccgctccacacgcattgcccgctcgcccgcccgcccgcccgtgagcgcgagcggctggagcgatggggcggcgcgggggcgcggcggtggcggcggcgtgcgggcggtggtgcctggtgatcctggccgtggcctccgcgctcggcgtctccgggccggccttctactggcgctacaagaagggcttcgcctcctcctcctcctcctcctcggtctccgcttccgctgcggccgtcgtctccccctcctgcccgccctgcagctgcgactgcccgccgccgctctccctccagtccatcgcccccggtgagctcacctagtcccttccctcccctcccgtcagatcttgcaaccgcccgttcgcctgatctgcgcgcgcatagtttgttcgataaaaatccaatccgtaggttgaaacttgcagcctgcaactagtgttgtgtcagatcgatgcgggaatcattgcatatttgcagtgtataagagctgaaatcagtactaagtaataggaaaactgaactaatttgcgtgctctctaccttgaacgcttgtacatcgctatcaggccatcactgactggattttgcaattttattcctttgcagggcttgtcaacttctcaacttcaggtttgagctcttccttccttcatagtccctttagctgagctttatctttatttatccaatattcccatgaaatcggttgagtataattgttatctgatggaagggtggtagcattcgtgcttaagtcgtatgatgtttccgggactgaatggtttggtatgcaacctgttacctgtagttttgggaagtaacctcagcaactattttgatgcctgggacgattaacgtgactaattgagtattagggtagctctttcaattattgtgctatgtaaatgtggcactgttaaaatggggggaaatttcatttgttgctaagagcacccctcttcgcatacagataaaaggatgcgtttaaacatttactacacctctttggtgtgtagcactagtatttgttggcacgcatcacactcacagaagcttaggaccaaaaatctgcctgactctgcatactaaccagattttggtactttgtggcaacatattaacagtatgcacctttaagtggatttcttactggtatttccagaaaaaagaaaggggggtatgactcagtgtagtaatttattgtgttgtgtagaatagttagtgcagataaagctaaccatttctgtaatagttttcccctgaaatacttgagcccctaaaattttgtcttgcctggagccctggacctgcacatactgcttttatgatttctcctaacatctttggtacaatgctccattggatagggaaattctctcgtgttgctctgcaagtagttgttataccttttgtataaacgactacattgctccagtctttctgagctgtagctagtgaaatattttcaattcgctccttcccatggttgaatcaattttgttctaccccctttttcgttcacgacaactgcttgatcttattttgttgtacctcctttttctttcataaaaactgcctgaccttgctggtgccattaagcatttgacttgaaacatacaggttgtggcaaaaatgaccctgaacttagtaaagagatggagaagcagtttgttgatcttcttaatgaggagctcaagctgcagcagattgtagctgaggagcatagccatcacatgaatgccacccttgttgaagctaaaagacaagctactcaataccagcgagaggcagagaagtgtaacgcagccacagagacttgcgaggaagctagggagcggtctgaagcggcaatttcgaaggaaaagaaactcacagcattatgggagcaaagagctcgccaattgggttggcaggactctagacctagagtcacaaccatttgatagcttgacatgtcgttgtatttcctttttcttctacaggtaaaattatttttggtagctgctggattgcatcctgcagccaaaccgagcagtgttaattgtacggctccacttgtaatgtatgtctatgtattatcatcagctgtgccaagagcaagaatatcatagttaaatgtaactagtatacatttactcaatgttcggatttattgtgacataccggagatatgctgtggaatgtggatgacacactttgtttatgatgcaatgtacgcaattctagtcttagctaacttaagctatgcttttgttcttgtataacgaagtatataaatggcgcataatgcattcttccctatgatttgttttatgggacattagtcatcctgtgcatttgctccataagtctggttccaaatagtgatatttacatggttggaaacctgacagatagccaacatctgtgttatgttggtcaacagaagtgtattggaacacgtgtgtagcaaacttcattttagcggtgacagatgagttcctgtcttcctagaggaccttagacatcaattcgtttaaaaaatatttacacatttgcgttgcgtttaaaaaaattaaattgttgcgttgtagcaaacatcatcattgtgtgaaccagatgagttagttacaaggacggacaaattctcaatactcttttcaaaaaataaaataaattctcagcaacttttaaagaatggaaccggaacaaagttctcaacgaataaaaagaaaatctccaaaacaaaatggcaaaatcaaataaattctcagcaacttttaaagaatggaaacggaacaaagttctcaacaaataaaaagaaaatctccaaaaacaaatggcacaattcaaaagttatcaacaaataaaaagaaaatctccaaaaacaaaatggcacaattcaaaaaattatggcccatgcaggtctcgaacctgcgaccttcgcgttattagcacgacgctctaaccagctgagctaataggccaattcgataaatttgtgttatttactgtatgcaaggctattggccattatcctctctcgaacctacgttaccctgcacgcttgtgtattttcatcatcgaagccatgaagatcccacgccgagcgtaccggcctctgaatctcatgagccacatctcctcctcctcctcctcctcctccatggtaataacacggagcgtaataaccgtagtgccccacgccgccgcgcctctgaaactcatgagccacatctgctgttcctcctcctccattgtccggcggaggcacaggcaccagatgatcatagcaactcggaacgtaagcgcaaggcacaggcaccagatggtgatgatgacgatgatgataatacgggacgtagtagccgtgcctctggaactcgtgatgagcctgcgcatctgctcctcctcctccgccttccccgtgatcatcatcttcttcctcgagagccaggatctcgaccttcttcccggtcttcttcttgatccgcctcaccgccttctccggctcgaagtcgccgccgcccgtcaccgtcaccttgttctctcccctctccacctcgactttctcgactcctgcgtaagtgtagttggtcgaaatctcaggtaatatgctttgagctgaagattaaataggatgtgtcttttggtggttttggtttgttattaattagttaccgtcgattttctctatggctcggcgaacagatcgttcacaggctttgcaatgcatgtagattctcagttctagtttgatgctctgtacaaggaaaacaaacagtaagacggtgtggttaaacggaaatgatggtggtgattaaattggtgctttggagttcgtccatgtgcgtagtatgtacgagttcgcaacttggaaagaaaacttacgttcgtggagctagcattttcttcatccatgatgccggcctactgaacacggtacggtaagatgtagtatgaaaatcaccctgaaaatgtggaacatgtagtcaggtagaaagcaaattcagatgggcagaagtagtaaaatccataatatggtttcgacattccaatcaaagtcacatgtgaaaattcttcttttttttggataagaagtcacaatgtctttgaaccacaattataaattcccaagcgcatttcatgcagattaaccaaagacatacagtcaatcacaaccaatgaaaactcgcatgctggagcaaaattttcagaaaaatgcataattaagtttcatgcatgcaaagttagctatcctccttcacctggtcgtctcattcatcaatccatgccgatcgcgtgctctctcctggccaccgcaacgcctgagaaaacgcgaaagacctgacaattacacggattggtagaggtaataatctagctgttcttgcgccaatgttcagggaagaaagagaatctcttctattgtacccgctctcgctgtcctaagaattcgatcgaccctgtttgggaagtcgcattgaccatcaaaccacttctcggccgatcccgtcgggaccgggttgtctatttatgaggtggtaaagagtgataggactagaagtgggggagaagaggtcgccggaaagaataacctgctagcttcacgcgatcactcccggccgcagcctaaattcgcgtgtcgttgacaggaggctcctcctctgaaatcttgtggcagaattattcctctgcatgcggttgttgcggcattgttcctctgcataagaggcagcggagacggacggcgtcgccgcttctttggacgggcccgccggcgagagcgcgaggacggggctcgccggagctccgggccggtggtggtagggacggaggttcgggaggcgggggagaagaaggctgtacgtaatgcggcccatggttcctgggcctgaagtagttgtgccgtagcaggaggcccacaaccgcggcgacggggttgggccggaatgggggttttcacggattattttttttcatttttatttactttctaaatgtttttaaaaataaattaatttttcaaagttttgcaaaaatatactcctcccgctataccgtatagagcggaacatataaaacgtcctcctctcctacaataggatggactatgtgacgtagcacaatgcgaaaggacgtaccatggtgattttgcaggcggccctcttcgcgtcctcccaaaggcgatttagtttgcggacattagcaatagtgtgttgatgtataggatacaccatggtaattttgcatacaaccccctccaagtgataaatcgtcttaggggagggataaattgctctagagaagatcagaagagttataaggagccacctacaaaatcatcatgcacgcccctcttgtggagcatcacatcatatagaatgctttattgtacgttgatttatatgccttaccttacgatagaacgggtggaaccgatttatatgcaccacccaacggtaggatggaatgagtttatttcttgtaaaactttgaaataagaatttatattttaaatcttttaaaaaataaatataaaaataaaatgaatcgttctcacgtgtgtgacgtatttttttcagccagatccctagtttggatcgcgattattcgttgctatccttaatttcgcgaagaagccctaattttcgatcatggaatttttcaaaaacgtactccaggccagtagaccaggagtgctattaatcctgtaactttgcaaacgagaccctatttggatctttattattgcttacgatcctcagttcagacttcagagagagccatagccagcccgccgctccccgccgctgcctcttcgctcgtctccgtcgagtccgtcacgcaggtaaaatcccccgccgctgactcgcgcgctgatctcgtgtgtgttttggtcccgatttgggccgagtttgatcggcatgccgcctgggtggtgttgattcgggtggccttccgcaggggatagttggggggatcgatccactggttctcgaactgccatagtacttgctttagaggtagcggtttcacttgtgtgatcgaccaatcagccatttctgctcgattaaattcggccagacctgtgtaaattggggtttacgcgaaccgaggaggtgttgtagctgtgagtattcatgccacatgcccacattgatcaaattatgctcttcaaacacatgaatctactaaatttagaagaaagaaaaaaaaacagaggggctggcaatttcatagtggattcatttatttttgtcatctcatttttctaagttcttaaggaaatgttgtgcaaattaagcagaaactgtaataccccaatgtggtttcgtattagcacctgtttgtgtgacaggagattctcagattttagatttgaggaccatcaatccctcactacttcactagcatctacttgtcatgggataaatctgaagtcccaagacctgtataaacgaaatttctccaattctcatgcagatcgtagtaaactttggtctctttgtttcatccagatcgggagaggtttgacagtgcaatgtaatcgataagcaaaaccgacagatacaccaaatggcacgcctgtgcagcttcttgtttgcaatgatgtgatctggcagaaagaaggcttgttggttgagactgcagtagccttgggcagatacacttgatgatttattgatgcagaaattagtgcttagcaacataatgttgtctgtgtactttattaagctaaatggacaataaatatgctgatacaatcagcatgccattcctcgaaacgaagtactaaagagaataaatatcgaagaggtttttcagcaaatagctatgtcttcctcgatgagaagaggtaggagcattatctttcatagttgtttgaatcgagttattctgaatccctgaatgttgatgaagcttctatgcctaatctgcagcaaacccaggagttagagcagtcaggaagccctggagagaaagcagtccaaggctccaagctattagttttttcaagaagagaaacctgtgaccttttggtgcaatgtcctctttgggagatgttctgcacaacatcttgtgaattgtgatgctagatttcatttcctgttgcttgctttgcttccagctgactgtatatacatataggtgctggtatttctggctctgtgtgcagcagattgcttgtcatgtgctttttttttttcagaatgctctactgattacatatttacatcttcccagaaatcttgtttatcaaagtcagatttttgcacattttttttggagagatcctttgcacattttactcgtctactcatctgacttataattatttttttatcatttcagcttggtttcatgactctcatctagcacaagctcccggtctgactcaagccgagtgggctgggcctgggccgcatcacgcaggcacacgagctgggatgggatcatttggactcttccagttcgcgccttatataatgacctcacgcacgttggctcgtcaatcatcatcggagcagacacgagagcggcgatctcatctcaggcgcaacgctctgcaagtctcggagcgctgccggagctggtcgctgcacggcgagctattcggcgatggatcaggggagctcttcgtcgatgtcctcgtgctcttcttccacgacggcgtctaccgggcccgatcaaagaagattgtcggcggcggcaccgacgttcgacccgtctatggcctcgagttcgtccatggcggctacgacggcgggcgttccagggagctcgccggcaatggcgcctctgcttacctctgcgaggatgtcctcgggctcttccgcaagttccactacttcgttcgacccagcaggatcgtcggcgttggcacctgcgcgctccccgaggcctggattgtcggcgtcggcacctgcgttctacccgacgacggcctcgagctcttccacgccggttatgccggccgttccagggttcttgccgcagattcctgagcccaccgcttcttgttccggtaagcttcgaaaggagttctttgtgtatctttttgttgtttcgaattgtgattttcttcctggttcttgtggatcgatgaatcctttttgcttcgattcccaagtgcttatcttggctctcccgaatcttttgatctttgggttctgcggaatctttcatggttcttgttttcttgttttttttttggctcatcttggctttcctgcataatcaccttcttgttttcttggttctgggttttaactcttcgtgtttatttggaatccttttcttgaaggagacaaaacgtgatatttttttataaaaatgatattagcgatttcactgatgaatctttgagaattttcttggtcctgtatgaaaaaaaatgccatcttttgtttgatgttcggtagtctttcacattttccttgccttagatagtttgctgtcattttatctcgggcagcgattaattatcgtgatatcttgatcagactttcctccggagatgctctggcatcatccttgtggagaacagaagatcaaaggaggacggccggaccttcttggtcgtgagtttggtattcttgctgaacagaagaggttgattcagagacatttagatctgaaagaagaaatgcatttgcgccataacaaggagatcgagaatgccttcatttcggagacaaggctggcccggggtgtggagcaagatctgcttggggactgcaagaaggccgtgctagtgcagcaagatcaatctggaaaagaagaagaaagtcatcagtgcctgaggcagctgcaagacgtcaacggcgagcagcttgtgggggtgccgaagctggtaagtctggaatcaattgaactaccggtaatgttgaataggagggttattagcatgaattgttgaatttaggaaaaaaaacaacaactgcatctggagatattttaaaacataagtacacattacatgcttgagaaatatgcagatttgcaagtgagtcccctacagaaaagctactgttacactatcggtaatgttgaataggagggctattagcatgaattgttgaatttagtaaaatgacaccagcatttggatatactccctccgtttcatatttataagtcattttgactttttttcctaatttttttcgagaatgcgcaaaagatttgcgcatctttgtattatgattagggaattaagtcaacaacttacaaaccaacctgaacagaaaaaagaaacaaagagaaactttattaagtttgaccaagtttatagaagaatttagcaacatttaaaacaccaaattagtttcatcaaatctcattgtatatattatgataatatgtttgttttgtgttgaaaatgataatatgttttgctataaactttgtcaaacttaaaaaagtttaactaaaaaaaatcaaaatgacttgtaatatgaaatgaagggagtgttttaaaacaaggaagaagtacacacttgagaaatgtgcagatttgcaaaattgcaagtgagtctcctataggaaagctactgttaggaagtatagttgggttggcacttacagcttaagacatgctttgctgttatttgtcagggtcttcctggagctgaagaaaacgttgcatgcaacaacactgcttcccataaagaattcagtgaatttccaggtccagatattaaggtatatccatgtcacagaagtgtcaatgtcagatactgcaattcatggcagcttggaaatagtttaccgacattcatgcctcatgctgcttagaccatcttataaaatgctgcaatagtattcaggtcatcttgcaaggatgataaccatatttacgatacgcttctgactgcagtttgggagcatcaacatcagagatataccattgctgcagggaaggcaagctgcagttattctgcccaatcctcagctagatagaagaacttccggtttaactccagctggagccagttccctggatcaggagacagatcaggagctgaatgaaaagcttttgtagtagttatgaaatagttactcagatcgtgctcctgtggacttgtgcagttgtgttgtgctgtacttacaaatctgtcttaaattgggcatttgtcatgctgaaaagaatccgctgaagatagtggtaaactggtacacaaaattctgtcttgaaacacccattaggccattaggcccattagtcagcaagaacatgttgaaggcagtgtcaccctgctgtgcattatataactcagaatagcaagtattctttggctgtttgtactgaacaatagctctggtagctacattctgtaaatttttttgccttctggaaatgaaaatcagcaagaacatatactgtcaccctcctttgtataatgcaatgtagaaaagtgagtattctttgattgttgtactgaacaatagctcttttagctacactgtgcatttttttttgcctctggaagtaaaactatgaaggggtctgcagttcatcagtgttaactgcagcagtgcagcattgtaaaaggtggaataattaattatttgccactcttacgagtggtgctaaatgatttaccactggacccacatataatagacacatgagggtccacatgttatagacagcgagtggcaaataattaattaccaaatcttaagggtggccaaaagttaaatgtctcggaaaaggttgtttctctccctgataggcctataatgtatctgcctcgttaaggcccgtttttctcaggctaggcctggcccaatagccggcccatgctaccatccacgagttagatcgagcgcagcagcagaaggatcccttcccatttcctccaccttccttctcctcgactgactcccaccttcgtcagatctgccattaccgaaacccagcaggcgaggcgaggcgaggcgagcggaccccatggagcccggcgtgagcatcgagtccgggtcggcgatccgcgtggcggtgctgccggtgggcgggccgatctcgccggcgcgcctccgcgactacgcggcgctggtggcgcggcacgcgcgcgtcgacctcgcctcgctgcggccctactactcggagcaccagaagagccccttcgcgcaccagccgtggggcggcggctgcctccgcctcaagttcgtgctcggcggctgcgtgccctcgccgtgggaggacttccagtcctcccgcaaggtgctcgccgtcgtcggcatctgccacctcccgtcctcccccgatctcggccgcgtcgccgccgacttcgtcgacgccgcgcgctcctacccctccgcgctcgccagccgctgcttcgccttctgccccaccgacgcgcaggtaccttttgctaccgctgctgctgctgctgctgctgctgcgtctcttcccaaacctctggatcacgtggttgttttggtagtgcgcggctcagcaaccactcgtgaattgagttggccatttggttgtggagttgctatactgaatacgtgtacctatggcttgcgcattgggtagaacctggcagcttcagagtgttccgatgcttgttactttcgggtgagatctgagtatctgacctctcgatcatgcaatccacgctgaactaatacactgattctattgcttgagagttggcgattttgcatcacagcagctggtctcgtggtgttaattcagccatctatgtgttgttttagttgatgactaggctgtgctcagttttcttgtgatgcattccgctagcatttctatccttaaactaatgtgtacttgtttatatcatcatatgccagtctttcttgcataatcatattaaacttcaccaaatcttgtatctacattccttgtgtaaggaactagggaaggtcatgatttactacgcaccaagcttctatgtagtgttgctatgttgatggattatattcatagctcttgccccaacgttctgatgccagccttgatgaattgtttatttgatcactccatgatctgatgtgattattatttgcattgtttgttctgtagctggtgcagaaaaagagggataatattattatgttccctccttctgatcaacaatcgttggaacttcatatgctcacgatgatccaagacctttctgcttcgctgttgatggagtttgagaaatgggtcttacgtgcagaatcaacgggaactattctaaagactcctttggattcacaatccagtcttggctcagaggaggttcgtactttaggtgttccgagtattttgactagtgtatgttgatgacataatagtacaacatttattgattatatgagataatatgcttccacattttctaggtgattaaggctaaaaaaagaaggctgggtcgtgcgcaaaagataattggagattattgcttgttggctggatcacctgctgatgcgaatgcacattatgccactgcaatagagcttgcaagattaacaggagatgttttctggcatgctggagcccttgagggtagtgtctgtgcattagtggtaagcatttgtatgccttattaagctttgggattgaaagcattccttgtatcagatcatactgcatgatagctgtaatgttatacactgcatattcagtatgatagctgtcatgcttatacactgcatcttcagtgttacttgacataagatatctagatctaatgtgagaaacactgcacttgaaatttccaccagaccccactttaaccccacccaaattttctttgggtctagattctccaatgtctgaaacttttataatgtttaactccaaacaacatatttcgaggacttgttaaatcattgagaaagggatccaacaattacatttccatttctttccaatatgctgagaagtgaaaactggttcattctcgcttcttttcctcacctggttagaacattcccatgacaaggtttggcgataattttatgcttataatcaggttgataggatggccgaaagtgaccctgttttggaggacgaagtgaagtttcgttattacaccattatccagctatacagaagagcaactttacaagacaatgctcaaaggtattgaatttgtcatgtcattccttcacataatgattgctttacccttttacatgctcaaaagtatgtcacgaggcacaaatgaaagaattgaattatttttatcccttttgttttttcttcttagctttgctgaaaactggatagaggattgcactccctgaaatttttacttggtgaatttacttaataaactaatatgtcatttgcacttgttctttttcttccttagagtttcaccagtcagctttgagcttgaagctgcattgaagctggcaagatatttgtgcaggtgagtctccctattattatatgagcagcacttggttagccaggttctttgtgctatattaacaattgatttctatagaatgaaaatcccaatatctcctttggtgcttgagtagattcttatgcttctttagttataattatttgactggaaaaactagggtggaatgggggtctgagattgttgaaagtatactttacttaggtttgttttgtccattgaattttgctctttctttataaggcggcaatgtgccaaggaggtgtcagatttactaatgggcgctgccgatggtgccaaggctctgattgatgccagtgatcgcttgatactctatattgaaatcgcgagactttttggtacacttggttataaacgcaaggcggcctttttttcaagacaagttgcgcaattgtatctccagcaggataatgcatatgctgctatgagtgctatgcaggtcctaaccacaactacaactgcataccatgttcaaagcaggaagaccagcaaaatggatcatggtttgctcaaggtgagattttgagagcttgcagcattgagaattatttccattattcagaatactgcaccatattcatatgttctcctcaacttctccaaacatgcctcgcattttatcaacttggatactgctttactcagtgaaatcatgccatcatcaaaatgtgctttctttttatgctggaaatttcacggaaataaactttgctatgctagtcacgagttaactgcacaacattttgccttttattcatctttatatattagtactccctccgtctcattttaagtgcaaccatgagtttccatgcccaaatttgatcgtccgtcttatttgattttttttataattagtatttttattgttataagatgataaaacatgaatcgtactttacgcgtgacttatgtttttaatttttttcaaaaaattttgaaataagactgacaatcaaagttgggcacggaaaatcatggctgcacttaaaataggacggagagagtagttgctttccttttatttctgttgatgtggtgagcagggtagaataaatgtcgttgacaagaaatataactcaatttaagcattttaggacgggtatcaatggttaagaaagatacatgaaccccaatgcaaactgtattaatcatgttagtaaacattcctgctttattaaagagcatgtgagcactttgccagcatatattttttattttatggtgctcatcttgttataccagaaatgatcattcagatatcattcgtttaatcacacaaaggacgagcgtaattattatattgacaaattggtgttgagtttatattttattttacatataatgataatgacgtatattgaatagttttgcattcatagctttactggttatccttatttgattctggcaatactgatcctggaaaattgcatcctcagtctgtagtatcactatttgagtcacaatggagtacccttcaaatggttgttctaagagagatactgatgtcttcaatccgggctgcggatcccttatcgtcgtggagtgctgcagcccggcttcttcggtcattttacccactcatcaccccagctggtcagagtggcttggcaagctctctttcaaactcagctgataagcttccatcgggcacacgttgtgccgatccatgtcttccttttatcaggcatgtcaaattaatgaatactcttattgctatgtttggggaaacttaaaatagatactgtaggagtccttttattttgttgcaaaactgtaggaactactgttgaatcaggaagaagattttgatcgagcatgtttctttatttgttttctgagtttttatttctggtgtcctttttttaactcaggttgcattctttcccactgcacccttcacaaagagagatagtgaagcgcaatccaaataaaaaagagtggtggactggtggtggtccttctggaccttttatttacacacctttcaccaaggggggaacatctggaactagcaaacaagaggtaaattggattgtgggagagccagttcaagttatggtagagttagcaaatccctgcagctttgacctaattgttgagagcatttatctctctgttcattctggaaattttgatgcctttccggttagtgttaatcttccaccaaacacttccaaattggttctgttatctggaattccaacacaagttggacaagtatcaattcctgggtgcattgttcattgcttcggtgttatcacagaacacctattcaaagaggtcgattgtctactccttggagctgcacaagggcttgttctttctgatcctttcagatgctgtggctctagcaagtttaagagcgttaactttccaagcatttctgttgttcctcctctgccattattagttgccaatgttgtgggcggagatggttctattcttctatatgaaggtgaaatccgtgatgttttgataacactgacaaatgctggaactgtacctgttgaagaagcaaatgttgcattgtcagggaagaaccaagattctgttatttcgattgcccatagcacatggaaatctgcacttcctattaaacctggtggagaagtgacattcgcagtgactctcagagcctggcatcttagcccgacagatttggaagcagatggcagcagatctcctgcaaactcaaggaggatagcaagagaagggagtaatcctttcttggatattcactatgctggtgggttcttggtgcaacattcaattttattagtgcatcgaagtcacatcagtttaacatattcccatccatatgcatccctaccaactgtttttatttatcctagattcaaatgtttcagcaaaacacagtaggaattagctgtaaggaattaccatagcaggatagaaacagataggcaagtacgagtagcttgtttactactacatccgtttcatattataggttgttttgacttttttcctagtcaaacctttatgtttgacctactttatagaaaaatatagtaatattttcaactcaaaacaaatatgttatcaaaatatattcaatgttacatatagtgaaacttattcggtgttgtaaatattgctattttttttataaacttagtaaaacttaaagaagttagactaggaaaaaagtcaaagcgaattataatatgaaatggagggagtatgtgtgttaaagccccttgtcagttgttatttattctcttcgatgatgtttacagtatttctttctctgaaatggcgatgctcactctttagcctgtcttagaaatgcataaccaacaaccttggcctttctaagcataaacaaatgaaatgtggagagtattcttttttaatgatcagttaggctgtctacagtcttgaggaatgaggactgaatttcgactttctgccattacaggtccttcagggaactctgagagcaatgatgtttctctcccacctggaagacgtctggttgttccgttgaatatttgtgttgtacagggcatgcgacttgtaagagcacgcctgttgtccatggaattacctgcccggtttactgatgctcacttaagatctgtcagtagcaaggacaatctaagcaatggcagtgatgcgattcgtaatgacattagcttattgaagattgatccttataaaggaagctgggacctccgtcttctggaacttgagctgtttaatcctactgatgttgttttcgatgttgatgtctcagttcatctcgatggcacaagtgtcgagcaaaaaattcttccagaggataaaacggccagttcggcttgccacaaaactcgaattgatcgtgactactctgctagagttctcatacctcttgagcacttcaaattacctgttcttgacacttccttctttgtgaaggaaaatggaagtgatgaacctcttggatccagagctgccacgttagcagaaaagaatgccaaggcggaactaaatgcttcaatcaacaacttgatttcaaagataaaagtgaagtggcattctgggagaaatagctccggtgagctgaatattaaagatgctattcagacagcattacaggcatctattatggacatactgttgcctgatccgctgacattcagctttagacatgccaaggatggaacaacagccaaaactgactcttcgaaggagcctggtgacggttccagtcgttctgctgatgagagtgttctgaggtgtaaggatcctatatttgctaatgaaatgacccatatggaagttcaaattcgcaataacactaaggaaactattcggatgaacctaagcatttcatgcaaagatgttgctggagagaattgcttcgacgaaaatagcgcaactgtcctctgggctggtaatttaatgatgacattatctttcctgctatccttgtctgttttgacattttgttttctgaaggcagcaaatgatcacggttaaggaagatcacaatatttacattttgattagtttttggctttccattgaaccaatccgttaggttacagtttgtcattgcattctgcccttaatctgttcatctatttactcacaaatgtcctttttggtgcaggtgttcttagtgacatatatctggaggttcaaccactgcaggaggtagtacatcctttttctatctacttcctggtccccggagactactcgctgcaagctgcttctgttataattgacgcaaccgatgttcttcgtgctcgggcaaaggcagagtcgcccgacgaacctatactatgccgtggatctccattccatatccatgtagttggtacagcttagccggactttcttggatttagtctagagcgtgccctgtatcgtgcgtgagtttcgtgacatgtgcagctgcgaagatcatgtagaatttttatgcacatctgatttatttgagccgcatgaaggcttccctgtaacacagttgtgttttgtacagtgtaaaagcatagtgaaggttgtttcacagacgcgcgaatttgctggttctggtttcagcatctcgatgtaaattttttctgtcctacgaagaattccatacgtatgagctctcatttctgccattaagaaatgatggggatttaaaaatttcgatgcatcaatacaagttgaaatccatcaaccatcgattgttacttttcatacgcatggatagtcatttctgccgttaagaaattgttggggttttgaaattttgatgcatcaatacacccatcaaccagcgattgtttaatttctttgcaaacagtgacaaggacaataaggcaaaggtcaagttgtcaaagaaggctgcatccctagtcttgtgatcaaatcttttatatgcttcttttcaatcttttatgtttcttgggcggaggtcctcactggcatgcatttgtttgttgcttgaagtacagcctggcaatcgccttgaagagcaggagcttcaagggaagccttcgccggtgtctgagctactgaaggtttgtgtagaggcagataagaatgttttcaaattactaaccttgcatactgcagtcttatgttttgaaatggacatgataaaagttacgaaatgctctgattgtcttgacaaacttgagcagtggcgaagtcctacccctttttgtccgtgtgcaattgcaatttgtagcttgcacaaaactttcaatgggtcgtgcaagatgatgtgaacttctgacattcctttacttttgttttcatggtcataagtgtgcaggattttatgccctccgcaagttgcaaaaggtagttatagaaatagaacgaaatgaggctcgactggagaaaatcgctaatgttgcaagggcggctcttacgaggatgaacaatggggagacactatctcaggaggagatgaaatcgtaccttgaagaaattattcgtttggctagtatctaaggaactgatcccaggatagtgtaatttttcatcacctctgtaatactcctatgtcatacgatgcgtaatcaaacattgcaaatttgcaatcatatgcccctccagctagatatttggttaactgtttatttcttcaactctataaattagttgtacttataacatgatgcattctgctttaattctttaaagtaaaatattctcgtcatttgaattcagagagtaccagcctgtaggacggcttagctttggtagcacggtaatcaggcttaccaagcttacggagccatcgtttcgcttattcgcggaataaatgaaacggcatatttgcaaacgaaaaataagttgtgaataaaacttttatatacgtgttcttggcagtctagaagtaaaggctggaaaataaacttcgatgaaaaaaacctcaaaatcgactccaaatttaaggttgaaaattaaaattttgactgataaacataagcatagcttttgcttcgtgttcgtataatgtttgaactttgaagtgacagaacgaaacaaacatcctaatcgtaaggcactcgcatagtatagcgctcgttgtgccggtgccgttcacaatcacacacgtgcaggccatgtacttcctagtcacgattactgaaattatctcaaccaaattggggagacgagctttttttttttttgatagatcttcacatcgtcaagcattctacaaactatatgttgattgaatgggaaaacgatcagtacacagacagacatgggcgcagaaacttcttaagattttaagcttgacaagtaaagtcaagtcaaattcctagtacagaaaggtaaactcttgtctagtcaagatggtagacacgagaaagacatctaggtggcatcaaaatctcatgatcaaagctttcagaaccctgaatatctcctcatatacatcttaagcggctgtgaaaaccttcttccctgcaccactctttgaccctgccggaatgaccttcagcacattgaacctcacggtctttgacagtggcctgatattaaacagatagttgagtaatttgtggatttctgggatgaagcacacaaaataactgtactttacttggctaagattagaaaattcatgctcaaacattcaggtttgtattcactgaggtacacaacattcacaggtcaaagtgagccgtcacaaaaacattcaaaggaacatgacaagctttacctgcactggccaatgatcacgtgatctccttccttaacacggaagcacggtgaaatgtgagcaggaatattggagtgcctcttctcgtacctgcatcagcatcaataaaattaattttatgaacaaacagcccaatgaggcattatagaactgatacccagcaaccaggttaacttgcctctggtacttcttgacaaagtgcagataattcctccgaacaataatggtcctgttcatcttagcactatgacatgttccagctatgatacgacccctaattgatacagtaccagtgaatgggcatttcttgtcaatgtaggttcctgcaagaagtagcaaactgaggatatgcagaaacctaagtagttttaacagaggaactctagaaccaggcatctaaagatatcttccaggactagtaaaatgtcaataggaaacaataataggagtaaagatgatctcataagtcgtaactacacaataaatggaaattaccaatactctttagttttagtgaatgctaagcttcaagcctggcaaggtgaaagcatttgggcagctactacaaatgttttaagaaacaatcattcatgcttgtctaccaatgagcacaacaactataaatctgtcttcttaactacaatagaggcaaattggtctacaactagagcacacaggttaagacataagaacaagaaaactgcactgggaactaagatttattgccttaatttgaaaagagattggcatattactgagcgatcatcaaccagggtggaagacaaattcagagagcaggcaaaccatgctgctcctgttcaattggaaatgtgtacagatagaaacagtagaattcagtgttgaaatctaacgcgcaataactatatcaacctggacaaaccatacaagcaaaagatatgtttagttgtttacaagccaagaattaacaggaacataatcagaccttcgatggcttccctgggtgtcttgaacccaaggccaatgttcttccagaacctattcccgcccttgccaggcttcttccccttggtggttttcttaggactggattccataacagatcatgagccacgtaccacaaatacaaagaaacagacgcacaaaaattatgaataaagaacttgctcttaccagagaaaaaccttaggctgcttcaagaatgccctctcagtctgcaaaaacaaatgagcaaagacgtttaatttctgttaaacctacagcaactaataacataatagtccatctaccaatccatctatacagcgatcaaaattaccaccagaaggtaacaaattctagagcttaaacaactgatacaatctgtataatccacctagccatttcgcgctagcatgccattagagactgcggcattccaacagctatgcaccaaaatcacaacgctacgcagaaaaaaaaaatcaccaaccggactgcacccgcacgcactagatcacctactaccacaacgccgctaacgaaacgagatcttaaacacgcatgcaagagaaaaacaaacaggtcacaattgatagttgatacgagcaactcgggaagggttctcacctgctccgccatgatcgccgcgcgaggaagagacgcactggcgcgagacggcggcggcacgggaggagcagcagcggagaagaagaaattcccgaggctttagaaccctagccttcccctggttaaatccgttcactcattacacggtggcgtgaggcgtccaagcagagtgggccgagatgggcctgaaacatctcggtgcagggcctcatgctaacatgggccgcaacttgagttggaaataaataagttcactctaggtccctcattgacatcaagtttgaattaggtcgttaaactaaaccgctaccagatgtaatgcatccctcaacttgtaaaacaggtgtactcgagatcctatgacagtatattgtctgattttagttaacgtgacgagttaattgggatcgatctgggttccatgctgactcagtcggggtgacagtagtcaacttgtcacgttggccaaaatcggcactatactactctggaacatcgagtatacaattttctacaaagatgagagatccaaagtaaacttatttcagttcgaaatgcatcgcattgctggttggcccataactcttaccggcctactactatatttgatgtggactcggttctgcacagcaggaacgtcggaataagttcccttgtgacccttataagtgtcgaaatttaatccgtgaccataaactacaaaaccggatatctcgactcataaaacagatatgcttgtctaccaatgggacataaagatctggcaagacgacagctattggcctaccgctgcgtgtagatggccgcagggtccaacgaagtagcagagcaagcttggaattgagaagaaaacatccctgcggtccagcaaaggcgatgtcgcaggcttgctcgccgcggatcctgcttggtgcggcttggtcggatcaccgatggcggctgttgcttgccaccgcctggctagcgcaccgatgctgccgccgctttgaccctcgccgcccgtcgcgggagaaaaagagagagcggcgaggaagagaaggaactggaggaaggagagagagaagggacacgtgagtctcacaatttcttttgcgtgtcaatgataaatcggtcccacacatatttttaattctaaacgccacctaaacgccatgtcaatcccacgtgtaaaggagacccggtcaataccgctacgtaggcgtcacgtcagcaaaaccgtcaagggagttaaattgcaccggtcttaagagtttagaggtcgagatattcagttttgtagtttaggctcacggattagatttcgatcatttttaagggtcactaagtgaacttattccccgtaacgtccccggagtggggtggtggcccaagcctgtagtatgttttgtcgtactgtagcatctaacacaactacacaagggacaaacaggtttaaaaaaagaaaaaaatatgaaaacaccaggacaaacatcaccagctgcgtctttattgctcttggaattgtctcatcttttgcatcacgaaccgttgcatcaccagctccgtggcagggggatagtctagacatgacatcgtagtagtctggtttgctctgagaagtgagaacgcattttcgcgtccggtgccggtggaaacgaatttaattcctcggcgcacacgaagaaaaaagctacactccagcacgccagaggcagtagcaacaagccaacaaccggacaataaccggtgcgcggtggagcctacggatcgacgacgacgggtgcgggagcggtgtcggaatcggcgagattccaagaaagcgaggttgggcatgggatcttgcttttgcggctctcaatctcaccggtgtttctgcgtgtctgccttttttttaagctaaaacttattttaagaatgatttttttcagcgccaaatcgtatagtgctgaatttaaacatatcagcgctaaattgcacgacgctaaatacacgtcagcacaccgactcatcctcctatctgcggtggcacggcattcagcgtcagttgacgtgggatttggcgctgaacaaaaggatcatttctgaaataagtttgggccactgtttatttgtaaggccccgtttagtttcccaaatttttttcccaaaaacatcacatcgaatctttgaacacatgtatgaagcactaaatatagataaataaaaaaaactaattgcacagttaagaaggaaatcacgagacgaatcttttaagtctaattagtccatgaaattagtctagtggtttttaggcgagttatgaaattagtttttttattcgtgttcaaaaaacccttctaacatccggtcaaacatccgatgtgatatcaaaaaattttcttttcacgaactaaacgtaccctaaatttagttcttgtaaagggtcattgtcaaaatctgtgtgtctgccgcgttgcacttccaaaagggcagaaaggcgagagagaagtcagagaacttgggacaggtgggcgagaccgagacctgccgctgctggcacccgtggccccgtgtgggcaatggaaaggcaggcagacagcgcagcgtaggcacgcatgcgcgcgcgtgccggatcgccatcgatcgatcggaagaagcgaagctttctcgctcggcgccgcccagggagtttgttcaccgacagcatcatgtatgcgccacaatagcggaggacggcggcgccctgcctggcggagaggcccggccgggcgtggttctatgggtgcgtgctcttggtagtggcctgcctggcctgcacttcacactgtacgtttgatttttggttcccttgcgaggtggcaaaagataggtccagcttgttcaggtcgttctcgttcgtttgaaggatcacacaagccattaaggcatgagcttaaacattgaccgatatttttgttggagtatgacaaatagtcaaacatcacgttagaagccaatagcatcatatattgaaaaatgaaggaagtacaaaattgtttagagagtgtgctctataatagttgagatgataaaggctcccatcggatggcctaatcagccaaaaaaaaagctaaaatttgaattttcaagcttaattttgagattgattttgagatattttcaacatagtttctttttcaacattggctttcaagtcaccaagaacacatttataaaaattttacctacaaattcatttttattttctaataagccgttttgacttattaggaaataagccaaacgatggggactaaaggatctaattattaatagaaaatattttttattactgttgctttatttttctcctatcattatgcaaccaagtttacattttataaaatttaagagttgttgttttttttgataatggaatataatatcccggtctttgctcaaaaagaactacaaccaattattacaaagatccactccagaagagagtgtagttcaagacaagttgaacacaccaaacaagagaagagaggacctaaactgagaaaagcaaaataaaatgtggagctagaaggcctcgtcaaggcctaagactgaagttcgaagccaatgcatagaccaatgacaatatccttgcacgaaaaggtttctccaaagcggtgcccccaaggaggatgcgacgtggatcgccgccaccgctcgttcggaaccgaagcaaggttttcacccagagaatatggtagggaaaggaaaggggtatgctaaaacaacacctccaagaagtggaacgacgccaaacggcgtcgccgttgtcagccagccaaatagctcggcaaggctttcgcccgcgattccctgtccaaacccacaccaccaatccgcacaagaaggatcatcttcggtcaacaacattgtcctttcagcgattcggccaaggccaccgcccacagttgttcccgccgtccacggcgcgcccgcacccgaactcctccttccccgctgccagacccctttcccgccttcacataccgccgccgccgacgacgcaccatcagccggatgatggccttcaaccatcgccgccataggtaccattgtcgacagccaccaccgccactgccacagccaccaccgtcgccagccaccaccgtcagccaccatcgccaccgccaccgccaccgccacggacatccccgtccagccaccaccgtccagccgccaccgtcagctaccaccgtcgctagccagcgccgccagacgccagctgtccagatccggccggggtggcacggattagaggtgtagcgcgaagcacgggtcgccggcatcatggaggaaggcgtcacgggcacggcgttcacagcaggaacattgacgagggcgccgcgcctccctcgtggtggcgaggttcttgacgagggccggcgtcgcggcacgcaccgcagtccgccgtcgtcgtcgccaacttcgtcgccgccacatccgccaccatcgccgctgctagccacctccctgccaggtccgcggagcagcgccggcgacgaccgagcccatcgccgatcaccccggccaagcggggagaccagatctggtgacgccgtcgcccgtcgctggagccgcggagaaccgacaccgtagcgccccaccgccgtgcccaactccgcgccatcgccgcgccgtccccgtcgccacgatctcgccgtcccgccgccatcgtcgccacgcccgcgccagagcgaggtggagccgaggaggatggccccgccgccgccatcccaacgcgtcgcccggctttgccggcgacgagctccggcggcggcgaagcatggaggagggaggaggaggggcggcagcggcggctagggtttcggcccctagggtggcacaatttgatggtaatctgaatctctctccaaacaaatagtagaaaataaaagaaaaagaagttgttgttgagttgttgttaaccagagcaatgcccctactctctctcccttctacccagcaaactattggctcctctcaatatcgcacgaagggggcaacaacagttttctgccaaaaaagaaaaacttaaaagttagtgttggttaaagaaaaaaaagggttacatcgatcacgtgatttattatatgttgaaattataggcatataatgatttaatctattccataaataaatcatgacattacagatgaaaactagcatgaacgcatcattagatctacacatgtaaactacacagtataacatgaacagatcaaatatgcgcaacatattgaacacgtaccgaggtggtggaaagaccggctgctcggtcgaaacttttcgcaggcgtctacgaaggcacgcaccacgcgagcgaagaggaagacgagccgtcgcggacgaacagggagcagtcgcgcaaaacgcttcccaaaaaccttattgtcgccttctcccggtgcaggacgtcgaaggcagaggttccggagacctgctctcccgatcgcaggtgcacgccagcgagcgggatggagtaatctacgagcgacggcgcagcacagagtaggaggcaaaccctagattgatttcgcatgtgttgcgtgaagacggcgggtcggtttatatagagaagggtcgcttgatcagggcgcccacacgatctccactgcgcgtaaccgaaccggataagtcacgcgtaacttatccggactccacgccgtttgcacgcatcggatttttcggaacgtttccacgcgcgccgcctgccctgccctgccctgctaggccaggccaggcgagcgagcgcgcgcgtgtgttccccatcttctctccaccacacatgcttcaagtggctaggagggcatcctcccttttaaggaggtccccatctcgtagaataagtaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccgattaaggttgaacatccacctagaactccaagctacacttcttactcacaacttgaacaatggactatgccttgaattgcatgtcttgtgcaagcaagtttcactcagagtcttatctggtactagaccgtctgtagactacccctcgggtggagcgtataagtcatactcctaggtctatagtaagcttcctagaagattcacccaaaatctccatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttagagagggtatagattggtactctcctctagtttactaatgatttgttcttcccagattctaattcacgggatctccgatcacatagactgggttaccaccatagtataactcacatgggtctcaaacccatctccttcgatgcattgtctatcacatttcgtgatagtccctttgtgaagggatctgccaggtttctagctgttgggatgtaatccaacattataactctggagtttcttaatttcacatgtctagacaatttcatattatccttagaactattcactttgacaattaccgtttgattgtcacagttcataaggatagccggcaccggtttttcaacaataggcagatccattaatagatcacgcagccattctgcctctacagtagcagtatccagtgccgtcagctctgcttccatagttgacctcgtcaaaatggtctgtttgcaagacctccatgaaacagcaccaccacccagtgtgaagacatatccactagtggctttgatctcatccacatcagagatccagttagaatcactataaccctccagtaccgcaggatacccagtatagtgaagccccaattccacagtatctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaatttttcttgttcttgcgaagcaacaagctaggatcataagttgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgccccaaatatcagtatgtcattaacatacaagcataaaataactccctcacccccaccatggcgatagtacacacatttatctgcctcattgactgcgaagcctgcagatgtcaatgttttgtcaaatttctcatgccattgcttaggagattgtttcagaccatacaaagacttcaacaatttgcacaccttgcctttttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttgtttctgagtatagcccttagcaacaagccgagccttgtacttttcaatagtactatcaggcctaagcttctttttgaacacccacttgcatcccacaggtttacacccatagggtcgctctgtcacctcccaagtcccgttagcgataatagaatccatttcactacggacagcctacttccagtagtctgcatcaggagatgcatatgcttctgaaattgacttaggagtgtcatccacgaggtacacagtgaaatcatcaccaaaagacttagctgtcctttgtctcttactccttcgaggagcttcactgtcatcctcctcagtgacatgttcatgtgtatgttcaatttgttctggtggtgtgattgaactgggaattatttcagatggttggctcgaactactatgtgtatccttcattgggaaaaagctctcaaagaaggtagcatcacgagactccataattgtaccaacatgcatgtcaggtacctcagatttaactattaaaaatctataggcaatgctgtgataagcatatcccagaaagacacagtccacagtcttaggtccaactttgcgcttcttcgttttggtacattgactttcgccaagcacccccatgtgcgcaagtaagaaagtgatggttttctcccaatccatatctcatatggtgttttgtccttatttctattaggaactctgtttaacacatgattcgaggtcaacaatgcctccccccaccatgccttaggtagtcccgcagtgtccaacatggcattcaccaagtcagtcagtgtgcggttcttcctttcagcaatcccattagactcgggagaatagggaggcgtcctctcatgtatgatgccatgttcctcacagaataagtcaaactcgtttgagaaaaactctccaccacgatcagacctaagtctttttatctttctatcaagttgattttcaacttctgccttataaattttaaaatagtctagagctttgtctttcgttttcaacaagtacacatagtaaaatctagtagcatcatcaatcaaagtcatgaaatatcgttttccaccctttgtcaacaccctattcatttcacaaagatctgaatgtaggagttctagtggtgccaagtttctttcctcggcagcattgtgaggcttgcgaggttgcttcgattgcacacaactatggcacttagaacctttgacaatggaaaacttaggaattaaacgcatgctggaaagccgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagaaacgactactttattagactcaaaaaccaacttaaatccgtctctagttagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgtcctgataagaataaaacaataagatgtcagcacaaacatgtacattggccccagtatcaacccaccaattagtagactgattaactgaaaaaacagtaggtaaattaccatacccgcttccatcttcagtgttgccaatggtcacattagcagacttagaagtctgccctgcaggtgccttcatccccttgcgctgtggacacttcctagctagatgaccaagttggccacacacaaagcaagtcctctcatcctgattaggattgttgttgttcttcttctgcttcttgaagttggtggtttgctgagctttgtatttccctttactcttgttctaggccttgtgcacaacattggcactggactgtccaccatcgcccttagacgcgacatctttttcccgagctttctcctcaacatcaggagatgctatcaacccctcaacggagtattcctgtctcttgtgtttgagtgcagtaccgaaacttctccaagatggaggtagtttcgcaataatgcacccggccacaaatttgtcgggtaagacacacttaaggagttcgagttccttagccatggtttgtatctcatgagcctgttcgactacagaacggttgtcagccatcttgtagtgatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagatagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataagatttttggattgttgagattataggcatataatgatttaatctattccataaataaatcatgacattacagatgaaaactagcatgaacgcatcattaaatctacacatgtaaactacacagtataacatgaacagatcaaatatgcgcaacatattgaacacgtacctaggtggcggaaagaccggctgctcggtcgaaacttttcgcaggcgtctacgaaggcacgcagcacgcgagcgaagaggaagacgagctgtcgcgaacgaatagggagcagtcgcgcaaagcgcttcccaaaaaccttattgccgccttctcccggtgcaggacgtcgaaggcagaggttccggagtcctactctcccgatcgcaggtgcacgccagcgagcgggatagagtaatctatgagcgacagcgcagcacagagtaagaggcaaaccctagattgatttcacgtgtgttgcgtgaagacggcgggtcggtttatatagagaagggtcgcttgatcagggcgcccacacgatctccactgcgcgtaaccgaactgaataagtcgcgcgtaacttatccggactccacgccgtttgcacgcaccggattttttgaaacgtttccaaaacaaaaacgaatccgaatttgcagcaaaacaaaactgcaaaaggaggctgcatagaaccaattttggcggaccattcgacgcgtacatcgtgcacgcgcgccgcctgccctgcccaggcgaggcgagcgcgcgcgtgtgttccccctcttctctccaccacacatgcttcaagtggctatgagagcatcctcccttttaaggatgtccccctctcctagaataagtaaggtggtactaaactccacatgcatgccatcctatgaggtgagcttttgtgattttccaaagaattaatcttcgagtgggctaaggcccattcattaattccaacattatatacataccctgttttatcctcagttgcacaaaatatatttaagcagagacaaaccagtacagataaacagatatacatcgaaaatgatataacaaacaattatcagacaaagaaaatcgtttaggtgttttaattaaataagggtggctgagatgatagtagaatgtttaataggcgatggttaaaagaatagatagtactccactttaagggcatgttcactttgattccattttcaaacttaccaaattttggaaaagttgccaaaaaaaatagttacatttagtttgctgccaaattttagtaactatataagaaatcatgccaaaaatttaaagttgccaaaattttagtataattgccaaaattttggtaatgccaaattttggtaaggttttttttgacatcaaagtgaacaggccctaaaagtacacttgtcgtgggactaaggaagtattatttaataggtgttgaactcttcccgataaatagactcgatgggttcttttctacttctatttcttttcaacttcgacacacttgattttcaaacacacgctttctaaactatcaaacgacgccttttaaaaaatatagaaaacttgttttttttaaaaaaacatattaattcatttttaagttttagtcaatgcttaattaatcactctattttgcatgtagggaggtgaagttctcaacctctacctccgaacacaaccagtgtattagttttgagagctttttatagtttcaattatttaagaatctgcaactcctcaatcatccaaggttttgtttaggaaagtttaagattttagacgtagttatgatcgagaagaaactagcggtgttcaagttcattttcctaaattatacaactataatttcttagattttaggtgaaaatataaagtatttacgagagctgaagattctgggagaagctaatactatcaaaaactcccaaccacagtttacaagtttcttccacaatctacgacttctccaaacatatcatattttcacccagtcttgagatttgtagtatataatatagaaaataaactagaatcagaaggtgtaaaactaaaaattttcagatacttcttagctacttgatttttcaccagcagttccatatagaggcgcctaaaaattgaaatcatcaaccccatgtttcttactctcacataagttgggtgtggctcgtcgtttccaatccgtccatccgagagtgttggcatggacacccacagcccacaggggcaaacggagaggacggagcaaacaacgtccccatcgtttggcttatttcctaataagccaaaacggcttattaggaaataaaaatgaatttgtaggtaaaacttttataaatgtgttcttggtaacttgaaagccaatgttgaaaaagaaactacgtttgtcgaggggtgaccctctctagcgggaggctgtgaggcccccctttgagagttcggccgggggcagcgggtgagattcgaggatttggtgagcgaaactgtgtgtgatcttgatctcggaggctcctctaagacgataaaacaaaagaggtttatataggttcgggccgctatgaagcgtaataccctactcctgtgtgtatgattcttctgtgcttagaaagtccctaaatccctggtatgcaagctagggttagacaagctttggctcagggatcctcagtcccatcccccctcctcgctaggcatggtcctccttttatactctaaggagataccacatgtgttgcgagtgctacctagggagaaggaaaaatattatctatattaattacatgtcttatgccttagcccagaagctatctgcacgtcggttgcttcgcggggcccatcaaatcatgcagggtgcccttgtcattctccatttaatgaatgaggacttccgggttctcgttcacaccagaaaacgggaacccgggtcagttcagagtggttggaccagctctgaccgaggtaagaggctgtgaagccccttatcattatgatgggacgggacggagcacgctgctcgccgcctgacacagggggcgcccaagtcattcaccatttaatgggtgaagacttctgggctcctattacaccgagaaacgggagcctagctttgaccagagcgggaggaccgactccggctgggataagaggatgagaacctctcaccatcactatttgatgggacatgtcaggctgcacgccgcctgacacacgagcagcgcataggcgcactagccagtcccatcggtcattcgaccggtcacagaccggttgagtacactgcacgccgcatgcggcgtggcgcgaccgctcgggtcgtcataaatgcgggtaggtgggcacctgtaggcggacacctaacccaccgtacgtggtgacctagagagggggtcgggggagcccgacccctagtcacgggagggggccatcgctgcccgacctcgggcccgatcccccctcgggggagggccacgtggcgcttggggcagccttctccatctagtctcagccagggagtggccgccaccccaccttaggcctgactccccttgggggagggccacatggcattggggggcagcctcctccgactagtctttgggaaggagtggccgccaccccacctcgggcctgacttcccttaggggagggccacgtagcattggggggtagcctcctccgactagtctttgggaaggagtggccactaccccacctcgggcctgactccccttgggggagggccacgtggcattggggggcagcctccccgactaaacatgatacccccgggcctatatcaccaacaacgttgaaaatatctcaaaatcaatctcaaaattaagcttgaaaattcaaaatttgactttttctttagctgattaggccaaccgatggaagccaacgattttattggttgggggtggacctttcttttattattgggatgtcaaatatttagctggagataaaaatatattcacaccacaaatccgattatagttctatgaaaatataatttctgtatgaatttttgggcttacgctggggacgctccgacacactaggagagattgcgattgatccgtgtgctccgcatcagcaaatgtccttcgcatgcgtaagagtgtaagtggatcagccgcgaacccacttataaatcagcataagcggatttgcggcttattttagtctataagtgggtttcgcgggttagccacttacaccccggcatgcgtgtacccagcagtagcacattcccagcgtttgccggccacacgtcgaccggcgccgcgcgccagcccaactgccgctcgctcaccatccgctgtcatgtgtggatgtgccagcctgattgatcggaaattcggattgcatctcgtacgtggcccggtcgccatgatcatcgatcagactagtacactatactacttctgtctatatacatatatacatagtttcagaatgtgtcatatcccttcaaaatcgtttatattataagatggatgaagtagtatttagacgataatatccttccccaaatcattggccatacatgcaagttggcgtctattaattcctctgcctctgaccggccaaccttctcaaaccacatatacacgcgcgtgtaccgtgtgcgatcgggacatcgttcgggccgatcggttgctcggatgatcagctgggacgacgacgattttggctgttcaaatctgaaaaaagagcggcttttgagccctccaaacgccggctgattgattgacagatcgattcagcgtatgcggccacggaaggagacgatgatcgccgcgctagaggccgagatctgcaacaagccaacacgctgagtataactggagtagtagccaacaactgcaaaggatgtcgccaactgcgtacttgcaactactgtaattgattagttagtcatgcgcatagtatcttagcccataaacggagcaaaaggccggttaatctgctgcatcttgccctcttccttgccagctgccagctgccagctgcgagctgcgagggccagccggaaagcgatcgacgcgacagcgattctgtgtgtttttccgtgggagagacggccaacgacgacgcgacgtcagtcatcggctccccaggctttggagcttcacttttttgcgacggaacagaacacatcacacatgtttatgtttctggcgctgatactactttaaagagagaagaacaaaaggagtttcggaggagtgtccgagcaaaggcaggcatagagctgataggtctattggttctactgttctacacgcggatcaggatcccttgcagtaactgtaacttaaacagtttatatgtgcatcataacatgatctagaatggaaggccagcacatgaagcggtatcataacaaaaatactgtagcagaaatgcactgtacaatagtatgttcatactatagcggtcctctagagctgttagatccgaaaacaaatggtcaagattatgtacagttacagtaacaaatgtatttgatttcaatcctctacatgtttagctgggatttacttttttatagaccgcgggatctcagcaggacaatattttcgataggtttggactaaattttgcttgaatttactgatttaaatttgaatcatcaaaaaccattcaaaaactgccttgcaattgaattttgtcccacgttgaaaccttaaaattacgaaacgcagaggggggataatggtcaggtctatcaaagcaaccataatcagtaatcgcactcataaattacaatcttatactcagtgcccgaaatgaatagcaggtgcgctgaacttttcactacttcataatcagcagtcgatctggttcccgatctctaccctataattttccggttctataatgtcacatcctaattttcgttccaggatttataaattatctaataaattaataatagaatttatattaaatgttctttaattttcaagtgaagttaaatgtgggaaataaaattttctaaatttaaagcatggttggatttaatttttattaaattctccatgattaattatactctctgaaattttctctgattttttttttcagagctcaattccttaatgatacaaagaacagtttagtaattagtaatcaattaatgatctaattataattatgttaagtgcttttcttgtttaaaaatccttaatttataaattgttgcctaaaagggaattattagaaatgatcttaaaagcctagaagagaatatctaattttaatttgttaaatctcaatataaaagtgggctagataaaattttgttaaatacttctcttgtttctatagttcctagatttttctgggatttatttgagccaaggaagtatttttaataaatggaattgcatttcatgaataatttaaagggaaaaaggtttttaaaagtcttcttttggccccaaaaccgctctctctctccctcggcccaagtcggcccaagtcgagccgcccgcgcgcgcgcgtgcgaccgccgctgacaggtgggtcccacctgtcagtcttcgtcttcctcgcgccgctgccgtcgcccgagccctagcgccgcgccgccgtcgtctccttccaaatccagccgcccctttccgtttccggtgaaattaatagaggggaaatgatcttctcgatctcctctaccttttccttttggaatcgatcgccaattcagttggaaatccatggattcgagttcgattcggatcgatctctctcctccgaaccctaaaccttcctttccgtcgccggtcaccgtgggccttcgccgccgcctccttgcccctataaaaggacccccgagcttccctctacccgtcgccacccttgccttcgtctctcgtcgtccgtagcgccctagccccgtgagacctcgtgccgctgtcgtcgcagccgctccagccgtgtgccgccgtcgctccagtcgtcgccatcgctcggggaggtcgccatcgtggtcgccgtcgcgtcgccgccctcgtccacccctccgtcgttgctgtagatcgccggagcaccgccgtcgtcatcaagccgatcttctccgccgccttttcctcgacgccgtcgccgtccgttgatcttccgccgccgttttggtcaccggtgagttcgccgcgtcgctctctacgtgctggtgccctccgttcgtgccgtcgcgccgtcgttcgccggcgagcttgcacgctcgagccgccgccggtggtgacgtcaccgctgacgtcatcgtcgtcgtccatccgtgagccgcggtggatccgatggatcttggccgtccgttttggatggatcaatctcggccgttcgtttccgtgagccgtcgccgtgcacccggtccaccgtgaaccctagccgctgacgcaataattcctttttccttttcaaaaataattcattattgcgtcataattcaattaatacccatataagtattttaatccgatttaatctttaaaaattcataactaattcatcttagctcggatttagttggttcaagtctctaaatttttctaaaattgagatctacatgttaaaaatatccacatgtactgtttatgcttgtttttgtactgtttatttggtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattcctttattccttgataccttgggttattataacttgactagttgagctttatatattggttcaggtagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataatatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacacatggtagacatgatgttgaggctgtgtcttgtgggtacagcggtacacctctggccagagtaaaactattcgaatagccgtgcccgcggttatgggcgggttgagcaatgttttttgtgattagtctcacacctctcacaataattattgatgttatacctggtaataatttgtttagctcctggtttggagttagatctgtacagctgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttatacccctgttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattattagtgaatttccgggcgtgacatataataacattttagaaaataacacggacttcaaaatatatttttgattttattttttattataatatatataataaataaatacttgtttacttttattttagtaacttaaaagacatatatagatctatatatgttgtttgatgttgttatagttcttttaaataaaattattttgaagttattgatagtcagaaaaagtttgccctcactttattcaagacgtaaagaattataaaaccggagtaagtagctatttttttttcttttgggaaatatcacatccagatatgtatggccaatatacataactgtggttcctgtcttaaaaaaaaaactgtggttccttatcatgtggaccataaattattgtaccttaattaacggcggataattaagatgcgcgatggagtcctatataatatctgcgacgatgattgattattataaggccatgcgagtgtcagtgtctcatcgagtccgtttacctgtattgttaacatctcttttattatagtcaaaccctaaaacagtttttacataaagaggtactcccttcattccaaattaatctatatatagttttttttatggtatttctaaataatctacatatttatgttcattcattaagtctattcgttatttatgcattagagtaaatagaaattgatgcatgcatccttgcacacaagtatttataacccatatgcaatatcttgatttgctattggctaggaaatagtggggatggtgcatgcattgagtttgttgctagagtaaatatagtatgagagagttattagcttttcttggtcttagtgtgcctgtgaaatatataaatcaatttgaaatgaagggagtatgcctgtgaaatatataaatcaatttggaatgaagggagtacgtaacaacacatgagttgtacccctggacaccatggtaataatagagtgttctaatgaaacactgttaatataattattcctccatgtggagcacatagatgtactagacgattaactaatggataaatgtccttatcaattatcacagaggagcacgcggcatcatattgtttatgaaaattctgatcttcctttcgtgtttaaggaaagcatattctgtaaagagaattttgatcttttccacggcgcttgacgtacgtagttaaaatgaaaaccataaccataaccattgtcatgatatatatagtgagtttagatactaaactccgttgttaaatattatataatgctatttttttttggaaaaacatataatgtcactgacttttacacaatacatttcaccattagtcttatttttttttaaaaaaaatataataactatttactttgatgtgacttgttttattatctactccctccgtcccaaaatataataagttttagctcttaggatttgttccaaaatataacaacttctccaccaacattctcttcccaaccaatcacaatcctccaccattcacttttcgtacctaccgccactacccatccaattacaaccctccaccactcacttctatatactttcttaataaccgtgtctaactctaaaacttcttatattctgggacggagggagtaagctactttatgcatggcttatcttatattattttcatgtgtacactaagttttaaatagtagaatttgctaaacgccacgtaaaaaaattcaatatcataccttttcaaaatggagagagtaatagcatggagtatgactgtatatgtttaactatatataacgtatctagaaaaaaaagcaaaggataaaaactctaccgcggataaaatcaaatatactttgagggagtaataaaatggagtaattgcaggctctccgtttatgtctgtctgcaattattatccaatatcccaactattctttctgtcacaaaataaatacagttttgtattgttcatatttaacgtttgatcgtttgttttatttgaaattattttatgactaatatttttattattattagatgataaaacataatagtaatttatgtgtgactaattttttaaaattttttcatacacttttttaaataagacggacggtcaatgttggacatggatactcatgtatttaacaatgatgagatttgtcggtgtactatgttgcatgtgcaatattgcagagatgaaatagtcatgtggttgattgtgatgttttggatctcataaaatcctgatgaaattaccacgaatatggtgacgtttatatctcagcactaaaacaataaaggagagtaagcagcaattcaataatgtataattattttgaaatttgcagtggaccggaggtcataggcacatctcaatacaaacatcctgataaaaatgccagcttacagatggataattggatatgttcttttagtaaattgcataagaccctgagtacacccccaagatgtataaaatcagagagattcttacatgtagcatataatcccaaatattatgatactattttgtacaataccacacaattgataaagtctactcaaatctgacatgtggtatgaaactcttagatgctctcacatatgggatgaaactattacatatatgctcacagagtatggtggatgaaagaactcacggaatctacatgtcagatttaggtatcgtttgtttggcttatggttttatggaacaccgcttctataatatttggagttatgtatcaggatccataatctctgagattttgtacaccttaaacgacgatacccatgattcaatgcaatttactttttgttttttactcccttcaggccttcattccaaagcaaaatataagcagccatgtacatagaaccgacaagagtcaattcattaaaatttccatagcaaccatgaaaataaattcttaaactccattgtcagtggaaattaaaaacagacatataaacgagcaacgagtagtaagtgaatactgtactctgtacacaggtacttatatcattagcgtgaccatattattcactctttctttgagctgatgactgggtttcgttattctctcaactttctcaatcattactttctcgtttttcatgtacagtgtattttgccaaaaaaaaagttctatagaaattatctctaccttttattataaaatttgaagatgtttccactgatactatggtacgtcgtccgtatttaagtcagcttttaagttcgttcgtttttaaaaatacaaaagtagtcgtataaaaattccttttaaaaatttcgcatgctaacttagaatgagaagacggattcctaatttatttagaattctcaccaggtcataagaaagcaaagtacaggatgtaaccatcatcctaataaggattctgaattagatatcaatactatcaaaataaaaatcccatatattttttaggaaaaaaaatctaacaataaaacgatttaaatagcttttacccgttacgcacggtcatcttttctatttttattaaaaaaatatatttaattaaatgtgtgctaataaatcatgtcgtttatgcgtacgtaagagattagttcccatcacatttagccgaacacagcacgaaattctatttcgatgggtgtaaagatgacaggaacatagccatgcgcatctctttcaggagcaagtagaaagaagaacaaaacgggattcctcgactgaactcatccacgatccatccaaattctcctcctcaaaaagagaacaaatttttgagtggcgccggctagtctgccaatatagaggccacaggccacagcaaccgaagcagccatcatttctgctccccaagtgagctctccctctcctaccaaaaagaaaaagaaaaaaaaatcctaaaggcagtgaaccaccggccacgtcggcagcagcttccccccattctcctcgtcgcgccaccgccgccgacggggaggcgccgcacgatatatacggtggcgcaagcggcggtgagctagctaggcgggcggaggagaggggggcgtggagggatggccggaggagggggagggggaggggg

SEQ ID NO: 67551 - DNA, 51876 bp, Oryza sativa
gcgcagctgcaggacggctacgtggcctacccgtgggagaagaagatgagggaggcgctcccgatccctaactccagcagcttcctctccatgctcgtcctccccacggcgctcgaccgcgccgcctcccgctacaactccgtcgaggacaccctcgcccgcgccaacgcctggatcctctcctcgcagtcgtccggtgtgcccatctccttcctcaacgtccagaccgaggccctcctcaccaaggttcctcaacagcgatcaaacttgcctagagtaaatgttttagtagctagtaggtgttgtgcgtgacatgcatatcttgcatggtggtgcagatctccggcgagacggcctccgcgacggtcaactcggggtcactggccgacctcccgaacctcgccaacgccagcctttacgggttcgaggactaccacggcgtggacatcggcgtggtgaaggcggtgcgcgtctggtacaccgccgccgccggtgagatgccagtggagatcaccctcgaggccggcgacaccaagctcggcttcgccattagccgcaccgaggaggtagtacacctttaccgtcatgccattcattgcatcttgttaactcgtccttgatcctgctcgtgtgattcgtgtctgatcaattgtgtggatcactcgcgaacgaacagggattcatctacatctcgtccgtcatggaggacgacagcggcttcctggcgccgtcgacgaggtcggggctgcgcgacctctaccgggaggcgaagcgcgcgtcgaagctgctggtgatctccagggtgtccgggcaaaaggtcctcccgtggatggtgtccacgtcgggcgccatccggtgcttcgacaccgtctcgctcagccagaagctgtcgctgcaccggcacgccctgcgcccgatcctgctccacctgctcatgtgggaaggcaagtcggccgacgcgccggctcgcccgcacgagccccgcctgccgcctcagccggcgccgtacccggagttcgccgccggccttgtgcggcaggactcgttcggcggcggcgagctgccacggcaggactcgttcgccataggcgagctgcggcggcagggctcgtatggcgtcgagctggtgcggcaggactcgttcggcgtcgagctggtgaggcaggactcgttcgcgtgcaccgagccgccgccggtgcggagaggagacctgcaggggagggacacggcaggggatacatccttcaggttccataatttctcgttgcccaacaactgggtgtgaatgtgcgattgaaattgaacaccaagggacaagtctcactggttgctgtacatatgtatacttcgatggggtggctttgtgctcatacagactgtggagtgcattgtagtgtgatggagcttacatagagtataattttggccggtgaatagtcttgctgtttcagcgatacttagttcgaacactgttgattgtgttgggaggagaataacagtttcatgtttgatttcaagtatgaaattcattgccatggattgcaaagcccatatctttcaaacacctcgtttggaagttcaacgatactacgtatatactttatttgcacgattactaataccaatttggcacattcaatagagacaacctatcttcattcaaatattccatttggaagttcttttcttcccaaatgcactggagaattgtgcttcatttcactaagaagaaatatttacaattacaaagaagggattcctttgatcaaagaatccctcctactaagaacacatcccaaaacggatcacccacaggtgaggcccgtccaacaccccgttcggaagttaaagagtaaatattttatttgcacaattgataccagtttagtacatttgaagagagacaatctatcttaacaagaggtttgaagcatggacatgtacgggctgtgcagggaacaacccaacagtttcagcatgtgagcctccagcaatgaagatacatatcagcctggactgttgttccgtttgctgatcatatgaattgtaaggttaacgagaaatctgcataacgtctagaatccattctttcctttcagattgattactgatagttcctgttcgacgtagtcgccagcacagattggtggataactatgagcatcggatgcttcagcaaagtggcccaatggcttaagggttgcatcagaagcaatgtgtgcaaacagctatttacataaataggcaaatgggtaagtcaatagttcaccagagcaagtaagattaaattgatggaagtgcctcatgaagtaaatcacatcgagaaggagtggttagcacttacggttgatgaaaccctccacaagcttctattttgctctcttgctaatgctattgcctctagtgttctcttggttaccactacctcatgcattccagctaaacactccccaccagtaagccattccagctgcagttaaagaacataaagtaattcaattggcgagatgctttacttgcttgtgtgttggttcatcacatccaagttgtcagaaataagccccatctttcactagcttacactcccagttttctagtgtttgtgtttcagaaaaggctcaaaatacaaatacaaagtttgattctatgattgacaacagtatcaatttcatggaaaaccagaatttagagatcagaacagaaaccaatatgcatacatatgaccttctattgatgcgcgaatatgaactaattaagatacttgcagtaaaactggcaaagctaacctgtttccctgattgaattagaagacagccaacagggaccttaacttccatctttttgccgttccttagccagatgttcaggcctggaaatctacttcgaccatgtatggtcaggaaattgagatcataatggaacccagcaaaaacagtgccctcagaaccatgccgctcaaggtcacttccagttggtgctaggaggtgtggtccctatgaaaaacacacaaataatcgaccaatgtcaacaggatgaatgcagaatggatctgaataatgcattaaaatgcagcgttcattacataattacaaaaaaaaaaacaactcaatttctgtgaaccaacagaaatatttttagctaagtaaacataatgctgggacctggtactgtttacttgcatcctgagtagattaacaaattacagcaggatattacagattgttacagcattacctccttcatcaaagaggtaaatgcatcctttggcaatccaaatccaactgcagccatctcagcaacaacctatgaaatgacacggccgcttgtatataatacagcaacaaaaaacagaaattaaatgtagagcatgatctacctcaattgcagaaatcattttagaaccccaggaatccatggtctctttccattcaggcaatccatcagggataacaggttccgaattcagctcctaaaccaggtttctcacaagtcagtatagaacatagcgaacgaccacacacaatatgcatatcatttcagatatccacaccaaattaaaaggatcaagcaaacagtctcaaccttaaaacgggtattcgctgggcgaggacccactctccacatataccgccatttcgggtctggacccttaggagtggcgggctgaaactcctcaggcatactcttgatcttgtcttgcatctccttgtcgacaagactgcgaggtacctccacgccttcaggtgtcacaccaaccttaacatttgaaacggaaataaagccagcattacaatagggacagacacgatgttttgtgcctgaattctcatggcgatttcacaatgcagagaagatggtctaacaagtagggtacttttagtgatcctgcctaataaggaccaaatttaacccaaaccctcgcctttgatcccaccagattacctgatagtggaggttggggcgctcctggaggcacttggagtcggcggatcgggcgaagtagtgctcgacgacgtcgaggaagcggtcgttgtcggcggcggggcagcgcgggtccttcaccagcagcgcccccgtgtcccgcaggctggcgctcaccgtcgcgcacagcgcgcgcaccgcctcctcccccgccgcgccgcccccggcgacggcgcggtcgaggtacggcgcgaggtccaccagggggaggtccatcggcggctgctgctgctgcgcgcgcggagagagagaggccgaatcaagtcgtatcgcgacaggattggaatgggggatcggcggttttaagtagtgcgagggggagaagtgggaacacagctagcgagcgagacaggagggacgatgcgtgaagcgagcgagcagtaatccgcgagagggagagacggaaacgcaaaccggggggcgcgcctggataaaaatattctcccagccccccgcggttcagccacgtcgctgacacgagcagtcgcaaaagagaaatcggttcgttgtttttcgggggattttagcggaagacgaggacgagccgcacgccgcagaccagcagcagtcggcctcacctgcccccctccccaacgccggcaagacggcaagcgcacggatcgcgccaatcacccgccctcgccggcggttcgtgcgcaggtcgaccgacgaagaagcgaggggaagaggggaagggaatccgggattaggatttaggaccactggactctggtgtaggcgtgtacagactgatatacgcttgagttgggctgttttcgttttctcggctcattcctcaacgcggctagacggaagaaacaaatgaaaagaaagtctgtcgttcgtccctcgattatagttcgagtatgttcctccttcaaactgaggaaaaaatagttacgcgaataagataaaataacacctatccttaaaaaaaaaagataaaataacaccttgtttatacatatgaaagcaattgaagagcagacaaaaagtgtacctaggaggcagtgcaggggaaaaaaagcaggaattggggcacgaccacgtaggagaggggaggggcaacctcgcgcgtcatgtgtgtcatgacctaaggtcatgaataagattggggataaaggaaaaactcattttcccgcctatcctagaaaatgagtccgaacacaaaatgcatgtcttttgatgaataatatttctttatctaaaattgtcctgtcttgctacaggcttttggtcggtttatatagtccgtaaccgtacatgtgagattacaatcttgtccccattgggcccttgtgagtttacaattatacccttgccatgtcagcaactttagagatattttggtacatttgggatgtcattatagtcttttggtgccagctagccggagtggttgagagtggtcccatggaatcttctcttggcatctttattgctcgagtagtatttttcatctcgggtagtcttttccacctagaatattcaaccactcttttccacttgcttagtccttgatattttacctgtcactagttagaaatgcactcaaaagatattatttagcttagtaacataaacttgtttgaatagtactttccaactcgaatagcattttaccatttcgccacttgaatggtattttgccattactctactcaaatataatttatcattttgccgctttagatggtattttaccatccgaacacttagaaaaactcaagaccttctctatagtgttttggccgaatacgaaaggatggtggtggccccatgctacaacaatgtgagagggaaggacaggatgcgcaggtgtgggtatagcgttgcggttgagggaggtgatgcgcccattgagggacacctaggtgttggttgcggagaaacgcggcctcacgtgtcaaaagagagggagagtcttgcaccgcgagggataccatgatatagttgctcttataaaaagtcttatcatatgctgacaggtagggtccactataggcccctagttgcctctattggatcttgcttctcacgaggcgagtctgcctcagtcatatgccctttgcgtcgacttaggtacggacgctaatgacttgagtcgtatgccctttgcatcgacttgggtacggacgctgatgacgtctactggtcccacctatcggctttagagagatgtgtgtgtcgggttgtggtgggcccaaccaagcgatatgatagtcaaccacattatctgacagcccacgttctcaactttctaggggtaattatggccagttctatagttagcatgtcgcctctcatacgcaaaagatggattggtatccctcgcattaaaagcgagggcagttgcgcgacgtgaagcattgaaggttcgcaccccatcgtatttatggcatagtaggggcccaagcagccacatggctcgggactcacctggtttaaaacaagaaaccaagttcccggtcccacctttcgctgtcgtggcccgatcccacatggcatggttagaaaatccttagagtcctagatagccagtagtggggacctaggtccccactttttcatatatggtacctataaaataacttagaaaaaaatacccgtgcattgcaacgggtgaaggctattttcatcttattattgttcaccgtgaaattcattgtgagaatttgcttagatatatatttttctagaaaatcatgtcaagttagcatgcgagtcttttttaaaaagatttcttatacgactccttttgcatttccaaaagcgaacgaacttaaagcccgactcgaatacggatatgtatttgcaaaagcgaatgaacttaaaaacgactcatacacgaatgacataccaaagtactggcaaaaatatcttcaatttttagaatagtagagattctcttgtctatcattttgtgccgtagacgctttttttttaaagtgtcatggacactattttgatccccaatattattttacttgtttattttcttattgtaccgatttctttaccttttctcatgtagggaaacatagtttgaggctccatttcaaaataactttctagagcttttataatatcctctatctaattagaccaaattttgcaagagatctcacttctaaaagtttgaagaaaagatgctttgcttcaagaaacaaccaatcaagcacaaaaccttagtttgatgccaagcaagatatgcttcttcacttgggtgaaggtaagaaattttgttctttaacactaaataacatcacagaggatatagatggaatccggaaaatacttgatcctattgtgcatatccataacggtgacaccctttagaagtctcttctcagattgagagaatcagttgtgattctaaatcctcttcctcatcaaaaggaaatcatcacactataacactataaagaacattgtagcaatggggactcttgatgtagaacacaagatctatacacccatcagtcctcatcacacatgcaaaactgttggagaaataaacatcttatgtgaatgtgtctttattaaagagtttatgatcaaacccatgagagggtgagacaaagttcattatggagattgtccgcatgtatgaagccatgaaatcagaagtgcttgttttcagtcaatatcttgaaccattgtctttgatcatggacagtggcggaggacggaaaaaaaatacaggtgtggttcatggacaattgtgttagcagtagcacaaaacaagaataaaaagaaaaaaaatacatgcttttagcaatacatcacatgtaggaattagtgatgatagatagatatatcatatatgtagaatctacgaaacaaatagtaaagattgattagtataatatattcgaggttgataagataagataaatatcaacgatctatccattttctgatgatggccacttcttgcttgcttggtgacttgctgctgcaccctccaccctgcgtccaccctatgttgcacgcctcctagcttgccactgtcaccgcctcccatgccatgtcgtcgcgccatcgctcgacgtggatgccacagctctgtgtggttgcacccaggagcctagcagccacacttctcccgaccaacatggttcttcctgccttctcgctagcgacgcgttgcctccgccctctaggctccgaagacttgcagcagccaccaaggcgccgatggggatggagatcgggggaatcgatggaggtggagaatggggaaatttgcctctagattcaatagttaaaagccatgtttacacaaaaacacctgctagcaaatgatgcatgtgcggatatgactcgttcgtttgatgatgcttcactgcgctttgtctatctcggtggtgccttgtctctgcccagagcccggagctgggggtagcgggcaatgaggtatggcgagcgccacatctcgccctaccgagtcctccatcactgatcatggaccaacttagtaaaacgttcgattggactgaaggtaaggagattctatttatgagtgaaatgtcttagttaaaaatcgagtagccttcatggtgttagagtaggcgtcgaattagtcctagtaggttaaaattggacttggagttgcaaaaggttgttgatggtggagttagtgtcggactctgtaactcggcgatcctttaagaagagtggacaacgtcgtaatttaaccatggtaatgacaatgtagtgcatgtgcacaaggagaggatggcggtgaggccatagactcataggagctaggtgtgccatcggtcccatgtattgatgtcgtcattgtggttctagacccggaatccacgttctgaccaaagcatatgtcctatttggatatcgacaagttgacaatgccactaggtttgctactctcaggaacatgtttttctcaatatggtctcgtctatatcctactacaacccaccttttatctctccatatcccctctctctctctctctgtcccttttcatcctctacgtgaagaagaagaccaataacatgtggtacggtgcaatagtggttatcattttagtcaaactaactcaatcaagtcaaggttacgctgatttgaacttaatcgtataaggacaaattgtgagcctaggcagaaatggcttgtttgagtgattcataccattttcattagagcttacactggtttgctactttcctccgttcataaaaaaaatgtaggtcatccactttcatttgttctagttattttaccatttacatgctgatcttttttaggcttatttgatgttgttgtgcactacattgtgctgaagcacccatcggacctgtagagctaacatagaagtccatcataaaaactgaacctcaatctaatcatataatttctatcataaccttctgctttccattgcaatgcaagggtagtttgctagtaaaatataaaagacaaaaaatgatatgggacacaaaagaaacatggtctttattggagtacacttaaaaaaacatatgacaatctagtttattggttatttcccattagatatcgcgagtattatgtttatcatttcttactgattcgaagagagaaactttgctaaataaccaaaattcccttcatttcgtccattcgctagttggcactttttctcactaccgtccattctttctcactgcacttgatgctcccgtgatgctccttctcgttttcttctttgtccggacatagcccacttcacattgctattgtaaagctagcccttttcgaagggcactttgtgtcatttgactatccaaaatggcaataaatgacaaactattaagggcggtgtctcatggcaaagaaacaagaggttaaagtatccattagaaaacccttgttttttaaattgtcctctagcaaataccttgtatttttagtgttctatatctacaatcgccattgttgtcatcaagcgtactgcctgtttactaaggcaagaaagctaaccactacatgcatggatccacaaggccgctccttcattgccacggcccgtaatcaatagttcttgttataccaatgcaatcaatcatccttgctcgcagtcaactagcactagaggttgaggatttgatgaacgtgaatctcatatgtcgattactcaagaagtataagaagcatggttagaacataatagtgcattcttatgtgtaacattggactttcgatttgtaaaaaagtctacacatagcttaggagagagctacaaatcgaacgtccgttggtataaaaaaattcagacggtcaaatgtttcagttgaccgttggtgcaacattatgttatacatggtgaaacaaaaaaaatcagcctctgatacatacaaatattttgtgaaacacaattcgaacacatggtgaaacatatttgttggagaatgaactcctccaccaggggaccgtgaggcccccctttgtgagttcggccaggggcagcgggagagattcgaggattcggtgagtgaagccgtgtgatgttgagggggtcgagccccccaaagacgatgagaccaaaggggtttatacaggttcgggccgctatgaagcgtaataccctactcttgtgcttggtttattgagtgtagaacactagtgcttgaggttgcgagacccaagcgcgagttcgctcgaaagttcccccctccaccactaggtctggacctccttttatacctcaaggggttaccacatgggcccaacaacctaacctagctccggtggagaagtattataatttttgcattaaatgcatgtctggtctcttgacttgggaagccaagcgcacgtcgtcttgatgatggggcctgtcaaatcttgccgcctgacacgaggggtgcccctgtcagtcaccatttaatgggtgaagacttctgggctcctattacaccgggaaacgggagccttgctttgaccaaagagggaggaccgactccggctgggataagagtataagaacctctcaccatcattatttgatgggacatgtcgggctgcacgtcgcctgacatacgcgatggtgcgcctgacatactgggtcccatcggtcattcgaccggtcacagaccggttgagtgcactgcacaccgcattaaatgcggcgtggcgcgaccgctcgggtcgccataaatgcgggtaggtggacacctgtaggcggacacctaacccaccgtacgtggtgacctagagagggggtcgggggagcccgacccctagtcacgggagggggcggtcgccgctcgacctcgggcccgatcccccctcgggggagggccacgtggcgcctggggcagccttctccctctagtctcggccagggagtggccgccgccctatctcgggcccgacccctctcgggggagggccacgtggcattggggggcaacctcctccgtccaatctctgggagggagtggccgccgccctacctcgggcccgactcccctcggggagagccacgtggcattggggggcagcctcctccaactagtctttgggaaggagtggccgccaccccaccccgggcctgactccccctgggggagggccacgtggcattgggggacaacctcctccctctaaacatgatactcccgggcccatatcactgacaatattgctatcacatatgaaacattaagtttttattgtttgaaacatatgtttttctttcgtcagaatatagtcatgtgatattttgttataaagatttaattataacaaattcaacggcatgatcaaatcgctcatcggataaatagtttagaagaaaaagtatttttaagatcactaaatacatgcatacatgcatggtgtggggagaaagccaatcgaatggcgggagagagtagtgacgtaaacatcccatactttttatcggtcatttatgaaacattaggttatatatggtgaaacaagaaaatttagttatcgaaacatttaaatttttttatgaaacataacaaaaacatgtgttgaaacatattgctaccgcgtctgaaacattaaattttaacggattgaaatatatgtttttctttcatcggaatgtaatgatgtgatatcttgttgtaaagatttaattataacaaatataatggtatgatcatatcatcgattggataagtagtttaggagaaaaaatattttaaagatcattatatcatgtaatggatgtatgaagtggatagggagatagtagtttgcccatctgactttttatgatacgtcagacgtccgatattaagcgtttccgcatagcttatgccaaaattaatttccccaagttgcttttgtgacgaagtcttgaatggaatggctgcaccacgcgacactcaggatcgtcattagttagcgtgacaggggtttagagccgcctaaacccctcccaaaaccctaacaacccccctaatccctcccacgggatggctccacaagtagactaccacaaataccccttctacatctcccaaaaaaaaaacaaaacaaaaaaaacaatccccttctacaaggcagcacaccaatgccctcacaaatatcactcgcatagtcgcattacgtgcgcagcgaattaaaaaaaagaaaaaaaataatgaaaatagccagagcgcctcacccagagccgcagagaccagcggccagagggggagggggctagggggctcgctcgcccatataaaaggcgcgggcgtccagccgccaccgctctctacccaagcagcccccctctcgcgaggccaatcattctctcccttcccctccgcctcgcgccgcctctcctctcctcgcccccctcaccggagccgaagcttccccgccgccgcgcggcaggttcgtctcactcgccccccctcccccctcccctcccccaatccgttctcctccccggctcgcgtccggccgaacggagcgcccgcctcggggtcgatttggcgagggtttagggtttttgattcgactccagatcgtgtttggttggggtttagcggcgcgacccgtgttattagggagtcgtttgtgtggccgactctgtggtggggtttggatttgatttggatttggtgggtttggtattttttggcctgggcagggaatatggcggggaagtcgaagggcgcgaggaacaaggcgaaggcgcagggtggaagccaggccgccgtcgcggcggagccggaggtgccggtgaccgatggagtcgaggatgccaagcccgagatcgaggaagttagtgaacctgccgtcgtagagggcagtgacactggcgctgagaaggagcagggcgatgcagctggggaaacacaagccgcgaagaagccagctgaaggtaatggtctcccccactcgatcgtgttcatatactgatactgtatttgtttcttcaaatcagaaactgtgccttgtagaatatagaacataattttaataaagctctggtcttagagagataaatgaattgtgcaataccatcgtgttagagaaatatctgagttttagtactgacaggccatcgggctagagaattaccaagtgtgcagtactaagttttacaaggatacagctggtatctgcatttttagtaattaagtagtttagaacgatgcattttcttttttaaaaaaattgtagggtaaggctagctgagttcaatttatgtggaatgaagaacacgtttaatgctgctgctgttgactttgtttttgcattaatgatgataggtatacatagtatctactgcaatgggcaaaaaagtgtctttagcatttgtaagatgcaacaactgatactttcctgttctaactatttcaaaaagctgtgataagctacaaaactctacctggatagaaactttcttgaactgagacacttgttggaatactctacttatcttattaacagcatgtctctttgtttccacattgggctacccgttctcatttgatcgatcatgaggacttcctatgtgcttagatgtgttattaattatatttcgttctctagtgacttaagttctaacaaccaaccaaccgttttatctcaacaggggaggttcatctctaccctgtttctgttaagacacagtctggtgaaaagcttgagttgcaggtattttatatacaaagtgtgctgtgtctctcagtctgtactggttctgtgtaattcgtatcatgatattacttacagctaagccctggagactccgtcattgatgtcaaacaatttctcttggacgctcctgaaacgtgcttctacacatgctatgatttgttattgcacactaaagatggctcaactcatgagcttgaggactataatgaaattgctgagattgctgatataactgctggtggctgttcattggagattgttgctggtatgcaattcaaaattatcttttttggatcattctcttcagttgttccttttaaaatttgacgcaacgatttgtgttttgttctagcgatatatgatgagagatctattaggtcacatctccgtcgtgtcagggaattgctatccctctctagtcttcatgtatcactttccacatcccttgctcttcagcaagaatctgcacaggaaaaatctgcagatactgcaggtacaacccttggttttgccctatgctgtgtagtttattgatgacattctatattattaggaattttttgcatgtcactgattagtttactaatttacacgcaagttttgatgttctgtcttttctttacttaggagattctgggaaaacggctaatcaagagcttgatgggttgaatttcatggaggacagtactggtgctgtcattaatttgttgccatctgtaccagcagagatcaaatgcgtgggtagcatagttttttcttcatttaatcctccgccaagttataggaggtaactctaatgaccgcatattccgcacttgtgtcatttatttggataccttagaaagattggtcaaatataaggctattgcttagtattttgattctccatggaattcacagtcgttgatcctttcttcagattgcatggagatctcatttatattgatgttatgaccttagaaggaaacaagtactgtatcacaggaaactccaaatcattttatgtgaactctagcaatggaagtattctggatccaaggcctagcaaacaggctctggaggacagcaccctagtcggtctgctacaaaaaatcagtgccaagttcaagaaaggttttcaattgctctcaaatatttccttattatgtcaaatgactactcttaagtttctataacaatagtcgggcaaatcttatgaaggttttcgtgaaattttggatcgcaaagcatcagcccatccttttgagaatgttcaggccttgctcccagtgacttcttggttgggagcttatcctgtgccaggtgatttattcagtacattccctgctcacaatttcattctcttttctgtttgtactaaggttttaatgactatttgaagtgttccgcttctggtatggtcaaatcttaagctagttatgaacatgttttctgccggcaggcagaatggtttgatgtgcacaactattcttatgttgtttctacttctacaactattgtagcgttgacttcagttgatataccccataatcattgccagattcttttcagctgattctgaccttgtctgtgaacctttcatccttcctattttccgtagctctttacgtcgatcttctttgctaattattcttgtttttgggactgctattatttattgtagattactccatgtattttgtctttttgtgtagatgctgtaatatagcttttatactccacatttttgtgttagcagaacatagaagggatgcagctagggctgaagattctgttgtgctgtcatatggaaccgaattgattggcatgcaaagagactggaatgaagaattacagtcttgccaggagtttcctcatagcaatcctcaagaaaggttgttacctacctttgcattcttggattgcctatttatatcatctacaataaatatttctggctattgtaggatattgcgtggcagagcactttataaggtgacatgtgatttcgttgatgctgcagttaaaggggcagttggtgtcattaataggtgtatacccccaataaatccaactgatccggaatgttttcatatgtgagtaagctcaaatataatactatctgaactgttagcgaaacaattcttatgtctgtgagtgttgtttggtttttgtatggaattttggactagtgttatgtgaaatttctctctcggaagggtgtgtgttgcatgtgactgttaggaacttctcttttgcacttgctcatcaggtttggtttgagtcatctggcttaactgttttttaatgatgttttaattcccatttagagatgcttacctatgctcttattatatttcaggtatgtacacaacaatattttctttagtttcgctgttgactccgactatgagcaactcccaaaggaccagaagccaaatggtcaaaatggatctggcagaagtgtgataggctcctcagatccggggtctaagccaaataagaaccatgcagatcctagtggcacaacaaattcaaaaactgaagaacctaatggtgttttggacaatacttctgatgcatcggcagaggcacagatagcagacagtgaacaggctacctatgcttctgccaacaatgacttaaaaggaactaaggcataccaagaatctgatattcctgggctgtataatcttgctatggcaattattgattacagaggtcacagggttgtagcacaggtatgtttcctgattactatatttttttttatgttctactggataccttttttctcttgcacatgttaattgcaataatctttctatattcttctgataagtagatacctagatttatactacctctgtcccaaaatgtagcaatttttagcacagtaccttgtcccaaaatgaagctttttctctacctatactctcctatcaatcaatcacaaccatcctccatttaatttgttacctattttgtcttctcaaccaatcacaactatcatccatttaatttgttacatattttttcctctcaaccaatcacaaccttcatacaatcatttcaacctactctcttaatacccgtgcccacctaaaaaatgcttatattttgggatggtggtagtacccttttagcatgatatatgatttcatacagtttgctgctgatgttgttataaatttgatcattgcattttgttgtatgttgttgtttcactctatccttgtcttagtttctctctctctctctcataaaatgtgtcctgttgaaaatgtttaactgagtttttgtttatttgccttgtacaactgtacttgtcttgtagagcatcatacctggtattcttcaaggagacaagtccgattcccttctgtatggttccgttgataatggcaagaaaatatcttggaatgagtcattccattcaaaggttggccaatatgttccttttagcatgcaaaatattctctgtacaggagtaatgaattttcttcagtatatgggctctcaaaacttatgttctttagttgatggtggtgttatcttgttgctagacgtcgtacagttcacaactaacgagaatttgcaagttaatataaactggttgttatgttaattaagatgatgttgcttaataatgatcatgatgggtgcctgtttgatatattttgattatcagtggtgatgctaaaactgcatgttgtaccaagtatggtgactaaagaactattcttgatatttgaattcttcggatacttatatacttttacttttgtttccctgtcaagtttttcacaagcttatcatgtggcttgttagatgaaaatttaatggtttgcctgacttgtgcacaatttgattttctatcaaacggtaatgcaatttttgatgttagccttacttagtggcacttaatttccactgaagatcattatggaaattggaatagcaagtcaagaaagattttttttttgtagccatacttgattcttggtggtagtgattaaccactctgatcatgttatacagcagtggatgtactctgtgccttgtggtattcaaagactatccttatttcttgatgatatctattattttaggtggttgaggctgcaaagcgactccatgtgaaggagcatgtggttttggatggttctggtaatcctgtaaaattagctgctacggttgaatgcaagggaattgttggaagtgatgacaggtcaaaatctatatctaaaaacaacaatgtgctttttctttttctaaatgctcagtggttcttttgggtgctggagatcctgtataagcttcttctaggtgttttgtgtgtgtgtttgggggggggggggggggagggggtgcctcttttggaacctttataattttgtcaactgcccaaacttgtactcagtgaacacacactacagtgctaatgttgatatcctttattgaataacatgatcctttcccctttttcaactgtatgcattatattttggatctgatgagagtgacccctcgagattctaactacattggactacagcaccgcttctgtgtgttgaggcctgaacttgtagcctcattcattgaggtgagctgatcccgtggtctccctttttctgcaaagaagatggttcgctggtatatgatcagtcctaactatctcatatctttatgtaagcaggctgaatccacaaataaatccactacacagaaagttgcagatgctcctggagaatctaatgggcaattggtaagtacttctgatgctacggttggtgcagaaatttattatggaatactttgtgtttgttcaaaagcattcattcctaaattagtgttacagtcaagtcaaactggatatgctattttcctttataacctaaaacacattgccacgtttttatttctcactttcatatcttcccttattcagttgcatggtaatgatttgtttgtctaaactctaaagttctaacttatccaatatcatgaagcaaaatgattttcccatttttatttaacagtttatgggtgttcaatttcccttgtggtactcatatgcctaaaattctttaaaaaaaatgtggttattcttgtttcaaatatgcaaactggaaacttagtccacctatttcaggctacaactgcggaaggacctgccaaatctgatgaaaactctgttcctagacctgataagtttgatgaagactctggtcctagacctggcacatctgatgacagctctgctactaaaccagctgaacataacgagtcaactgcagaaatcctttttaatccaaatgtgtttacagagtacaaacttgctggtagtccagaggttagtcttagaactactccctgcttgatatccctgctctaatttattgacagcctactctttgctttcttaggagattgcagcagatgaagcattggttaaaaaggttggttcgtatcttctagacacggtgataccaaagtttgttcaggatctctgctccctagatgtctcccccatggatgggcagactttgactgatgtgctgcatagcaatgggataaatgttaggtatcttggcaaagtgagtctctgaactgatccagctggatgtgagttcattgcattttatgtatagtatgttcattatctaattcctttctcaggtagctgacatgatcaagcatttgccacatctacggggttgttgtcttctgagataattgttaggtcggcaaagcatgtggtcaaggtgatagatctatcttaccagctgtttgtttttatgatggaaattctttgcatttatttctttaataatttctaaaggatgagtcatactgtcacccagactcatcctgctgtccattcaaacaaatgttatatggataagattattcatcaaaatgcataactttcctgttttaccacgtttaataagaagtcattggaaaaactatgccaatttgttgaccgtactgtttgttgttcccatcccaggaaatacttaggcaaagcgcagatcatgatattggaccagccattgctcatttcttaaattgttttattggcaatgttttggcaccttccacaaaaggtagtgttgacagtacggatacaaaaacccaaaaggtatgctattccacgtgtaagaaactcatgtcatcacttgtattctaactgcaactaatggctattcttttggattttcaaattggtagggtcatgagaagactcaaaatcaaaaatctgccgagggacagaaatcaagcctttctgcttcttcaaagaacattgtgccaacattttcccatctaacatctgatgggatttggtctaacattaaggagtttgcgaaacataaatatctggtagtggctattgcttcttttgtttccgtagttttctatagatgccatcaatataacactccttttatttagtttgaagtgaccgatgatgctaagactggtgctaaaagagttgcagtactccgcaatctttgccaaaaggtttgctttgttcagctctatattcattgagtttgctattctctttcagagaaatgtttaatagtttggctgcaagtagttccaacaaataattcttatgtgctcttttggtcaattgtgacataatctgcataataggtgggaataacaattgcttctcgcaaatatgacctcgatgctgcagctccattccagccttcagatatcctgaatctccaaccagttgtcaagcattctgttcctgtatgtacagatgcaaggaatcttatggaagcagggaaaatccggatggctgaggtatgtatggagaaaatccagatataattttcccgtgaaatttgtgataacatgttttgatggactcatcttatactgattaatgcttcctctgttgacaaataagtgtcattttggacagtgatatgtacaccaatgcacttctttacttgtatagaacctataaaaaatatatatcatagctaaattgttttgaaactattttgaagacaaatctaaccatatcacttttaatagttgatttgaaatgttcaaaagatgcttgtcacttatttttgtctggagggagtatcctgtttaattttctgtactcgtggattttacaaatttttatacctgcatttcagggaacattgaatgaggcctatgcactattttctgaagctttttcactacttcaacaggtatgcatcacagctatattacggcaaaaacgtggatatttgatttctgacatttatttatgacctttaacagattactggtcccatgcataaggatgccgcaaactgttgccggtaacacattagcttatttgtttaggcatctggcattttctagatttctctttttgtttttatgtacataagtcatccataataaaatctttggattttaatttgttttccctttgactgaaggtaccttgctatggttttgtaccatgctggcgatataccaggagcaattgtgcagcaacatagagaacttatcataaatgagcgatgccttggtctagatcatcctgatacagcccacaggcatgttgttcaatttcaatttttctatagaattttgatcttgtccttgttgtgaagctaaatttcacgttattgatacaaaactgaccgcccatcctagatcccaacatctactagaaatctttaaaccaactagagaatgaatgtatctttgtcatatgtgatattaatttacaacatcattttctttctttcaatttgtgcagttaatatcttttatattaactaaccttgtgtgttattttctttttcagctacggtaacatggctttgttctatcatgggcttaatcaaactgaacttgctctgcgtcacatgtctcgcacgttgcttttgctaagtttagcatcaggtcctaatcatccagatgttgcagcgactcttataaatgttgcaatgatgtaccaggatgctgggaatatgagtactgctcttaggtatcttcaggaagcactcacaaagaacgagaggcttctaggaccagatcatattcaaacagctatctgctatcatgcccttgccattgcattcagttgtatgggtgcattcaaactttcaattcaggtcagttcaccagaaagatgattggtaaaaagaatactttgaaaacattgatctcatgtattgattctgatggcagcatgaaaagaagacctatgatatactggtgaaacaattggggagtgatgattcaaggactaaggatgcagaaagttggttaaatacatttaagtcgcgagaacagcaggtataagtttaaactgtatttggatttgtgatacttttaacaagcatgcaacatgttttatgtatggcatagtattgtagttttgtattttcttaagaaaatgtatacggctattttttatttggtcctgtatctcttgtacatctaatatactccctccgtttcacaatgtaagtcattctagcatttcccacatttatactgatgttaatgaaatatgaatgtgggaaatgctaaaatgacttacattgtgaaacggaggaagtaccaagtaatgcaatgcaaaacctttgtgtaagaaaatcttccattctgctttgcatacctttatcttcatgctggatccggttttgcattgtccatcgaagacgtaactctcattttgctgtacaggtgaatgcccagaagcaaaaaggtcagcagggtactaacccacctgctaatcctattgagttgttgaaggtaagtttagttgctgcaatcttgaagtctttaccgttttgcctttgatacaaccctacaattccaggagaatagatagccgtagactcgtagttcctttttagcttgtcataggaagtacagagtgaaaacctccttttgagaatctggcaacattagtgttgcatcagatgatgttgattgaattgactggcagtatgattgaattgacattctcttgttttagttatggaagctttttgccccaatatttgtccctatattgtttgtttgctattctgtacatggattaatccctggcacgcttggtcgtttgaaggtgatggtacattgccacttttttttgggtttctccttgtcactgttaacgaagtatatgtatatggctattagacatctcagtattttgtatttggttcttttgacatccagtttttaccttatgatttgacaggcaaatcctgatttggtgagagcactgaaggcagctgcgaaacaacctggtgaaggatcagcaaatgtcaaccgatcacttaatgctgcagtagttggtgaaggtgttcctcgagtaagaggagttgatgagcgggctgctcgggcaactgcagaagttcggaagaaagctgctgccagaggccttaatgtgcgaagcgggcaggcgcctgattacatgtctaatctatctcaaattctcaactatctgggctcggcgaaggcgcctactgcttctggtagcactccagccactgccgctgctacttccgctactgccagcactcaaaatgcatctgaaggtcagcaatcgaatggacccccacaaaacggcactgcagggaataccaacgggccatcgtctaaaaagtccggtggttccacaccagtaggattagggacttccttggagttgaagaagcagaaatcaaagcagaagtcatagaaagtaacatcagtggtaggtttatttccaacaattttggaattctagggtgctttgagttttttacccacatagaattgtcacgccagcatggtggcagagtaattttgtttgttttttttgaaggggttcttaggatgagttcaataataacaaacgagaatgaagtgaaacaattgttgtgacattgatagactactgatgatgagataaaatgactaagcattctgccttcacaccagaaagctgagtcaagttcgttcgttcataaaattatgtcgtttttgctggaatcgtatttcggtactgcctagcttagttggcagaaaaagaatgtccatgatttggtattgcctatttcttcatgctttttggattgtaggaccattatccagcattggactgtgtcagaataacagtttcatcttcttgaaggtaagaggtagtacaacgattttgccttcttcaaggagatgcagtacgcaggcaaaatgtgctacgctaatttcgtttttgtgtacatttgctactgaataccatatacactaaaataatatatacatgcaagtaaggagttacttttttaagtgtcacgtagcaaaaattatattttattaaagatcatgttttttttttttgtcgtgtatcaagatttggccacttcaaagaagagatgatgacgtacagtatctcataccagaagtttttttttttacttcctccgtttcacaatataagttattatagcatttttcacatttatattgatagtaataaatctaaacatatgaatacgggaaatgccagaatgacttacattgtgaaacggagggagtagcaaattttgtcacttcaaaaaagggatgatgagggacggtatcccatacctaaagggctggaacaagatagttacatttgctgctgaacactatcagcattaaataatagagagtacaatttattttgagtgccatgtaacaaaaatcatattttgttagcatgtgttcggtttggggatcaagtgggatgtgttaggtccatcctagttttttttaggatgggatggtttcatttatgtgttaatgatcttttttttttagtttcagaggatgtggcccacatgtcaagaggaagtggattagattgatccacttttgagggatggagctaaccagatctagagggaattcctttaacggatcattccacttgttccaagccaaacactatgaaaaacgagttctttataatccaacccatcatatccctccaactaaacgcatcatcaatgatcatgatttgaaaggaccttgatgtcgcctagagggggtgggggaggggttgaataggcgttcctaaaaaattaccacaacttcatagcatattagatagatgagaactttcggttcaaatcggaacttttggtatgggattgaaagttccgatctcaaccgaaaggttcagcggataacggaataaaacactagctatggacttgtagcacgaataaacaaaatgtatatgaatcaaaaggtgacaaataagatatctaagcaagatataaggtcaccaactatattaattaagcatgcaagtagatcaggcaaaaacaagctcaagcacaatatgagagatggcaagaacgagcaaaccaagagaggagacacgttgatttgtttcctgaagttcggatccacggatcctacgtctctgttgaggggccacaagggccgggtctatttcaaccctttcctcacgaggttgcacaaatgcactcattggtttcactcttgattttcttctcttgcggaggcgaaagcgaagccttcacaaactttccgtggtacaccacaaccttgggtgctcaccggcgacgcctagccgtctaggagaccttagtccccaagagtaacaaacacaatcgaagatttgcttgctatgaactcgagtgctcaaagtatggagtgaagctcactagctcttaacttctcaatctctcaatccaactctcttcccttctcaaatccccctcacaaaaaggcaccacaaaggatgggaaatggggatagctatttgggtttggatgtatctaatgttgcccaagaacagcagccactcataggaggggtggaggagtttatatacccgagcccctcaaaaactagccgttggaggcaaaagactggaattttcgaaacttacgaaaatttacataagctaaactcagttttgcaaccatttttggaacttccgataattttcggaacttccgaaaagcacagagtaaaacgactataacttttcgctcaggagtccgttttttatgatcttggactctatggaaagctcactcagaggacgacccaactcaaccaaaaacaacgcctaaagccactcaaaagataggttaaagcttgggtttctcttaagcttgggtcactttgagcaccgagacatacataaacacatcgacgttgcatccctcttaatagtacggcattcctaaactcaaatgtaaataggaagagaattataccaataggaatgccttctttccatctttctttcattgtctttagggacgccaatgccataccgtttcaccatatattcttcaaatgattaatgtggttacttcaaatggtccatcatgacaaagccgtcactcgtccttcaccaccggatttggttcttcggcgccaagccccttgcttgcccttcaccgctgcatggtccatcgcgaccgagcatcgcttacccttcaccgtcttgccatagtagccacttcgtatcccacatcttcaatatcttcactttgtcattcttggtatcgttaggtgtaatgatatcacttgagcatcaacacctttgtaatccttgggacctatttctttcattcaactcaataaaattattagtcccaatgatccggttgtcaacatccacatgttgaccaaccgatcgcatgtataaaaggatataaataaatgatgagtatcaatcaacaccacaagtgtcatatctcaaacatatgctcacatgtaaagatctcaattaaatgaaatttaataacttggatcaattacatgcataactaaagtataggatttgctcccccaagatgtatgcatacaaaatgtttgtgtcaatcaagagtatgcataaaaagaaggaaacattaggagctaatcctatataagaatagaaggcatttgtcaaatataggcattaaaataaaggtataccttcatcatcttcatgttctcaatataaagagactaaacaagagaaaagactcaaacaaaacattagtctcacatgcatatgtcaatcacgtggaaatattatatatgaacatatcaatatgtatatggagagaaagagtgatacacatagcttgatcttcatacatttcatccttgtgatttaggtccaccatcaatgaatgattctatctcaactcatatgaagtccgggaatcacctctcacacactccactttcatatccacatgagactgggcaaagaaatgcttataaaaacattagtctcacataattggatttgtcattaatcatcaaaaccaaattaatggctcgaactttcatgatttttgggtgtccataacaaattttgccatcttcaaagaatagatgttgactgttgagggacttcccataccttaaaagggtggaacgagatggttgatattataatgatgtcaacatatctgatttggtcttacatgtggtatttgagtggtaccagatttgatatttaagtatcagacatggtactctagaaaacaaacgtgctacctatgtattatggcctgatacctagcatcgctagaggcgaacgccgtagtacatgcagagagaaatgatctcatggagtggcctggcacaaagctcaagtcacccaatatgcatgcagagcgccttgtcacctatcgagcagggtgcgccaccacgcgcctttcctccctcgagttcaccatggtcatcacagccaaggaagaaactactgtcgcttccacgaacactcgaacataacaatgtggctcgatggggccgacctggatagagcatggttacacgggaagtctttgaggcaaaccgtcgggcaggcagcatagggcacggtgatgatgcgtgggaaggcgacggagacgtgtccatgaagagatcgctatagtggaggtatgcctgcgagcaacacggggaagaagaacgtatcacttcgttgcataatttatcctgtctatatgtcccactttcttaagattttcgggtgaatttcactttgggccctctttttttttcactttggaccatttctagggcatgtttggatagcttaggattacaaaaagcaactagttggtattccctccgtttcataatgtaagtcatttgtagcatttctcatattcatattgatgttaatgaatctagacatatatatctatctagattcattaacatcaatatgaatatgaaaaatgctagaatgactcacattgtgaaacggaggaagtagctagcttccgagaatctaaaaaactaggttttctagtttctagcttctggttttctagtttctagcttctagttcattttttaaattatgcaactatagcttatcagaatctagacgaaaaactaaactatttgagaagcttttgattctgggagaagctgtagctatgagaagcttcccaaacgagctagttcagggccagtttggtttgaggcctaaattaggcttgctaattttttggcaacctcaacaataattgtgtatgtttggattgaagccaaattttggcatgcctatataacataggccatttcaatagccaaattagttaatttggcttcaatccaaacacatgttggccttacctgtcatgccaaattttggtaaggccaacattggtcacaaaccaaactggccctcaatcttttcactttggactagctaagtttatgtttatttcactttagatcacccccaaacctccactttaacacatcaacgacctccaggatgttgactgtggcacgctaatgaaatcctccacctaggatagacatgtctagagaaaagagtcggcatggtcaaagtgtaacaaactaaagttagataatctaaagtgaaaagattgaattaagggtggtccaatgtgaaactaaaaggtggcccaaagtgcaccgcactctagattttctgatttcaaacgggaggaccagtatcccagtatgaaaatttcagtatcacatgatgttcgaggctaggaaataattattgtgatttatgatcatgagaaagcaagcaaaaccagatgtttcaagcatcgtgaaggcgtttattgtgatcgatgatcacgataaagcaagcaaaaatatttattccgagactgttgtataggtctctctcgagcacaacaatgccaaggatttgcaaaggagctagtacatcaacaaaacagacatgaaagtaagcatcagcttcaaaattcaccgagctgacggttttgcaggacttgggctacacgtacagaacttcagtcaatgagcgggcttattctcgactgtgtagggatagtactctttgccattgtccactctggtagtgttgccgccaacgtccagcgcagcagatgtaaaagccaggcaagaaccagctatgagcgcagaagggatgctccttcctgccaattgggcatttccagattaacagacatgagtctttctagccaatatactgaactataaaattactaattgattggtgaaataaagacaagactattacaaatacgatcattacatgctggcttcgtagataaccattgattgatatgcagaggtaaaaacaaagttaacagttcgtgagatgtctgagtactacccctttagtaaaactgatacacatggaacagctgttcaggtacaaagcaagaacatactacgcacagcagaaaaatatcatggggcacctgttaagaatcccctataaaaattttcattgggcatcaagtgtttgtaaaatctggattagtcctacttaggttctttgtttgcaataaaaatacaaccaatagagcatccgaatagaaaatgatcaagccaatgacatcataatatcattctaaagcacattgtcagctgatactagccaatgacatcataatatcattctgaagcccatgacaccacagctttgtctactttaccacaagaaaatgctttttttttgggttgaatggtaaacatatgccattattcaaagttgtctctaacttgtttcataacagttatctcgtgatgctaatgagttccataagcctaactggctgttagatctagtctagcatcatctagaagaaattattgcataagataaatatcttattaacctcatagcaacctcaatgcaagattatcaggcaaacaaaagtacttttatggtgaggattagctcatgctcctgaaagcatagcctgtttagaatccatcttatgtttaaaaaaagggagcaaaaatagtgtcaaatatttctaacatatgtttgacccgtatctgtccacacaataactcttactgtgtagtcaccagaagccaattgatataggagcacaaactatgccatcatccaaatttaggatgaaccaatccaaaatgctccaggtatctaatggtggttccttgatcaatacaccttaggttagtcacatgtttgtccacatattttctgtgcataagcatgtgactagcaacctatatctctaccacacccaccaaaaaatggtcagcctagtatagcagctaactcaagcagtcaacatttttgaacgaacgtgttcaatcctagatggaaatgattctcatggaactattgtgcatataaactgtgtttaatcctaaaagttttgcgcttacgtgtagaccttagtgatacaggaaccagcgcgacgatatttttcaataagttaacatgaccaaggtaaaagggttcctatatcttaaggtaatagtgttgatgatctatggaacacgaagtaaatattattgaatcatccaatttcaatctaagtagaaaagtccataatgtaaataatctagctaccagttagggtttaatccgcctgaaaacacacagaacacagacactagcaagtgtgaatgaatgcaaacgtgaatgtgttgaacagggcgagcagcatcagctaacctttgtagccgaatatggtggcgccggcgacgaaggcgccgacggccccgttgacgtagtcgttcttcttgcgctggctcagcacgagctgctcgacgccgatgtagaggcccccgacggcggcgaacgtggccccgtagctgccgcacatcttgagcgtccggatgagccccgggagcgcgacgtggcgctcgacccggggcacgtcgtgccatgtcgcgacgaccgtgccccagatggtccccgcggccagccccgtcgccgcggccttcaccgtcttcgtcaccggcgtgtcctcctccaaccccatccctcccttcccaacaccaacccgcccgctcctctcctctccactccctgcacgaacagtaacgtgagccaaaccccctagaaacgggatcgagatctggtcgatctgagccggagcgacgcccgcggcgagcggcggggacaggaggcggggcgatcgagcggaggcgacagcgcgtggcttacctggggggaaccctccgcggcgcttgccggcggcgaaggatcaaaaaattgttgggattttcgggggcggaggtagtgaggtaaaaatgggggaatcgcggcgtggttggagaggagaggagagagggggtgggaggggggacggggcggcgtggtctcactcggctcggcctcggcggcgctcgcggctcgcccgctcgcccgctcggccgcaacgttggcgcgggcttgagccttgggcctcctccctacgtgggctgcccacttcggctcgcgcgtggcttcacggcctcacgggcctttcactcgtgtcacgggcctcacagccatgactgattcgtacacttcaatgaaactgagtttgtatgagcataagctaaaatatgcagtagaaaccatattgaaaacctaggtattattataggatataaaaatagacgtctcaaatttatccatatcattataagtaaaaataaactcacgatgacatgcacaaatcttaaacgttcatttctttttcctacaatagttttaggttttcacaacatatctatccgtataagttgtgtgcctcaaaattacgtacttttatccatttgattttaagatctgtgcttaactctatctttttctttctttatgcttaactctctgatctctcacgcggaggtaactgtcaaatatgtatgcggagtgttccactgttttggcatggaaatactatgaactttggaatagtagtatggcagtcaatcatggtggtttttgcagcacgtggagtcccatatctatttggctccttccttgggtagccgtcaccccgctctcccccgagatgcagagttgcccaatgatgccgcgccggggcccgaaaccggtggagacgcagacgcgggaggtggcggtggcggcccccggcagccgaagtcgccagcgatccatcatgatgtcgcgcccgcgaccgcgcgacagcatcacccagacacacaccccgtattccccgttccggctgccaccgctcgcggccacgtcccgcgccgcgccgcgcacgtccctgccactcactcccgttccgagagaccgccgtgccgaagtgccaacccaccgcgggcggggcatggtgatctcgccgtggttttcccaaccgtctacgcggcgcggtggcgtccgtggcgtgcggcctctcttccagtcacgagcggtaaaaagtggcgcggctttgccgaaaaggccccagccgcttggcttgcctgccgcccgctcagctcccgcgtcccgaccggagacgacacgagggcgggtcaaggcgaccagacgaatcggcgcctctgatgaatcgcgctctgctttcctctgcgctgattctacagtgaaacctgcatcgatgccacgtctccgtgccaaacctcgccgtgtcttcggcgtggtttagttcccaactttttcttcaaacttctaacttttttatcacatcgaaacttttctacacatataaacttctaacttttccatcacatcattctaattttaaccaaacttttaattttagcatgaactaaacacacccttctagctctagatgattatggtgcgcgctcattgcagcctgatgccactgctgggcatggcaaagcgaaatgaccgacgagatgcttattatacgttggatctgtcctcaggatcagcacatgactggtaaggttagtttggtgctaccgtggtggtggcccattaaccacgtttccaagaccagacagtgcttgctttaaaaatactcttagccactgaaaccattagcttagttttgacttctacacttaacgccctcggtttatttctcaggtttagtactcagccgacacaaaaacgtttgtaaatacggcgctatcaaacagtgatacaattcagatgagtttataccaaaaatattctatttttgatgcaaaaatttggtttcgaagtactcctgatgcaacccaaccccgctctacatatataatggtagaccaaattcggttttacacttgtacatatatacataagcaactgtactgtgctgtttttctcaagtatgaatgtgaaatatgacagtatccaaatggagataaaaatgtttagaaatacagctctaattaaaaaacaaacagactggattttcactactcagaagataaggtaagaacaaacctatccagcgttgccaggctaggaacaccgtctatttagcaactaaactgagctgctctaagaggcaaagagaatcaagattgcaggaatttctgctaatatcaccagctgttgagagctctgctacaagcaggccaaaatagtattcagcttggaagagcagctgaacacctgttggtgtacagtactatcagttcatttgttttgcctcaacattggcaaaaccctgagcaatcagtacataattttgcttacatttcgcagcattgaggaactactgaagagaagacgatgagaaaaaaaaaatgaagtctactgaatactgaaaaattgtgtagatggactcacttgcattctagccctgcctccgctgctcgcctgggcttgtttttgcgccggcttccaatctgcctgaatccattagtcctagttgattcatcactgcttgatcgaacactggaattactctcttccaggacaagattggagctttctttcagctgcctgcctctcttgttaccagcagcagatgcagtggtgttcttgtctagccttgatgccttcagcttaacatcatcaccttctacttcttcgccatcaattacattgtctacaaaattttccacatctacttgatcaatcttatcggcgaagcgcttttgtggccttcccctcctctttcttgcaggcatagcttcttcagcgccgcttcctttgtcttcatggctccggacaatcgttagcttctttcctctgcctcttcctctacccatctatccaacttagcagtgacaagatttattcagacaatcactgaagctgcaggctctactgaagttgctctatgtttttctctagttgctatttggaaggaaagtactcaatatttcaccgagatacctcgcgatggcgacaatccaatcaagaagataggctagaaatctgcagtcgtaataccaagaacaacatgctgttacatctaactagttcatgatgaaatgggttcttggggtgcagaagcaataaagtttgaggtctattgagatccatatcaataaagaagttgcaaatccagatcaagcaacataaatatccagatgaaaactatacaaaacagcaagcaatacgcatctatcaagataagtttaacaaaaggattttttttttcgatagagaacaagaaacataaaacaaggaccgattcaatatcggaaccattctttccacggatgacaagcaagaaactcaccttccatatagctggcgtccactccaagcagcatcatgcatcccatttcttcatgtttggtagccaaaaaagatggaatttttcgcaggtgctacaggaaaagaaacgctgggtatccaatggatcggcggtaatattcggtttgcgatgccagaagtacccgcggatcgggaggtttcagcaaagattgggatgtggtgttcaggaagcaggagaggactcagggctctacaaatgaacaactagtgctctggggtctgggagttctggatggttgggctccaatagcttctggggtagcagcagcagctgcactggctggggtttgtgtgtgtgagagagagagagagatttggttcttctcatgaagcttttttaatactacctacgtttcaaaataagtgtagtcgtgaatatccatcttatttgaaaaatttatgaaaaaatttaaaaaattttgttacacataaagtactattcatattttatcatctaatagcaataaaaatactaatcataaatttttttcaaacaagacgaacggtgaatagtgcaaaactgcacttattatgggacgaagggagtactgctactcctgtactagtactactactgaggagtcatttgctgtttgtttatgcttttatttacagcttaccaaccgttgaaaaatactgagagagagtgtgtgttcttggcttcttgccattttccagattaaaaaagcaaagacagaaggatccctagccctagggaagcggtttacttttaccatgatgggatttttgttccatgtttctggatgtttaaacacctaggacagccagtagtaactcaacacggcaacacctgacaccctgacgtccaaggtcattttgctttcaaagcgatgccacagttctcgattggctccagcttccaggcgagcaatgctcctgtactgtacaggtgtttatttcagatagagatcaatattttgttcatggcctttacctaagaaaacttcgtgtttataattcatttgaacaggtcaacacagtttttgttcatctctactccgtactgtgcttcctagtgcaagtcatgcagatgccctcatacttctcaaacagtgctaagttaaaaagtttagcagtatagtatttcagagtaaagaatgatcaggtctcttctatttactgcaataccatgaagagacaaatcttagcacacttcagctgctgcagcaagtggctgtattaaattataccgtatcctgacacatgctatacttttttattgtattatctcttttactttgaatttgaattcatctttttatacagtttcttatcaaggtagccaaccaggaggttgtactgatcgctagtgcaatagcactactgtatctctgtattactgtactgtgtatcttgagatgattctctcaagcatttatacagaagacgtacatgttcctcttgctgtcaggtcatcattatataccttctcccaattaaccgtccttcaattctcaccgctaacttgcaaacgaggcatgcttgttttgacaagagcttgttgaacaaacggaatttatgaacgctgctagtactcatttgaacaaacggagtacattataaaagatatagtctatcaattatattattaaattatattattaagacagttttcaaaggagaaaccacgttcgctgtgggcaggggtggatccacagtctaacgaccggggtgatctgacaccgatgacatccagcgaatgcacggtgatgctcaaattctaccagctgtgaccccggcataagatggtaaatgaccccagccatcgtcttcacctggcacgtagtacgtgaaactaaaacaatttacttggtggtgttacgatcctagttgattaatgattcttttattagcatgcacaaagcccgagtcaattttcttttgtttcctaagcctcattgtaattaattgtttcgtcgttgtgcttttgcttcgtcagttaagcagttagtactagctaatttcagatttatacctctttgtatgatgaaaggaaatgctcttagcctatttcaattatcattcattcgttgctggtgatcgataaaaaacacaagaacaactttaaaaaagattttgcattaatcgagagaacaaaaaaatgatctacctagtcttttagttaaatcaaaattatagcggtgttcatttagatacaggaattctgctctcgaatatcataaaagtgtagagttgttattaggctacgttcattcacaagccaaagagaggagatcactcgtttttcatgcatacgttttttagactgctgaacggtgtatattttttcaaaaaaattctttatttttttaaaaaaaaatcatattaatacattttctaaatttaaaataactaatacttaattaattttgtgctaatgataaactcattttgcatgtcttctttaatcttcttcttttccattctgtcaaaagctttaagttgatgaccccggtggcctttaatcctgactccgcccctgtctgtgggggctaaaaattcccacattaatcggagaaaaagaaaaggagagtccaggtagaactacaattcaaaaatagctgaaattcggaattaaaaataagcaatattaaaagaagtgtccatataagaacccaatacgagattaatcgaaattcacaataaaaataaaataaaatccgaaattagaaaataaaaggagagtccaagtagaaatataatttaaaaataactgaaattcgtaattgaaaaataaggaatattgagataggagtccatataagaacccaatacgaattagttaatattcggaataaaaataaaaataaaatctgaaattagaaaaagaaaagaagagttcaagtaggaatacaatttaaaatcaactgaaattcggaattaaaaataagcaatattgaaaatataaattaaaaataagcaatattgaaaatatatgaacccaatacgagattaattaaaattcataataaaaaataaaataatatccaaaattagaaaaataaaagagatttcaagtaggaatacaattttgaaacaactggaattcaaaaaataaaaaataaaaatattaaaagaacactatactgtattaattaaattttgaaaaaaaataaattctgaaattaaaaaagaaaaaagaattcaattaggaatacaatttataaataacaaaaattgatgataaaaaataaagactattggaaaaaaaagactatctaaaacacatgacgagataaattaattaacatgcctataaaagagtagagtggtagcggttgatacggcatataaaaactgttagtaaaacaccaaattgaatcctaatgattattaaaagaagggacgacaggtaggacgtgaagcaaacggataaggctgttgccgagacttctagaaagtaaaaaaaaacccattgataatcatattcgattttaaaaatcttaatgataacaaaaacgagaagtagagtgcggcgtgtataggagtacagttacagagccgtcgacagttggtgagacttctagaaaataaaaaatgaattccaacgatagttatgttctatttttagaatcctaatgacaataaagaataggcggcggatgggccgtagagaagtatagtggcattgtttgacgggacttctaaaaattataaaaaatgaaacccaatgagacaataaagtctaaaaactataaggtccaatttttaaaggttcggaacttctaaaaagtaaaaaaaaaacaatgataatcatgttcgattttataatctcaatgacaataaagaagggaggcagcgggcgagccataaaggagtataatggcaaagccactgacagtttggcgggacttatagaaagtaaaaaaatgatcccgaacgataattatattcgatttgtaaaatcccaatgataataaagagaaaagacagtggacggcccgtagaggagtataatggcagcgttcgacgggacttctagaaattataaaaacgaaacccaacgagataataaactcaaataagatccaaattttaaaggttttaaggagaatgaataaaaatagtggtagaccgagcaagcaaataaagaagtatctgataaaagtaaggggtagcagctgatgtgacttttaaaaactatataattaaaagtatagggatagctatttaataaatcttaagtaaaataatactgaaaaagatatgattttgtttggatgctagccgcgcaattgcgcgggccatccagctagttcttttgaaatttagatatggtttggatagggggggggggtcatttgacctcttcatttcggatatttatcatcggataagttcatgactcgtgagcgtataatccagtcatcaggatacatgagatgggcaagaaaagcctgcctgtttcattagtacctctgtatcagcatgtgagtctcatcagtatcgcatcagctggggaaacattgcactgaagctgcgatgcagattttacaagtaaagcaaagcaagttaggaccacactcttgagggcactgcatgaccacaccagcacaccatttgctgacagataactaaaagtactgtagacaccaattttctgtagaagcataactatgcaagttgagttagccatctcttagctcgattcaagtctaacctatgacgagttaactggctacaagcttaaaaaacttgcaagctgcaagtcttttttctgcaccagtttttgacagaaagttaactggcacttagctcttggtaggattgcagactcaacaacagcaggagaatagcaaccttgcatatgctttcccatcttagttggctcatcagtcaggtcttaatagctgacaaaacccctcaaacaacacagccgaatctaacgtggcccgggcaaaatgtttaaagaatatactttggatcaacaggattctgaaactgttaactcggttcttcattcatcgtcacaaaggccaccaaaagcctgacaacaaaaaatggatgagatcaacagcatttatataaccaagataaagttacagttcaacaaacatataagacttcgacagacagaagtcctacctgaaccaggaaactgttgggttccattatcataaaatgagtatatattttggactggtaaatggcaaggatattgaccacttgcactcacaaggagaagcatgtacatactgaatgggcaacatctggaagaaattgatcacagtgcagggtaacaacttgatgactgaaaccatgaaatgtcatatcctgtaaatgtattgtatctgaaactcatcatcttacactaggcttcgaaagaaacacggattgaactaaaattacaacaccaagtgtacaattacaagatgagaaaatacacaccatgaatgcactgttcaatagcttcttttgtttgtcactaactcactacaatcatgacaaatttgcacacagtcactgtcaatgctatttgggcaaggatttgatgaaattaacaataaggtcaaccattcgtgcatcaaaagcagggccttccatttggaagtggccagctccttcgatcaagtgagtatcaacccgtcctgctgcattcttgagcttgttttgcagctgctttacacttgtgaagccatctttagttcccatgacgaataactttggtttctcagacttgaggatagcattgtggtgtctgccaaataggaccgaggccattagaccaaatgggtacccaatgctaacataaccaatgacctggtcaaccttatcaactgcagatcccgctattggtgctcctgcatcaggaaagtggatatagatatatgactaagcatgatctaacagctgcaagaatggttgaagaaaacttgtatgtggaatatgagtcattatcttaacacaattgttttacacataatcagttatacttgcagcactatctgttgacaacttgacataactaaatcataagaattcataaatcttaaatcataactatatgtatgactttggagtccagggaacagcgcgtgaagaggttcagtttgagtaggtctcagtagccacagctaatgaataggccagaagtaggtacacctagaagcaaccaactaaatgtaaatatgctcataaaaataggttatgatatattgcctaaagtcaggatttgctgaaaaacaatggttctagctgtaaacaagcaagagacgttgcttctgaggacactaggctaccctgacagaagggaaatttcgccattgaaacttcttgtggattactttgcatctgcacagagtcacctaaaacaaatcaatgtgactaatacccaggtaactctgtatttgtacttcaaagacactgaaataataacatgctagtatatttgatgccaaatccataagaccaaaaacctgatacttcagttctgctgcaacgcacaagctgtttctattttcttgcaggtccatttaagtggctaatcgccaattgcatattcagttagatcaatacagtttctaatgagcaaatcacttggtcgattaccataaccctcttctgtgaagcttcggtgagaatgaaacaagggcaccgacgtcatttggggaaaaagaaaaatcagcaacctaccagcggaggagccgacgaggaggacgccgcgcgggttgagattgtcagcgacccagcggcagacggcctcgacgtccccgacctcggtggagccggtgagcgaggcgcggccggtggacctcccggcgccgcgcatgtcgaaggtgacggcgcggtacccgcgccgcgcgacgccctcggcgatcccgcgcagcaggccctgcacgccgcccaggatcgtgtaggggtgcaccagcaccaccgcgacgtcctccgccgccgccgcctccgcccccgccgccggcttgaacagccgcacgctcagcttggccccgttcgccgcctccaccgtcgtccactccatcacacccacccacgcactcccagtccacccctcaccgagctgagctcagctcctccggtcctcccctacctcgatgtgatccgcttgctcgggtggctttccttcccttcttccttaactccggttggcttctggttggtctgagcagtgagcagttgccgcagttatttctgcatgggccgtgatctgggcccataaatttataatgggccgtgaattccaactggagttgtgggctatgggtctaaacgggccgtaaaaatcgtgttagaaggcattaggaataagtgcactttgcctcccttaaaagtgacccgaatctaatccatgaccctaaatcgcaaaaccggatatctcgaccccaaactattgaaaccggtgcaatttgactctcctggtggttttggaggacggttttgctgacgtggtggtgttgacctagtctatggggttgacgtggcgcttaggtggcatttgaattaaaaatgtatactccacatgttgtcattcacacacataaaaattggggaaaattggaaccatgccattataattttacaaaatttgagatatgccatcctgacccacatgtgattgactcatgtgggttctacatgtcatgtcattgagataccgatggtatatctcaaactttgcaaaattataatggcatggtttcaatttaccctaaaaattatggggagagaagagaaagagaaagaaagagagcagggaggaagaagaaagagatagaagatggcatgtggggcccacatgctagtgggccccacaatttttatgtgtgtgaatgacaaccgagtccacatatacgttttaaattcaaatgccacctaaccgccacgtcagcgaaaccgctctccaaaaccaccaaggaagtcaaattacaccggtttcaataattcgagggtcgacatatctggttttgcagtttagggttatggattagattcgggtcatttttaagagactcaaagtgaacttgttccaaaacattagacatgtcggctactacacgggcgtttgagtccttttgttgtttcgcttttcatttttctcgttgatatgcggaccctagatatggctaggtcctgagctaaccggatacagtcatacagctaatatccactgaagtgttcttggtccgttacagtgatcgacgatcgacgcattcacgcaactgtactctgtcaaacgccacatcgacttcaccggcgatattttcttatcctctctgccttttatttttctcccctaccttttgacgggtccagcaacaaagttgtttcttttgtgtctgaaagaggaagattccaacaaaccgcgataagtcggcagcaatccagcatctatcagcgacctcggtcggcaacatccaacagcagcaaaagcgtaaaacacaggagcactagctggagactggagtgctgctaacaggccaagaacgttgacgtgacacaactaattaatgaaagcgacaatgctgcacaattcacttgatctggaggcacgcatgcataaggtgacctggatccagtgataacttatcacttctggctgtatccatgttgatcttttgctgcctctctttggttggactacagagactagagaagtagagagagtagtacactgtacaccagagacgacgacctctcccaatcgacgtacgagagagaaagaaaaagcatacgtacgctttgactgccgcatgcgtgcatgcgtcgctgcactgctcgaccgacgaccgtctcggtgtctcactcgctatgtcagcgaaagcaatagcactgtgagcggcggtcacgcatgtctgcaaaaggaggggagccgcgacgttcgcggcttcgcccgaatgcctggattttgtgcaagattcgttgcacgatcgcgccgtcaggcaatcgagatcgatcggacggcggccgcctcgatcggtgcatgcatgcgttacgtagtttggcaagagcactgccgcatgcatatgcagcggcaggcagagtgtgtgtggccgatttcgctttggactctacggcgcgcgcggtgatcatcagtgcggtagctggctttgtccctagtgtacgtacgccgctgacgccgccgcccgcgacggcgacaggggcagctagcggcgtagcggagtgaacggcatgtgggtgggcgtgcggcgtggagggcgtcgcgcgtgtcggattcgtgagctgtgcgtcggataggcgagaatctagcgtccttataaccagtaggataatcagttgatcactagacggtgatacgtgcagtgcagtgagctggtgtagtgagtagtgtgatctcacgacacgtaccggccgcaggagagtcgtcgtagggacgtgctgcatgccagctaatactgttagaagtggcataataaggaggacgtaattaaacaacatttctttgttatgacgacagtctatagcagctgcatcgctggagcataagttatccgtaagactgtaaccggccggtcgaggcctacgtaagtcaaaggaggaggggagggagaacatccgcgaaggaagggagattttggcattttgcacaggttacagtaatttggaacgatgcagctgccagttgaatgccgcacggatttatatatgcgtctgatgttttacgtactgtcatgctgatgtggttgcgcatatatctagtaaaccaacgacaaattaaactgccaaaactctcgaaatttctgacaaggacgtggcacgcgggaggaactcgagcaacgtgcttgaatatatgatcaacaaggacatttgcatagagcgtgtactggtagtacttctcctcgtttgtaacatactcctcatgcataaaaaagcgcaaccatccatttcattttagttgtttgcatattttgtgtgcggagaatctttgagaggctacggttcggaacttcagagttcagagtacatatggttttaattttgtatccatgggactgaaaacataatcatacctccaaaattaatgtatgtcttacgtccttcgttaggtcgcaatgttgttcaatcacgtcgcgccagcaagcacagcgacccgctttaatttcttgtccttgagatccttttaggacgcttagccagttaaaacgatgcatctcgatcacaataattattttcacgtgtctctaccgtttttttgttcccgaaggaatcgtagtcctggagtactagtgaccatacgaactgcagattcgtgaaaaaaaaattgatcggtctcaccgggtgagttcaagataatagtatctagtttaaataggagtattactgtttcgtttttactgtcacaacttcagaatgtcacttcaataatataagttttcagtgttttttttaaaaaaaagacgattgtcaagatttaaagataaatagtttcttggatagttgtttaaaataggagggagtagcttataacaagcctaaatggcaaaaatggaggacaactaactaaagtgtggtacttccagctcattacgccatgtaccccttatgtactatacgacgcatttttttcgctacgaacagcagtagcattgtcctcgcgacggcgacctaaacctgatcaaccgtccatccatctgactttacttgtactgttgtacacgcactagagacgtgcgtgcgtgcattgttctgacgattaagcatacgcacggtcttacgtactcccggtgaaattcacaggcctctctctggtctactgccaagcacttcacaggatccccgttattttggggccggaaaaggcctaaagggaaacagctggcgcggcccatgcacgctgccacacaaccacagtgccatatgtgtcggccactactcgccccggccccgcaggaggaaacgaaaacggcatccaacaccgccggcccgaccccgacgcacgcccataaatacgcgccccatacaccgcccagacacacgacccgctatctagctagctagcttccccccccccccccccccccctccatttcccacacctcccagtacgcgcgtctccgtcgcgctcgcgccggccggctgcgtctgcgcgcgcggtacaagagatcgttccatcagggagcgcgggtgatcacagcagccgacgcgcgcgcgcgcgcggcagcacggcgtttcaccgatcgcgtcgttgcgcgcgatcgagctaccgcgttgttgtttgaggagatttagctaggtaaggcttgcggtgttcgccaccagcccacacaccactctgatctcgcgccggtaaatgactggacgcctgggcagcagctgcgtcgtcgtcgtcgtggaggtcgtcgcttcctttgtgacgtgcctgtcgtcgtccccgtcgccggagaagtgcgagctgccgccgctgcgcgtccgcaccggagggttcatcagcgaaggtacgcttgcacaaagagatgcgtacgtgttatgtacgtagggccggccggtggtgtggccgtgtgatatacactacatgtgccatcacgtttggagatggtagtggtaccctgtaagttatgaatagtctgatatatgactgtgcactgtgcacaagcttggtgccaccactcaagctccttgtttatcacgtaaaaaaaaggagtttcagctcgtatgggctgtgtaaacacccgactgacgtatgggcccccggaaaaggacgagggcccctttgtcggtgttaggtatcttttcttcagtcgtttcagcttttaattacttgcttagtgcatctctgacaagattgtctcgcacaggttaaagcaaaaaaggcccggaagttttcccttgataaaaaaaaacgagaaagtatccacaagggcgacgatatataacaacaaacagaaaggtaaggtatatccacgggacaatcttcaggcacaacacgagttctagttagtccagttcttcgcttggtgcacgctccagcgtaatgaacaaaatgttatatagagtaagaggcgaaatcagtcgaaactatcatcagcgtcagctttattatatagcgtgatgagccatcaattcaaacaatatcttactaaaggataattttactattcaccgaaaggtacaatatttatagcgtaaaaattttaatatagaaaacttgatatctcgagatattttctcaagtacaataaattttttctttactaaatgattttggaatttcatcggctaaccttggtgatgaacgtagctagctccgccctttatatatgtactccattctaaaatataataatttttagacttcaggatttgtcataaaatataataacttctccattaatattcttttcccaaccaatcacaatccccaccatttacttttcatacatacctccactactcatccaatcacaactctccactactcatttctaattactttcttaataatcgtatctaatcttaaaacttcttatatctgggacggaggggtattattttaaaccaagaagaaacgtttcgagcatgacattgttttcgctcggataagagtcacgcggcatacttgcttcatctgagtactattgcaagtaaagatgaactctggcctttaattgcaaagggtccaggaacatcaaaaggaaagaaagaaactaaacaactgccatctccatgtttctttttgaacgaaaggtcatcctcatgtatcgatggactttaaagtatcgaaccgaaacgatactccagctgacattaatggaagtttttttttttctacaccaaagatgtatatatgtacacaaaccattacgtatgcacctgtacctacgcacacgtgagtgcaaccccttgtctcttcatcggacccatgatgtttattgtccaacataaaccacctaattggtaggtggaaatgcaaacctagacaattattgaaaatgaaattgtagtttctggaactggcaaagctagaaaaaaaaaagagcttaggtgatcggcgttttttttttcctattgtttagttcttatttggctacttgtttcttgaaataaaattttaaatcagccattaggtgatcggcgttttgttgtttgtttggaaaattcatagagcaaggcaatggctccaactgctgtcgattcgaaaaggatttctgacatcactgaagatggatcaatggacaggcgaggaaatccggcagttaaagcaaaaactgggaattggagatcttccatcctcttgctaggtaaagctatgttttactttaattctgttattcatatatctacaaattaactgttttaataagattggtttcttgtttattgaaaaactgcttttcttggattcccaacatgacaacgttggttgttgattagattaggttatgtttcagtcttcaaagaactatgaactaatattgtcagcacatagtgtgatcacaaccttatagcttgttatttgctagtaaattcctacttcgctgtctgagttgtatgcagttcagacttcagatttccaccaactggaaccttcaagaataatccttcttgcagagcttctagccagttgagtggcagccaaacctggaggttgatccaccgttggaaagctatcaattctgtactcttcaggtttaacactacgcgttttgctcttcatccagatttactctgcatgggcaataaccaacctgactaaaaccttacttcagaagaccgattgttgtgaactgtgttaaacctttgtgttcgtattcccgaaaaaaaaaaaagttcaaccttgtgttgcattaggacacttccaaagccatgtgcagaatctacctaatcttgtttttcaatatataagctgttacaagttggatttgggatcgattggacagttaattcaggtgtgttcctgatgcagtcaactatgggctcgtgacatgcgccttcttcggcgtcggggtgaaccttgtggtgttcctgcggcgggtgctccaccaggacaacgcagaggcagccaacagcatcagcaagtggaccggcacggtctacatcttctccctcatcggcgccttcatgagcgactcctactggggccgatacatcacgtgtgcaatcttccagatgatctatgtcacggtacgatggtcaagttaattatattattattatttttaattagctcttctgttgttggaatgatcttgctgaactacgcgtcgtgtgtgttgttctgaactttctgctgatgatcagggcctggtgatactgtcactcgcgtcgtggttcttgctggtgaagcccaccggctgcggcgccgcgggggagcactgcgacgcgccgtcgagcgccggcgtcgcgctcttctacctgtcgacctacatgatcgcgttcggcaacggagggtaccagccgtccatcgccacgttcggctccgaccagttcgacgagacggaccccagggaggcccgctccaaggtggccttcttcagctacttctacctggcgctcaacgtgggctccctcttctccaacacggtgctggtgtactacgaggacgaggggaggtgggtcatggggttctgggtctcggccgcggcggcggccatggcgctcgtgctcttcttgctcggcacccccaactaccgccacttcaagccgaccggcaacccgttgacccgcatcgcgcaggtgttcgtcgccgcgttccgcaagtggcgcgccgaggtgccacgcagcgagctcctgcacgaggttgacggcgacgagtcccagattgctggcatccgaaagatcctccacagcgaccagatcaggtgaatatcttgtttgaacgatgtgccaatgcactttgatcgatttgccgtttgactcaggcatcaaacagtgttgattcgagatatataatcgggagtggattctaatccctcgaggggatatcccctcgtatacctttttcttctaaattcgatgtaaatagttgtgaaaaattctaaaattttttttgacaatgtagagtataatgatacctactagtccaccaaaattcaagttcaaattcgatctacacatcgagaaaaaaaaacaaatttagatataaacagtacgctactattcatatgctgaatttgtcttttttatatctcgacgtgtgagttgagtttggacttaagattttgtggagatgtatatatgtgttgtatgaatgttatcaaattttttcagaatttttcataaccgtttagataatttttaagcaaatgagggaatatccattcgagggattagaatagtttcctatataatcgatgtgcatttggtggcgtgttttggtgttcaggttccttgacaaggcggcgacggtcaccgaggaggactactgcacgccggagaacatgcaggatccgtggaggctgtgcacggtgacccaggtggaggaagtgaagtgcatcctgaagatgctgcccatctggctgtgcacgatcgtatactcggtggtgttcacccagatggcgtcgctgttcgtggagcagggaaccaccatgaacaccaacatcgggtcgttccacgtgcccgcggcgagcatgtcggtgttcgacatcctcagcgtgctggcgttcatcgccatctaccggcgcgtgctcgtgccggtcatgtcgcgcctgtccggcaacccgcaggggctgaccgagctgcagcggatgggcgtggggctcgtggtcggcatggcggccatggtggtcgccggcgtggtggaggtggagcggctgaagcgggtgggcgcgccggaccagccgagctccctgagcgtgctgtggcaggtgccgcagtacgcgctgatcggggcgtcggaggtgttcatgtacgtggggcagctggagttcttcaacgggcaggcccccgacggcgtgaagagcttcgggagctcgctgtgcatggcgtccatctcgctggggaactacgtgagcatcatgctggtgagcgtggtcaccagcctcaccgccggcgacaggcggcccgggtggatccccgggaacctcaactccggccacctcgacaggttctacttcctcctcgccgcgctctcgctggtcgacctcgccgtgtacgtcgcgtgcgccgtgtggtacaagggcatcaagctcgacagcaacgaggagaaggcgaacaagatcaccgtgcacgtttaggcttcgggcctgtaactcgtgacggctcctgtttagatactgggatggcaactaggcttgccgtagtaataacgacgcgtgacagaatcatgtatggcccatgcaacttctctgtcacgactaaactccaggagctatatatagccagcccatgttcgaaccatgtattattggattttgggaataagttcacttggtgaccctcaaaagtgattaaaatctaatccgtgaccctaaaccacaaaaccggatattttaacccccaaactatggaaacctgtacaatttgactccctcggtggttttggaggtcagtttcactgacgtggcggtattgaccggctctcctttacacatggcgctgacgtggcatttagaattaaaaaatatgtgtgggacccatttgtcaatgacacagaaaatagattgtgggacccacgtgtcccttctctctcccctccctcagttccctctctctcctcgccgttccctctccccctctctctctcctccgcagcaggcggagatggtggggcgacctgcgagcggcggcggcacccgggctgagctccaccgtgacgaagacgaaggagaccacagcggcggcggcgggaggcacacgcggcggggtacaacgagctcggcccggcagtgggaggacga

SEQ ID NO: 67552 - DNA, 54113 bp, Oryza sativa
ataggaatcaagtttctgtcaagtgtaaggcagataattgtccttggtacatatatgcttcaaaattgcctggtgaagacacctttaaaataaaaaagtatgtttcaaaacataactgtgggaaatcacacaatatagcacagctttactggagatggcttactaatgaatacatggaattctttagatctgacaagaaatgggatgcacatgcctttcaagattgtgtcaggcgagataccaatgtagaagtcagcataagtaaggcatatagggcaaggagggaggcctacaagaaagttatgggcgatcatgatttgcagtttaaaagaattcaagattatgctcatgctgtgctatctgctaatccgggaagtaaagtttttgttaagtgcgaagtatcacctgagccagaaataaggcctaggtttcaaaggctgttcttgtcatttcatgcttaaattactggcttcttaggtggttgtagacccttcatcggtatagatggatgtcacatcaaacccaacaatggttctcaaatactaacagcacaaggcagggatgccaacaataatcttttccctattgcctttgcagtagtggagtctgagtgcacagaatcttggacatggttcttactatgtttggagaaggccattggaaaaggagaagagtttgggggctgggtattcatgtcagatagacaaaaggtaatggctatcatatatgtctactttgcattaatacatgtcaactgtttttttaacattttgctgccatatatagggactactcaaggcagtggctgaagttttcccaggagctgagcaccgttactgccttaggcacctacatgccaatttttcccaagcaggatttagaggggaatatctgaagggtttgatggaacgagcagcatatgcatatagacaatctgagttcaatgctgctatgcaagaactaaaggttaacaatttgagtgcatgggagtggctaagcaaggttccaaccaagcattggtgtagatatatgttcagttctagagcaaagacagatcttcttcttaacaacataagtgaaacatacaattcaaagatactgggagctagagatgaacccataattaccatggttgagcacataaggataaaaatgatgggtgatttcaataataagagggaaggtgcaaaaagggacaattggcaaatcccaccaaatatattaaagaagcttgaggcagagaagagcgaggcaagatattgcaaatctgtgtgtgctggtaggggcatttggcaagtgtccgcatttggtaatcaatatgtagtggatttgaacaagcacacttgtgggtgtagaaaatgggatttaactggaatcccatgtttgcatgctgtttcagctattcaaggtttcaagcaaaggccagagagctatgttgatgacatattgacaaaggatgcatatgcgaggacatattgtgggatgatttatcccgttcctgatgagacacaatgggaaaaaactccatttccagatgtagacccacctgtggctaggacacaaccagggaggccaaaaacaaagagaactagagcatctgatgaacctagggttcaaggaaggtcggttgcaaagacaacaattagatgtagcgtctgcaaagagtttggtcataacagcagaaagcatggaaaagacaaccatagttcttcatctcaaaatgtgagtacactactaatttatcatataaagacattgtactttgctacttctcacaatttgttgtctgtttctctcggtgtaaaacacaaataactaggaggaagaagaggagcaattcccagcctattagttctagttcaagagatgatattccaacaacatccacacagccaccagtatatatggacaatgcatttggtgttggtctctaccatcatgtgccagatggggcttatatcggtcctactggaagaaagctgcaaattagaagaaaatgatctcctatttttatgcagtggtattatttacatcaaaattcttagctacaattagtgggggatgttgatcccttcttaatctcagtactatcttttttacgacaaataattttctgtacttctaactatcagatttgaattgtgatttttaaggggattctacttcaataagcatgtcttaaatattctggaatgtgtttttgacttggtgtttccattcttcatattgatgtggaatcacgaatcatgaggcagacactgttgttttgcactggtggactagaaattgttttcctgttttatattagcgtcatgtcgtcctacccgtatggctcgcggaattaagagtggatggagatgcgcgcggttttgccgccaaggtggcacaaggaaacttcgctcatgggctgagctaaaggcccacgataacgagaaattgagcgcatcagagaaagcgtgaaaaccgaatagggtgggaaattggaagagaaattaacttatgtgtagtgttttgaacaatattgagttgtaggggggagagtagaaagagcagtgacttgtaggggggtatttggattttccccttgattcatcgatgaccctggctgctggctgctttgcctcttttctagtctccttctccctagccgaatgggcccaaagctagcccacttgtctagccttctggaaggacatcacagcagcccatgtacatgacatccacccaggaccaggtgcgtgcatgcccagcccaatatatgcctcgagccacacaagtctatcgtaccagccttcctatttatcttgcacgaggcggcagggaggttagggctttttctacttctatacatgacagtgatcatcgacgagccgccgccggccccggcgccgccgcagccgaagcaatccaccacggcgcgcagatggtggatgaaggcggatccacggaaggccgcgcagcgccgtatctcccgcgagctggaggatctctggctcgacccgccggcgtactgccgccccggccctgaacccgtgacggacctcttgcactgggaggtgatcatcgacggcccgcccggcaccccctacgccggcggcacgttccccgtcgacgtctggtaccccaacgagtaccccttccaacccccgaagctcaccttcaagaccaaggtaaaatcactcgcccaatctctgagtagatcactagcttgtgttcatcgccagatatcccaattgatgcttcaatctcgtacgtacgaatgcaattcgatcgctgcaggtgtaccatccgaacatagacgacgaggggcagatggtggtggacgtgcttcacggctcctgggcttcgtctccatcctctacgacccgctgctcgactacccgatcaacgacgacatcgcggagcagtacgagaacgagtacgagctgtacgagaaggaggcgagggaatggacgcgcaggtactcctccacgcccatcgcctcgcactggctacccaaggctatgaggacgccgccggccgttcctcacattccggcaaccgcagagagaagagaagaaagcaggtcgctgcatctaaggcttcttcttcttcgctaaatcaactgcggcggcggaagaagaaatccatcgaggatgagagtttgtggaagaggatggtagggaggatagtagggtttcttcagggctggtggtctcctaattaccgtctactgtgttggtgatagtacaagtattgggaggcatgtaaactagtagtgtcaattatgagttacttcatccgtttcataatttaagtttttctagcatttctcatattcatatatatgttaataaatctagatatatatgtgtctatagattcattaacatctatataaatataagcaatgatagaaagtcttacattgtgaaacggatgtatatatacctcgaatgtgctggtatatacgcaagttacctcacctagctagacggctcgtcgattagattcatggttatatatagctgattccattaattgttcgggtgtgtcacttacagataagtgttagtgtgtgtgacattatgttgaaatcattcagcatgacgccttcgatcatcatggcattgcagtcattttttttaaataattaatatacaatatttttagtagaaatttaaatagcaccccaaccagcaatctaaagactaccttcgtttttttattaaatgacgcatttcactttttcataatgttgggtcattcactctacttaaaaaaatagtgtaaatatgctaaaatatatatcatacttaaaatttatttaatagtaaaacatgtacaacaaaataaatgatatttgcataattttttaataggacaaatggttaaacgtcatgttaaaaatcaatgacatcatctactaaaaacatagttgtattgttgacaaaatattgcccacaggatgcaattgtcacaaccaattgaaatccgataatacatttttagtgttctattaaataacattatttcttccccaaaaaaataacattatttcaaataattttgttgcaatcaacatatcaaaaattcaaaactacatattcagccctaattaagctcccaacctatgaaaatgagttaacaataatataaatattacaatcatgcatagaatggtattattttattctgtaaataactatgagatgggcattggggttgatttttgcgggtaatgtttttttcgcgggtaatatttgactcgctctttttcttagataatagaaatgtattataccctcggtttctattatatagcacacagctagctaacaagctttttaactcatgaactgaataaaaaaaacaaatagatgataaaacaaatccctaattaccataaaaagataaccttgatagacttaaggtaaattttgctatatgacatcgcgacttcgtggttttaataccatatagattacaacaagtaagcctatatatatcatatcactcatagtggaataagatatactccctccgtcctaaaatataaatatttttagcatagtgacaagtcaaacattttcaattttgactatatattaatagcaaaaaaataaaaaagatcactcatgtaaaattgatgttactagatatatcattaaacaaactatcataatatataaccatttttatttaaaacatattacttttatagctattgttggtcaaagtagcatatcagagacggtaccataatctaaaaatgtttatattttagtactatgggagtttttggttatcaactttacaagtgtagcatcattacacaataatattaattgaactaacacgggtcaacgattacgagagaagtccactcatgttcatccctaaagaatagccaatataagtgacctggcgccgtgtggtctactgctttattgacgtgctgcattttccattttaacaagatcggcggccgttacacggagccaaaattgttcatggggagcatagaaacgaagtgatgcaaaacacaccgctaagcccaacaataaaccggaatatccgctccaaactctcctaaacctccccgcggtacttatcaaccccaagatcgcctctctctctctctctctctctctctctctctctctcaccacaccgagtttccatcctgcccgtcaggcgctaggccgctagggccggcgtgcaatacatacgtggtagtagtagtaacaatgggcagcgagctgccggccgcggcgccgccgcagccgaagcgatccaccgcggcggcggcggtcgcgcgcagacggatagggcgcgagctgtggcagttctggctcgatccgccgccgtactgccggcccgggccatcccccgtgaaggaccacttccactgggaggtggtcatcgatggccccgccgccaccccctacgccggcggcgtgttccccgtcgacgtctggttcccctacgattaccccttccgtccccccaagctcttcttcaagaccaaggtaatcgcttgcgtaatctacgcgttcctcgatctgtcgcgtgatccaagattgctcatgttcatcgccagttctcgctaatttgttttgctacctttcaatctcatgaacaggtgtaccatccgaacattgacgggaaggggaggatggcgctggacatcttccaggacaactggtcaccggccttgacgatcaacaaactcctcttgtgcttcgtctccgtcctcttcgaccccctgctcgaccgcccgaccaaccgctgcatcgccaagcagtacaagcacgagtacgaggcgtacgaggagaaggccagggcttggacgcagaagcactcctcgacgccgatcgtctcgcactacccaccgtacgctgtcatcggcagcacgccgccggctgttcctcacttcccagcgactgcagccaggagaaaggctgctgcatcttcagcttcaggttcagtaagcagcagccgcattccgttgcttatgaaggatgagagtatctggagaaggacaatgaagttttttcagggttagtcttcttaattatcgtctacgtactgcacagacactgaaaacagataagggaaattagagttctttcttcctcacagatgaaatatgttatatctagaattttattttactgtattgtgaattgttgagaggtatgcatacttgtatcaaatcttcaggttatgatctgtcaccacacggtaatgacatggagctgctgactatgaggagtgataaacaaagtccttatttatctttttagtctgatgtgcagcacttaactttccactctgtttctgatgtgcaatctttttgcttgttcgcgaaacttttcattctgttttgtaaataagtgttgatatatatgtgagcactggagccagtgtgatctgtgagactgtgacgcattatgtcgaaaccattcagtatgccgttgttttggtggtgcgcctcgagccatatatatcccacaaggaatgaatcaaaattttagaaaatatgttagttccaggaaaagctttgctttgcttttgagataaccaagtgaaatggctatccaaattacttcagtaatgtgtacattgtactgttggaggttacctcatcagccatttagatgctatcagctttccgactttagatgaccatgtgtacgagcacttcctaaactaagagagattgagccgacaataattaagttaattgtcagcatgagttggtggtgactaagttatgagaagaaagttataaaagggacgaggaaagatacaaaacgtcaagcgaactactagatatagtcatatcaatctacgagatatacagtcatataccagctcaattactaggaatctaatggcgcagcatcacaaacaaacaatcctgaaaagtatcgtgaaccactttgggatccactagcggaccgagagacaccgagtgtttttggcacgcttcttcatgctagcatacacttatcgagctgttgctaaacttttcttgctcggagtggtagcaatgtattgtagcataacactaacacgtgttgtagacatctgtttgtaccgtgttttcttatttaaaaaaagttgcagcgcgtagtgtatgttagtatgtactacatccgtcccaaaataagtgtagccgtgggaatccgtgtctaacgtttgactgtccgtcttatttaaaaaagttataaaaaaatttaaaaaaagttagtcgcgcataaagttctatttatgttttattatctaataataataaaaatattaattattaaaaattttcaaataagacgaacgatcaaatattgaacgtgaatagtgtaaaacttattttgggatggagagagcagtgctatgagttcatgcaaaggcgcagcacgggcgcacggccctgtactccaggcctccggggcatggcagccggggtaaccggcccacctgcggttgcaacgtcaaacggcccacgcgacgcgagcgatgcgccgcacccaccgccgcgacacaaacactcgtgggctacgcacgcgtggccgcgcgagcgaaagagctatatagcccacgggctctacgcccgcgcagccacccacccggccgaggccgtcgttggctcgttgccgcgtagcgagcggcagcgacgccgtgagacccgtagtccccaccacacagccccaatccggcgaggaaaggaaaaccacatgtgtgtcgtgccaccgcgccaagcaaaacggtaagcgcgcggtccgattcgggcgcgcgtatgtcgcccacgcgtgtgctcctgtgctactgcaagcaaaaccgccaaataaatgcatgcccatgtaaacgaaacgtacaaacagtcacgcgaaggaaattgacacacacatacgcacacctcacacgtccatgtcgaggaaacgtgtcacgccagaacacgtcgacgtcgatacgctatagcgcagagggcacagtgcgcacatcacccgaccgggcccccaaaatcacatcaaagcccaatcctccgaaagtctaacctccacacgcaacaatgaagcttcttgtcaacaagcgcgtccgcgtctgcgtctccctctttggcgcttcgataggacacgcagcacggcgcacccccaccctccttgtacgcgcgatcgaattcgattggcgcctctcggctttttttttcccagatagcccgcacacacacacacctggttggatggaggctggcacgacggccactcgcaccggaaaatgtatgcatatgcatgcgtgccatggcgtgccgcgtcgggtggatggcgacgtgttaccggtggacgacgacgacgactcgggtgatggatacgtagccggaaaaggatcagattatcaatcgatccaacatgctcggatcgatgcagagtaccagccggtgtacgtgctttaatgaagtccaagttattagccgtcgcccggccggcggtcgatcagcaccaggtttgtttcttttagccaacgttcaaaaactgttgctgagtaactgaccattagagcagatacaatagcagactataagccagttataaatatattttaaagagataaaagaaaagagagaatagcagcaggctatagatttgtagccagctgcagcatggacttcaagatataacgtgtgtatgataagtgggaccagatattaatagtgtagtaaacaactattatatgaattggctattacattggttatacataatttaaagttagtagttggctatactattaaagttgctcttacaactccgagtataccgatgaatgtcttgcagtacttgcctgctttcagaacgtgtcaaaatactccatttggcatccattcgtgttcgtcaaaaagtagaaattaatgtagagagaatcagaccagctagggaggagtagaaccatgcttcgacgtaagaacaaaatggtttgcattggcatgcatgcctcgccatcgtcgccgggcgtcttagcccatcccgtatcttttcgcccatcgtcataacgcgcggtatacgtacttgactatacttgtgccgttgtgcggttgcgctttctgtgttgccattattgaagactgaagagagtgcaacactccagcgactaaagcctctctcactctctttattctcgtcgtaacaaccagtgcaacttgttcggcttatggatgtccaatcatacatttgcaaaagtatctgaaaattcagatagcaggaatatatatatttctttggagtatataaaccaacttgatttcattgtccaaagtactcacacacgaatacaggcttacagttttggagctcttgtacttactaaagaagaagctacaaacgcagcacacacacacccattaatttacatttacagagtaaacatttcggccagtacttgccaaagaattactacatgacaagctatatatgtcacctctactggatttgtgtagtgtatcatatttggagttctgctgttccactttcaaatactctgtaccccctggcctcgacaacataaattaattaacattacgctaatattgtttttgagttgtgttttcttatctaagcgctagagcaaacacctttaccaattcgtttttatctaccttgtgatatgttcatccccatgcttatgtaacagcttgtgtggttgaattgatgaatggcgtgctagctagtatagccaatagcaaatggattgcccattaatttacccaagtatccatgcggaccatgcctgggtgcgcgttcggcggcgctctcggcgttctcagctgcagccgccggcggcgaacccgatcctgctgctcttgacgtcgtagacgacgctgaacgtctgctgctgcgtgttcccgatgatggcggcgctcctggccggcgcgaacgccaggcacgtggtggagtcgtcgacgtcgacgaggaggttctgcgccgacagcttgagcgccgcgccgccggcgaaggacatggtgaccgccggcgcgctcacccgcgaggcctggcccttgaagcacgtgtcgaggatggagtacgccgacgcgcgggacgtccccttcatggccgccgccaccgccttgctcagcgccgagtacacgctcgtcggcaggcgcgtgatcaccgtgccggagtcgatgatcgtcggcaggctggagtacgccgacgacgacacggacagcggattcccggcgaccgtcatcccggacagcttgatgaagtagagcgagtcgtcgagcgagctggacaccatcggcgtgtacgagtattgccccgggttgtacgacccgagcgacaggtaccccgatgacgacgacgacgggaggcagtaggtgaaggagtagccaaggcttggcgcgagctggtacaggagcgagagcttgttgcgggcgaggccgatgagcccggcggatcggccgaacaacccctcgttgtcctggccacagccgtagtagaagtttggcagcgacgtcgagccgaacgagacggtgtccttgctgaggtagccgacggagaaggagctgtcgccgtagctggcctggtagatgcagacgttggaggaggagcaagccgacgggttgagcgtggcggaggggaggtcgctgcactgctgcgcggagcaccccacggaggcgtaggtgctcgacgacttggggttgaacaccgggccggactgccggtggcacgacacgaggcacggcgagcactgcagccaggtgagcgaggagcccgtgtccacgaccatcacgtactgcgtcgccggcgtgccgaggcccatgcgcgtcacgtagttgcccacgcccacggacgcgccggggctgagcggcacggacgcgagggagccggcgaggccggcgtcggcgtcggcgtccagggaggtggcgcgcgccgacggcgtcttggcgaggcgcgccgccagcgacgagatgcgcgcatcgtcgtgggtgagcaccgccgtgaacgggaggtcggccgggaccggcgccggcgagcaggggctccgcgggtggtgcagctcaaggtgcaggcccgtgctgttcaggtactggaaatctgcacaaaattcaccggcacgtccttaattcgcccgcgtcaattcatccaatttttaccgcaaccatgacaaaaaaaaactactttaaaattagagattctaaacaaattctgccgcggctataaggccatttgcaattaatgggaggtgtcatttttatgttttcaaataagccacataaacaacaatgcatttaattgatgattgaaaatacactatactccctccggtttcattttatttgacggtttggacaatgacacggtttacaaaatatatatttgaccttatattttctattataatatacacaataaataaatgcatgtttacttttattatagtgttttgaaagacaaatctacgtatgttctttaaactaaatatttttaaagttgttgatagtcaaagttataaaagtttgacatcaatcttatccaaaacattaattattatatagaaccggagggagtagctcgttaaacatggccatcagttccgttgcgccatcttgtcgtcaattttttacagtagtagccgtcttgtgactggacagtgacgtataacgagacgtacggacattatacaactagggagaagtactgggcatcagattgtataaatgtcccagctcatatgatttccgttcccaatcgagtgtggatatgtcatcacatgatccaattgtccaaacaatcatgcaacaataattcatttatttatgttacagataaggagtgtcgatcatatatatgacttgcagctgtgttgcgtgctactggggaatatataaatgtacgaacagcgtacaacccgggcacgtacccaagattgcggtcacgtatcgatcaagcattcaagctcttattgatggtaggatttgcagttggcattatctggtcataaccatattaaatcccaagacaacgctggatcgctgtaggtggtagataggctagctagttaaccagcatagtcattgtgaaattgagtgaaatattctcggtagaaggcccacgcatggaatagtagtctcagttaatttccagtgtttgtgaactagtgcaaaatggaagattctactttggcattgcttagacaatctaagagcttggacgtgctaacattagtccaacaagagaggaaacacgtcaaaaagggactgaagttgatgcatttggttggtagttaacatgatacacaagataatggagtgattgtctgatgtctataacgaggaccacaaattaacacaacacccagtcttggtgcctaagtacagaacacctacaaagcatatggtaccttgccttcccccctctattatgacgagcaaccaaagatattttttctcaagtgggaacaaccaggattgtactgctgctttggatgactggagaactaaccacttctgaagaagccagggggcgttggactggaccatcacgtacaacagtagtactacttccatatcaaaatatagcaatgtaacgtatcctagtgtctcatcatatattaagctgttatacttattttgatacggtgagagtacaatccagaggtggcccagctaactaggcaaactatttacagcagcaccgagtttctgttgagcgtgcctacatgcagccgtaatatcatcgatcggtgctggatgattcaagtcatggcaaaagaaaaagttgccaaaaaggaagccatttgcaatggcattgaaaaaccccacgtatcggtgacgttttctagccgatcgatccggtgcccatctcggcggccatcctgtccggcgcatttgtggtcgcgcgcggcgcatgataggctgatagatatggtggtttggcatcggtggtttcacgggggagaggcgaagtatggctaccgttagagcttcacatcatggccttccatgacagcagtcaatcgaaccactaaccggccatcaatttcgactgagaccatatataaattgcgatggctcagtgaacagtgtaccgtgtacggccttcgattgaaggctggctttggtcgtattggaaagagacaagtctctccaaagtattgttctctggtattggtcatcactgacatataaactcgctgaatgtgaagtccacatattatatctacttaaagtcagaacaggatgctatcgagaggactcaataggaagagttttttttttcttaggaaaatatgccatcttggacggagtttttgccgctaataatggatttgtacaaaaaaaattgtcggtcaggacaaagcattggaaaaacgcttgtgtggtgataagatcgatcgctgcacctgcgtgccgcccggcaacaattagccgtcgacaaaagtgtgtacctaacaaaactcttttcttctggtggcgacggatcattgactgtcctgtatattttaattcaaggcggcgaaaagagttggaaaagaagagaaatgatcgagccgaaaagattcgattttggttgtcatttggctcccaccctcgctgtcatttcttcatttttttcttaagttagttatagtatcgacaaagaaaattcagacttcccctgaaaatgttttcaggggaaggatactacatgaccaatacaaatttgtggttacactaccaccatatttacgtccattcaccatgttgattctagttgtactagtttaaccgaggtgctaaaacaagcaaagactccaggctagaaaaaaggaagtggtgcctcaagctgatgtgatgctattttgactgcaaactgaaattggttcttcaaatcctacttataggtgctttaattggtactcttgctctttcagtctttctactcaattggctagcgctatgtaaactcagtagtaagctgtactgttatggatatgtcaacaaagcacatatctttcatctacttgcagaaaccagacataattaacagcatgaatcaagagaaagctaactaattaagacaaggaggattattgatacccttgatctgtgacgagcacacatcggtgatgtccctgataggggtcgccactgcgaagagcagggagaaggcaagcaggtgaagaagatgcagcgccatcttatctctaaactctgaaaccacctccgtcttgcaggtggttcagtggtgcgtatgagtttatgactacaagctcagcctttttatagagattccgagtgagctatagcgcgcgctagctcttcgggcttcgtgggaatctcacgagtagctttcagttcagttgctgaagtaatctttttatccatggcgttccaagctagcttccaaccacctggttactgaaataactaacgtacgtttcagtactacgactagtacctccgtgatcaaaatcatcaaagatcttttttgacgtggatgatcaccgtagatatatatatatatatatatatatatatatatatatttcaattgaaagtcctcgttatcgacataattatgatggcataaatcaacagttcaagtagtatagtctttctcagtttatttcctgtttcatatttttgccttcttttggttctaattcggaagcttctgatgtcgcttgtgctgctactgtatcgttgccctcaataacaagaatctttagttaatcatgctgtaatgggacggtgatgcaaaagctgcttagctgcttttgttcctacggctcaaagtaagtaaggttaggtgcacacaattatggattcggctaatcaggctcaattaagctggcagttaagcgcacctatctagcaaaaatgcagtatgagccctctactgatgaacacatctgtccatcaagcaacatcgatcagtattagcgtcgacactaaggtagttttcagggcaccacattgactccggtattagacacaactacaaaagtgtgagaaagatgacgagcttttaaaggctgcatgccatattcttgagacaggttatccaactttttgtcaattttggacagaggttcacaaacagaattcaataattttgtactctttatcttaggttagcagtctttagtttgtttgtttttgatgattggtttcgtctttttaagtttctttgaacttcactcattttgagtgtgaggttataataattggctgtagctctttgagcaaaggctgggatgctctattccattatctaaaaaaaattagcatccacacctatagacatagtagctagtgcctggctttttcatctaagtccttttaaaaaacttatttattttataaataaatccaaaaaaatagacctttttcttggcgccagtaatcctacaccgaggtccaacatctctgttaacgaccaaatttggtaatatcagcatcggaaaaggagattagatcaaggtggagttgaaggcggagattgatccgagaacagagcaagaatcggctgaagtccagatcggctacgattaggatcagctgggtctgagtcggacaaggtgagccgatgcagccgattttaacattataatttggtgtgtgatatcgggttgaattgaggtgcttcaagattattgccgcacatggatagagtcctgagaagacaattgtatctattaattaggattttttatgtaactttattagagatatgtttgggcaaaagtctgccgcaaagacttatggtatcttagagtttgttagagatagtggtcgtgtccggtatggacatatcttgtaattctcgggtataaatagaccccgagccctatgtaatttttaacacacacgttcaatacaatttcggcgcatcgccacctttttgctttagttttgtttcgacgagttcttgctttcgggttgagctgcatcggtttcaatcttcaacaagaggtaaaacttgttatgacgacttgtgttctcgagattagtgcttccatctttatgacactctaatcttgtctatataattcgtcgagttatcatatatcttacataatctttggcaatatcgtcatctaacctacaatcggctaacatctgttaatagaaggcagccgattaggttaaatagcgacgttgtcctagattatgtaagatatctaccactttatgaaacacccagcggcttgattgtctagatattgttcttcttttcatacttaatgctacatcagttgagtttgatctattaagtcgtgcttagaatatcaatctctagcatgtcctctggttgccgattagggtagtatcggagtttcaaccgatcttatatgatttaaccatattcgatctatatgcttcaatgacatgttaaatccgccctttatgtcaggatcttattgcatttaagtatattaagcttttgtttggtatattatatttgttttgatatctttatataaagtagtatcagagtattagccgatacatgttagatctatctgatcggctatgctataaacatatataatcctgttattaatatatatttcgatctaagtgatttatactgtctcggcatggtgaccgatctatcccaatcacttgatttaagtatatattaatataagaactatatatcgttaatatctacagccgatcgaatagatttagttcctcactatctatttataaccgccaatcgattcatatatgacatcggctcaaagataaatgatatgtcatcggcacctagccgatcggctatcatttatagatttaaccacgaattctttgtctctatttcttgttgattacaggatcaaatcaattggcacgctcatacattcgaagacgagctttggacctgcattggagctttggacaaaggtgctaccgacggttctctaggaagtcaaggttacaactctcaaggggtccatggagttcaaggcgatggagcgcatggagttcaaggtgatggtgctcaggagttgcaagggggaaatcttaatcagaatagtgatgcggcacaagattttagccgattgtaggttagatgacgatattaccaaagattatgtaagatatatgataactcgacgaattatatagacaagattagagtgtcataaagatggaagcactaatctcgagaacacaagtcgtcataacaagttttacctcttgttgaagatcaaaaccgatgcagctcaacccgaaagcaagaactcgtcgaaacaaaattaaaacaaaaaggtggcgatacgccgaaattgtattgaacgtgtgtgttcaaaattacatagggctcggggtctatttatacccgagaattacaagatatgtccataccggacacgatcactatctctaacaaactctaagataccataagtctttgcggcagacttttgcccaaacataactctaaggaagttacataaaacatcctaattaatagatacaattgccttctcaggactctatccatgtgcggcaatcatcttgaagcacctcaattcaacccgatgtcatacgacaaattatactgtcagaatcggctgcatcggctcacctagtccgactcagatccagccgatcctaatcgtagccgatctggacttcagccgattcttgctctgttctcggatcaatctccgccttcgactccaccttgatctaatctccttttccaatgctgatattaccaaatttggtcgttaacaatctcgacaccaatgatattagtgccaacacccttacacccctatggaagctaactcactaatatgaaggggaatgacgcaaatgacattggcattgaggacctatctacactacttaaaatgacatcaagacctatttataagaaaaaaaatatttacattgtatccctttccaataaaagaaaaaacaacaggtccttggtgttgtcattgtcgtcgtcccccttcgtattggtgacttagcttcgacggggtgaagcgtcaatgctaacgttggcaccaccgagatgttggacctcggtgccaacaaccatggcaccgagaaaaggatccgttttgaaaataagtttttttacgggtctatttataaaataagcttttaaaaatgactaaaagttgaaaaatagtagtaccgctttcacaatctgtagactgcagtggttagtgactgctaatagtaagctagcttgagcaaccatccaaaataatcaagttagaacaggcccgaccaaaataacagaatttttaatctgaactagtacgtactaactactactcatacatagtctcagtccaaatcatagagaaagaagaaagggaacctacccatcgatatagtactcatcaaggaaagcataatgctatcatgttcgttggtggaaattcagttatcagagagagtgattgatcagattgagagagagaaagagattcccatgcgtgatttagtcgatcgatcgatgaatataccatctttttctccgaagcttcagcactaagcctcctccggcgatgggggcaaattataaagacaatggccttatgcacatatcctagctgaaaaccatgagagactgtctaagaatataatctctcgtcgatcaggctcgtagtaccaaccggcgagacgaccgtcaccagcaaaggaaatgaccatcttaccaaccacgtgagatgtcccgaagctaaagcgcgctcgggcaccaagaaatcatgcccacattatcgaagtagttagttagttaccaccagaaagaatcatccatggcgtccattggcagcaggtacgtatactcgtacaagtagtatagtattaggtgtagctggtatagtgcgtgtatacgccgctaatatgatggcgcggctacttattgtgttagggtctgttcactttgatgccattttcaaccatactaaattttagtaaagttgtcagaaaaaaatggctatatttagtttactgtcaaaatttggtaactataaaagaaatttggtaaggtttttttttcatcaaagtgaacagtcctaattaaccccttgtcgcgagttgagagcttgacatagcttaggcttcgtcccgcaacgggcggcggcacgccaccacatgcagcgtctttgcgttggtttggtgccgcgaagaggaggaggaggaggaggagacgacggggcgacgtcagaaaattattagatgggctacaatgcatatccggctagcccacaggtttatagcccattagttgcacttaaagagacacaattgtttgttgggctgtttcccttgccagttgcctaaatgcaagcatatcagagcccaagtttatctggtccaaggcttgtatagtatttccctctacttctataactaatataaatattcgtatttttccggtcgtcacatctaattttcgtccgtttttcgtccatacacaatccgattcagttagcaatagccatgaaaaaaattgtaaaaaaaaaaaatcggcggctgccgacgccaccaccgccaccggagggagaagagaggcggcggagggagctaccaagctatatatcccaccaaagcaaggctgctcgttcaggagcttgatgatggatatccaatttaactctcctagatggataaggattttctagccaaagtagactagtttgataagcaaagctaattttaaaagtaatttaccaaatacctaacctagcttaacaaggaaagaatgttgctagtctaggatccaaacacacccatatctctttgattaactttaagcttagcaacgatgatttgtgtctaagagtaggcagaaaaagaccgaactaaaagaccgagaccgagaccgagaaattcgttcctaggcagtgaaagaccgaattttgttcggtcaattcggttagtttcctcggttaaccgaatagaccgaaaagactgaattaacaaaaaaaaagtctaaatataacctacaatttactaaattcaatagaattaaactatagttttcacatccctactttttctaggcatgcaacctaataagagacgtgcttacggaatttttttttgtgatttttgtgttgaaaatttctattatttctttgcatatataaaaatgttgttgaatttcggtcaggaccgagaccaagtccgaatttgtcagtcctgatatttttgcgttgaaattcggtcttcacttttcaaaaaccgaaatgaccgaaaaccgagaccgaaattttcggtcagaccgaatgcccacccctacttctgactgctctctttagttataggtcattaggttatgttgtactactccgtcccagagaaaaacgaatttctagctacgaaacagacatatatgtgtccaagttcgtatgtaggattggtctttttttttttttaggatggagggggtattgtctaatgcaatttttgttgtgttctctatggaggcgttttagtcaattttgctccaattaattatgcagttataaagttctagggatttttaataaacaagttaactcttttcttttataatgaaaagaaaaatccatctcttttcagaggttttctttggggaaaaatatctatgaggatttgaatttaaacactaaagggacctgcactcctggttcgattactgggtcgaacaaaagtttagtttgttagctgcaacatttgaaatcgatcatgagacccacttagaaaatgaatctctaatcagatgcatccatcgtcccttgcaccgtcagtcacaacggctgcataccacctttttcgtcgctgagttctattctttctttgtgatcgatttttatctgacgagtaacaatcggttgttacagtgtggttttctccatttttttttcatgtatactccctccgtctaaaaaaagacaaactctgagtttccgtgtccaactttgattgtccgtcttatatgaaatttttttataatttatattttcattattgttagatgataaaacatgattaatattttatgtgtgacttgtctttttaattttttttcataatttttttaaataagacggatggttagacgttggacacgaaaaccaatatttgtctttttttttgggatgaagggagtaattagttctattttactcctacacacaggagatgctctaatgggtgaagtcatggtcccttccgttttaagaacacaatagctggcttgttagcatgtggcaccggcacgtgcactactcgcccccaggccccagggcggaagatccgggtctcactgcacgaatctggcaccaccaccaccggcaccgccacgcaccgcacaagattcacccagccgtttgcactgctttgctcgccatcgatctcgcgcggccgcgacgactgtctcgcactgtcggctctctcgtctctcccccttcctcctcttcctctcggtcccgcgcgcgtcaacttctccgctttgccgcattcctccgcgcccctcagatctccgctgactccgccgccgcccgccgacatgtcgtcccgcggcggcgaggacgacgaccacgcctcgctcctcagatcccaccccgcggccggcgccggcgccgggtccggctcatcgtcgccgtgcccatctccgcgggctgtcggtggccaccaccacaaccagcacgcggacgtcgaggcggtgggggaggccaccgtcaccgcctccccgaggcggagcggcggcgtgcgtggcctcctgcggcacctcgaccgccgcctctccgcgcgcggatccggggggcgtcgaagccagcagccgccgcagcagctcgatcgccccgagccgtccccgacgtcgtcgccgcagcagagggagagggtcggggaggagctcggggatggggcgccgccggagtgggcgctgctgctcatcggctgcctcctcgggctcgccaccggcatttgcgtcgccgcgtttaaccgtggggtgagcatttcactggttctgctcacagactggaaacttgactatcctctgcaagtagaaagcaccggagtgaggctcatcatttataggatctaaacgtagttcatggatgctagcaaatgtgaacccaagggactttgcaaatgtgattttgatccgtttatttgtgcaaactaaactagtgcaaataaattcacccaaatgatgcaaaatcagtttcatttaagtgcgcaaattcaaagcaacttaacagagcactgaaagcagtaaatgaaaagccttatgtcacatcatatctgcggttgcccaaaacgcgataaattttgttaaaatttaaaaccttccaagtgattccaatgtaagttaaggttgagatttttcagttctgccttgcatgactgattctatagacagctcctgttatggtatttttaggttcatgtcatccatgaatgggcttgggcaggtaccccaaatgaaggtgcagcttggctccgccttcagaggctagctgatacttggcacagaatactgctgatccctgtgacaggaggcgttgttgtaggaatgatgcatgggttgcttgagatatttgatcagctcaaactcgtgaaaccgcctcagaaacaaggaatcaatttccttgcggcaatctttccaactgtaaatgctgtccaggctgctgtaactctaggtactggttgctcactggggcctgaaggtcctagtgtggatattggcaaatcatgtgcaaatgggtgctcggaaatgatggagaataacagggagaggcggattgctcttgtagctgctggtgctgctgctggaattgcttcaggtatgtcattgatgattacgtacctgtttccttagtagaatatcatgacttcgatagctagcaccttacaattattatttaaggatgtattacgtaatggcaattccatgtaaattggatagcatttatagttaacatgtattgtttcggatatctttgtaaaataacttgaaatattgtatttcacgactcccatgtaactctaaaatttaacattttgattttgttcctacccttttggcctttttgttgttagcgcttgctaatatactgtttcttgtgttgtgtgttttcaggcttcaatgcagcagttgctgggtgtttctttgccattgaaactgtactgaggccactgaaagcagaaaattcacctccttttacaactgcaatgataatattggcttctgttatatcatctactgtgtcaaatgttctgcttggagaaaggccagcttttatagtgccagcgtatgagctaaaatctgctgccggtatctcccctgattctttttacctttatctttaagattgaagattcatctattaactacagtaacaaacactaccaatttttatcatgttatgatacaccacttgcaccactaccaattcttggttcatcaagccctaatatgctatctccattttgttgaggcctatagtaatatgtttcagagatgatgttatcataaagtttagcagcacttgccctacttttataagttattcacacaaacccaacttttctattatcttgacatggcttcttggttgaataattctctccttttgtattgttgtatatgaacagcataggttctaaaggatattctgtcgtctcattttctgttctgcagagctacctttatatctcatcttaggaatgctttgtggagcggtcagtgtggtatttggccggttggttgtatggttttcgaatttttttggatacttaaaagaaagatacgattttcctattgtagtataccctgctttgggtggactgggagctggcctcatagctctcaaatatcctggcattctatactggggtttcacaaatgttgaagaaatactacatactgggaaaagtgcttctgctcctggtatatggttgttaactcagcttgcagctgcaaaggtagttgcaactgccctttgcaagggatctggccttgtgggtgggctatatgcaccaagcctaatgattggggctgctgttggagctgtttttggagggtcagctggatatttgataaattctgctgtacctggtaatgctgctgttgcacagccacaagcttatgctctagtaagttgctctgttttcctttttttttttcatattgcttgaagcaatactgttatttctacatccttgtatatacaaaaactaattgtcagaactccaggttggaatggctgctacactagcttcagtctgttcagtcccactgacctcagtgctgcttctctttgaactgacaaaggactacaggattttgcttcctctcatggtaagtatgactgtttatgtagtgtgcccattgttttgttttgatatagtctttctcttttgtcacatcatgatgtctagaagaggacataaatgttgtgattttatgtttcactattgcattatcaaaactaatgcacttattttttattgtccaacagggagcagttgggttagcaatctgggttccttctgtagtaaaccaatcaaaggatggtgaaccatctaggtttagaacacccaggcgtggttattcttcactttcttcagaagatagaaatagtaaaagctggaggcgaggtgacagtgtaaatgatcttgagctcactagcttacggactgataactatgacacctataatgaggaaatgcttctagatgatttgaaggtttgtaggcctctaattcttattgttaacggtctagctgatgcaatggtgcgttcaattttcaatagaagtacatgttattatgttaattctatcctaatttgtcatttgaactcttttaccaggtctcccaggccatgtcaaagagctatgttaaaattccaacatctgccatggtgacagaagctctcaagcttttgcatgataagcagcaaaattgcggccttgttgtggattgtgaagattttctcgaaggaattgttacattaggggatattcgccgtatgggatttgaattacatggggacagtttcacaagtggagaccagctcaagcccgctgtacgtttgaatggtgaaaatatgtatttccattagaatagttctacgtaaataagtaatgaattggtgtgcatcatttcacttggtctggtctaggctggacactgattttgtttaaaccattgccatttaatgcgatagcttaaaatgaattctaaattgaatgtacatgctttctatctctgaaaggtaaaaacaaaacaatttacacaggctggcaaggaatgtgtactaattaatggagatgttgcaggaaaattcttcaaccatatcattgtgtcttactcgaggattccagtacgaggggaatgaacgtggattgctaacctgctttcctgatactgatttgaccactgcaaaaaaccttatggaggccagaggaataaagcagctgcctgtcgtgaagcgtggtgtcggccatagaactgaaggaaaacgcaagcttattgctcttctacattatgattctattggtcactgcttacggttagtcataagcttatatgtgttctttcaaactttatatttttttgggtttattcagctttaactcaagataattgaattttttttccgcttgtttaattcatttgaattatactgaaatgtcaattcatttggttatgaagggaggaaattgagaactggaaggccatatatcaaataaaagaggacttccatctcatagcaaatgggcattgaacagcattacattgaccaatattacaccacatcaatcgcatgcaatttgatatccttaaggcatttttgccaaatggggatacaggaggtatacacgaagttcaacttgtacagatttgaggctcctctacaaagaattaaattgccatctgaggaaattattcaggctagctagccaattttgcaatagaggttatggtccattcttgttgcgaagcaacttctacttcacacgggaggagatgggtatgtatgaattcagttattcagaattggaaagtggcattgtaatgtatatcttgtacctgtactatttgtaactgtgtaacatcctgttgctgggaagcatcatatgcgccagcttgtagaggtgcagtcacacgagaaactagtgtaataaagtgtgcagcagaaaattttgtcaagaagccgatgttgtaggttgtagcgtcacattgtatgtaacactttatatcagcacttgaactgaatttctccctttccgtgcagttacataaagcttgcagagcaaagttgctttatcaccatcgctgtcctgagtcggagtcatgtttacagcgaccgccgtcgtggcatgttttttttacggaggctgctttctcttcctgtaaacttttcaatagaatttttttttaaaaaaaatcacactggttagcaatttaaaaaatatgcgctcggaaaataagggtataagttaataaggatagaagttgggaaaaggaaagaacacatcatccttatatgttactcctgccgtcttaaatacagcttagcactaaattatacacaacttaattatacaatataggtagaagtccatttccacttaaatccgtaatagtttgctactaccttcgttttcaaagtactccgtataagttattttgatatgatgttatacatttcaatactatgaacagattttctgttcaaatttataatcctaaaatatattatatccgatcaaaattaagatagtatatgtatattttaagatgaagacagtagcgatgaacaacatgctcatgactcaggagtcaggagtcaggacaggagtcgcagcttcttccggggtgccccgaaacggagtaacctgggcactcttttcctcatcttctctacagcaaccgcaccgtgccacgtaaatctatcggtgaccgtctcgacctccatggaccgcactggtcggtcgggaatggcacggccccaagctagcctcaggcctcagccgtgctccggcaaggcggcacccggcaccggtctagcatactagtctgtcccaaaaaaagctaaaccctggctatgaacgtggacacgcatgtgtccagattcgtaggtagaattggactttttttttaggatggagggtacgtcttttgacgatgcgctgaaacactgcagttctctgagccaagccacacgtagcctattgcgcatgcatgctatgcagacgaccttacaaaatttctactcctctccgcccaaaaaaaaaataaaaagttttatcccttcaatactttttacctgcctatcactatcactatttttttaaatgattaaggttattatagtcactctctatttcctctatttttatcttgagatgttagaattgtttttttttttttttatggagggagtaaggtccaaggctagcatctcatctcacgcaacgtcacagtcttcgcagaaacgccgcaagcgacaacgcgatacgctgctgcgtagaagcatccggctttggcctttcacatcaggcaacagcatcgctattgtatggtactgtactgtgtcacataccggtggtccatctcactagctaccgttgtccccgcccagcccgggtgcaaaagaccaaactatcgaaccgaacacctcaagccaaggagccagacggagccgggcaaggtgaaagctcagtcagtgcacgtgtattttactactcccaacttttccacggattagcaacgcgttttctcgaaccgaacaggggacaggggatgcaaaaagagactacctgcgaatctacttatatgtcaaataagtaataatctatggatttctacgttgtggctcgatttaattaccgtaactaaaaaatgcaagtgggttgattaataaatctatttatatatcaaatttagtaagtaacccgcaagttaatctacgagttattagattatccattaattttgtatataaataagttcgcgggtttgtcggttacatcccccaggcaggaggaatcccgaacgaacccgtttcatgccactgtgcgtagcaacagaacggcgcggcgcgctgattcgttgacgagtgggagataattaagccggggttttgtatccgcgcctgctcccctttggcggcttctgcgacggggaaggtgtcgccgagcgcacaacagacggggctagtggcacaaaacggcaaaactagaaaaaagaattggatttttcttttccatttacgtgcgtatatattatgccttgtcattggctcgtcgctgtcaaatatttactatcttttttttttactgtcaaatgtatatagattagtgcgcatattaaaaattcaagccgaacaagacatgttcattattgcccaaaaattaaagcactttcgatgttttgcacatgcatgtactcatcattattacttcctctatcttcaaatatatggtcttttgtcggatgtgacacatcttaatagtatatttacgaatctagataagatgtgtcacatccaatcaaagtaccctatatttggaatagatgtagtaatatatattcaaaatgcattctcaactgtgtgtctatatatatatatatatatatatatataaattcataactagcattagataaatagctatagtacattttaggatggaggaggactgtattagaaagagataactatcgggatcatgtcatctagtctctctttttctaaaacaacctcgttctttttaagctaacgaaggtatgaactatccgtgtgacgcttaataaagtacaatttctttaaaaacatgttgtctagtagatatatattttcttttgtctaaactagtacagtatttattaactttagaatctacaatgattaatttaattaatttatcggctaatgacctggaaccgggctgtcagctacagctgtggtcttcggatgtggttgttgcgtcagcgtggaggttacttggggtcttcagagacttgcaatgggctatataatgtacgtacggcattctagctactatggcatattggcagttgatgtgatgtttggccaaacatctacagtacagcctgcatgccattccacgaagtgcgactagaagtaaacggcgccagtatgccatgccacaaattgggcagagagaaaaatgtgccatatggtccgtggtcttccatcaacaaaatattggtcgtagctacactaactgacgaacttgaattcacgatcgagccgtccatgcgcatgcacgcaaatgtgaacgtaccttgattattctcactgattagttatcagaaatttagtcctgcagagagatgatcataagctgccagccctgagactgtcgatcgtatcatgattcacaagtggcatactggcattttctgcggtgatcacggattaacggcagcaacaccacatctgaaaatgacgggataccatattaaaaaatatatatgcatggtcatagttttaagatgctgaatttcacttgagcagtacgttcaattctctcgtacgaacttgaaaattctctgtttcagttaagccctatgtttacgcggacaactacgaccgcacgttataccgtcatagagcggtataccgtcataggcctcgttactgggtgagctatggtccactggactggaaggcaaatcgaggaaggaaagtgctagctactccgtatatgatacctcggcaatattatgatcgagatcccccgagatattaggatttattaatcctaaggtgttatgaaactttgaaaagaatcaatattgtcataacaatactagcatattgtagtttcttgaaactccataaacatcattatcattgaatatcactatcatggaggatgggcaaaggatttttagaggattaaatttcctaaggaatttttattattgaagcctttttcgcgaacacattattgaagcctttcattcatatgaaaagataggaaatatccatatgaatacattcttacggtccagtccaatcaataccataggaaattaaagcaagaagttagagttatttaaattttttatttaactagaaaagatgtctgtacgttgcagtgggtgaatgctattttaatcttgttattgttatacggtttggctagggtgaaattcgctatgagaattcgcttggatattttttttctagaaaatcttgagctgcaattaagagtctgaaattcataagttagcatgcaagtgtttttaaagagatttcttatacgactccttttgtattttcaaaagcaaacgaacttaaaatctgacttaaacacggatctgtatttttaaaagtgaatgaacttaaaaaccgactcaaacgcggatgacgtaccaaaataccggtaaaaacatcttcaatttttataatagtaaagatttgttcaatttttcctgtgatgtaatgaaatggcttgtcttctagtttcttatgctttcaattcagatagaatttgtaaaaacataccacttcaaatttttgttctttttcttgtttctgtatttttcttatcatgcgttctaaagggggtcttattatgtatcaattagcatcggttagtatcaagtatcaaaaagtgtggtttcatcatgtaagggatatcccctcgtttcttgcagttttataataatgaaaatgatttatatttctggcttctgtgctaaggcacacaaataaaaaagagacgataggtgatgggacaaaccctcaagggcctcaactccacattattattaactagcgttatatcaaatagattccgccaacaattctaatagaaactatttagatgatatgtaaaaaagtgagaatatattctcaaggatgagaatccatcttctcaagcaattcagatctactgtagtagtattgcagatacattactactcactgacatttgggctgtatgtccagtgctacagaggacctcactccttctcaagtatcatcatgtatcaaagagtatttcaacgaatatcattgcgtatcaacgagtaccatcgaatatcaaactattcgtcgtggtgtatcaacaagtatcatctaagctttgtttactgagtcaactgcgagtctccgtcaattagtaggtagtaacatggtttgcgtgctatggcatttcgtgcgtttgcatgcacgcatgaaagtctatcctctctctatatataagttgataggaatttaaagctgcaattatctagctgatcagcttgcctaggaagcaaggaattagccatggcttctgtttcgccgctactgcttctcctcttgtgcagctaccactctgtagttgctcatgcaggagatggacagagttacaaggttcttgagctgaattctgaggccgtctgctccgagcgaaatggtgactgtccatgcaagcgcatagtttttctgcaattttcgtgtggtttttcagtgaaattgtaatcgttttggtgcgtcaaattttgcagcgatttcgtcgtcgttgagtggaaccacggtggcgttgaaccaccggcacgggccatgctcgccggtgccgtcgtccaagaagaggccgaccgaagaggagctgctcaaacgcgaccagctccgagccgagcacatccagcggaagttcgccatgaacgccgccgtcgatggcgccggcgatctccagcagtcgaaggtgtcgtcgtccgtgccgaccaagctgggctcctccctggacacgctggagtacgtcatctccgtcgggctcggcacgccggccgtgacgcagacggtgaccatcgacaccggcagcgacgtgtcgtgggtgcagtgcaacccgtgccccaacccgccgtgctacgcgcagacgggcgcgctgttcgaccccgccaagtcgagcacctacagggcggtctcctgcgccgccgccgagtgcgcgcagctcgagcagcaaggcaacggctgcggcgccaccaactacgagtgccagtacggcgtccagtacggcgacggctcgaccaccaacggcacgtacagccgcgacacgctgacgctgtccggcgcctccgacgccgtgaagggattccagttcgggtgcagccacgtcgagtcgggattcagcgaccagaccgacgggctcatgggcctcggcggcggcgcgcagtcgctcgtgtcgcagacggcggcggcgtacgggaattccttctcgtactgcctcccgccgacatcgggctcgtccgggttcctcacgctcggcggcggcggcggcgtgtcggggttcgtgacgacgcggatgctcaggagcaggcaaatcccgacgttctacggcgcgaggctgcaggacatcgccgtgggcgggaagcagctcgggctgtcgccgtcggtgttcgccgccgggtccgtggtggactccggcacgatcatcacgcggctgccgccgacggcgtactcggcgctgtcgtcggcgttcaaggccggcatgaagcagtaccggtcggcgccggccaggagcatcctcgacacgtgcttcgacttcgccggccagacccagatctccataccgaccgtcgcgctggtgttctccggcggcgccgccatcgacctcgacccgaacgggatcatgtacggcaactgcctcgcgttcgccgccaccggcgacgacgggaccaccggcatcatcgggaacgtgcagcagcggacgttcgaggtcctgtacgacgtcggcagcagcacgctcggcttccggtccggcgcgtgttgaccggggcgggcggcgcgacgccggcgcctggcgggccgggcaacacgacacacgtagaggccaagagggtagcagtaggttgctctcatgtggtcgtctacttgtttgtggttgcgaggtaagagtcgtgacgtgtgatgatgacaagatataatgatatatattgcaattgtaatccaacaaccaaaatattatattagtccctagctctaaaaaaatattatattaggagtgaacttttcatgattttttatgaataataaagactttatactgattaattcgatcgtttgattcccaatcgacggatgcatcattagtgatccaagtgtctggccaataattagtgtgtgagaatggtcttggtgattcccaatggactacagtttgccctactgatttaccaacagaatgttagattgcacgtaactgcgtatggtggcacttgtgcaatttttattttgtttttctgtactattctttgttttggtttgattctttcgaatggatttaagagaactgatccatatgctcctccgttttttttgagatgctaccattcatcatattcaaaaaattaatataaatattattttattttgttatggcatgttttattattaaaggaattttaagtatgacttatactttacatatttacactaattttttaaggagataaatgatcaaacattattaaaaaaaattaacggcattatctattaaaagggatgtactatattaattttgtggtggagatttcgatatcgtccactctgttcaccagaacatatgtaccccatctctctatttcttactcttgagggccaatagtcttggataataatgggattttggtatgaaacatcaattctattttcttttcctttggagcaccggaaagcagctgtcaaactgatacagaattgtgccaccaaagaatccctagtagagtacacatggcatttcaaagagaaaatcatgttattctcctagaaaacatctaatggattcttcttctgctatctcatagtctacttgttgccttataggttaatgttttgttcttatttttttatgtctacaaaacgaaaatgttaattcaaaagttaattttgaggttttaatttttttaagcattgactttaaaccgttacaacacatgcatgaaagtatttctttttttttgtaaaatttattttatcatggcttgtcagccgtatatcaaacagagtttataggctggtccacgtgtatccctactaatttttttttgtgtatttgctatgaccctagtattcttgtgctttatcatcatgtgagttcataatttgtgatgttttgttcttagttttttatgcctgcatatattaagagttatgcattccaaagaggaatatcttcggtataaacatatttgaaattgtatatgctctaaattgttcaaactataactctatggcccttgactttcacacaaatatcaggtgaatgttcggctaacaaccatcaacaatacagatccagcattatctacgagattaaaaaaaaagataacgttttctctctgggccttgggccacagcagccacaatgcacaacagaacgaggtggccccacagtcccacacgtccccctaactgtccactagttttagacttttagtcgtagcacatcagttgagcaccgtgccactgaccacgacgcaccaaatcaaaccaagcgtgtcaagcgcctaacacgtgcacatggttagcccgtttaactaatttattattattactctcaaaaatcgtatatccactaacgaaagtactatgccttacaacctttgtgtatttgtgtactatgtactctcctactactagtgttatgttatgtatatgcgcctatcatcctcgtgtacgtacgtacattgtacgcgtatatctatacacctatacgccatgtacgtactaaagaagaatactgtcgtgggtgagttgttaggatggatcgatcagcaggaggcgggcatgaagccgacggtgctgccgtcgaagcgcacctcgaacgagcgctgctgcacgttcccgaggatggacgcctggctgtcgccgccggtgggcgcgaacgccaggcacccgctggtgaggatccccgacgtgccgaggtccatggccgcgccgccgccgaacgcgatcgagatcgtcggcagcgtcacggtgccgtaccgggtgaagtcgtagcaggtgtccaggatccccgtcgccggcgccgacgggtagccgtagggggccatggcggcgcggaacgcggaccgcagcgccgagtacgccgtgggcggcagccgcgtgaccaccgtgcccgtgtcgaccaccgcgcccgacgcgaacacggacgcgtcgatgctcagcggctgcccgccgacgctgatgccggcgagcatcacgatgtagtatgtcgggtcgttcgacgccgtcagcagcggcgtcgtggagaagccggcggtgctgctcggcccgcccagcgatatgtaacccacggagttctgcgtcggcggtaggcagtaggagaagacgccgccgtaggtgctcgacgcctgcgacaccagggactggccctgccggccgaggccgaggagcccgtcgacgccggcgaagaggccctgctgcgcgtggccgcagccgaagaggaaccccttgagcgcgttcgacccggtcagcgtcagcgtgtcggagctgtacacgccggtggtcgtggacccgtcgccgtagctgaccacgtagccgcactgcccgccggagcagccgttggagtacaacgccagctgcgagcacgacgccgcggcgcacggcacggcggagtaggacgacgaccgcgtcgggtcgaagagcgggtccctctggctgtagcacggcggcgaggggcacggcttgcactgcacccacgacacgtcgctgccggtgtccacctccaacgtctgcgccaccgccggcgtgccgaggctcaccgtcaccacgtactgcagcgtgccgatggagaaccccaggttagccggcaccgtcgccgccttggatcccgccagctgcatccccggcgcggcggcggcggcccccgacaccctcctctgtatgtactccgcccgccgctggtccgcgcgcagcgtgtcgaggaacgacggcggcgatcccagcgccgacgccttccccgccggggcgcacggcccgtgccggtgcgtcagccgcagcaccgccgacgtgccgttccgcggcgaggcagctgaaactcgcaacgaatcccaatctttcatcacaatccggccccaaaaaccagaagcaacagttcgatctccccgctcgctcgctgtctactactactaactacgtacctcgtccagggagttcgtcggcgcaggtggagctcaccgcgaagctggatgtggagacggtgacgtagcccctcgcggcgtcggcatggcggggcaagaatccgaggccggagaggaggatcagcgtcaagaggagagccatatgcttcgcttcgcttcgccgcgcgcgcgcgcgttggcaccgagcgggaaggggacggtgtggctaaataaggcgtggtagcaccaccagttggcgcgtcggcggcggcggcggcggtgcggtgcgagcccaacccatgacgatgaccatatgatgcggttgcgctgtgcgattggaattcttcgttcgtgttgggttggggggggggggggggtcccgtctcccaccgaaccgaagcgaagcgaaacgcgacgcgacgcgatgcgactttgcgagtctcgttttggtgcggcgccaacgaaggtgggctttctgcgcgcgtcagatgcgaacgtattattgcgttgcatggacgatggatgattggagaatggcacgtcttttttgtagtcgtacggtttagcgtatcggcgccggcaagcttgaggctcaagcttagtatagttctggtactaggaactaatcccaatcctaaaacttttttttcctgatgatataattctcataacctgtcaaattggtgtctgaaatttgaaatctgaaaatgaactctactaaagtttgcatatggttctttcagtgcctttacagtttctcaatcgattccttttagaagtagtaccttttacatgaaatgaaaaggatgctcaaagtcccaaagttgtgtcacacaactgttacgctaactgttcgtctccctgacggagacctttatctaccgctattttcatcggtggcgtaagggatctatggccgtgagcgcgacacgactgatgtgccagcaaaatacccaagttttcttctcccgtccctgccactgtttgcaccctgcgtctccccaaaattctcttctccttcgccgacatgctgcgagcctgcacactgatgctggtgtatcgcaaggctgacgacttcgcgttgcttatcgcagcgtggctctcttgagattactggtctaaccgcccggattatccgccgggtcagtcctgtcctgcaattcgtgtacagtggatggccggtctgcatatgtatatgtagtggtgcattgccgaacattggacgagtggtttgacatggattgggtgggtcctgaacgatgagcaactgagcatgcatacttaggtagttggtactcctacttggtagtgccttggtcacatgcagagcacttctcttcattctggtctactgggaatttggatagataatgttggttcgtagtggagcaggcaatacccgggtttggtgcttcttgagtccctgatgactgaaaaatcacaggagtcgcactgcatgactaaccggcagtttcatggtcgaccggtaaaacaggctttcaggcggaagtgcgtgtgccagaatttgagtggtacagtctttttcacaagtgaggagtagcaacacgctttcacaggaggttggcagccatgcatcacgatccagtgcagttgcaagcatgagcctgtttggtatagcttcagcttcagttccagctctcccttgaaattggaacttagccaaatagttctagctccacgtaaaataggagcggagttgaatgaagctttttcacaaaatgaactggagaggtggagctagatttaggcagctccacaactccactctatatctaactcctgaagttaaaactctaccagacagaccctataattgcaacttaagcagttgttcgggagttcttaaaaaaaaagccagttgcttcggcggcacatgatagagaagttaaaactctaccagacagaccctataattgcaacttaagcagttgttcgggagttcttaaaaaaaaagccagttgcttcggcggcacatgatagagaaagtaagggcctggatcattgtgtgactgtagcaaaaatatatattttatacattttgtagcaatgaatgtgaatcgttaaatcaaaatatgaacggttgattacttacagtcctttttagtaccaactgtatttgatctcaatccggtaggcataggtatctgaatttacaattttcagataacccactcttgttttatccgccaaataagccatccaaaatatacaaattgtacagacactaaaaaaaaaactcactacagaaagcaaagaagagtgacggttcacagtgatgattgtgatgcaaccactctgcatcacaactcacaactcataaccctctgaaaaatggtaccaatctctcctttccgatggccatctccctgcgcccaatctccattccgcaacgcttccggccgccggacggcgccgtcctagctccctccggcggtgccgccgccgccactcgctcgtacggtgcggaccacttggcctgcacgtaccgcgcccgcctccacggcggcaggtgcatgcccgcgccgcggatggactccgccgccgcggcgcacattgccgcggcgacccccctgaaggcctcgggagtcgcgacgagcaccggcgggagcgagaggaggaggtcctggtactcggcgctcggcctcgcgatctcgaactcgccggcgacgttgacctcgacgatgtagcgagcgcgacgccccgtcgccgacgccgccgccgtcacgtccacgtactcgtggctgcccgccggcacgctgccggttctttcccacgacgacctgcacacgccggcgtcgaaccctcgggcgcggagccgctcgacgactcgcttccggatcacgtcgccgccgttgcgaacggcatcccggacggcgcgctcggcctcggcgcggatgcgggcggccgccgcgtcggacgtcgcgtccgctagcgcctcgcgcagcgcgtccttccactcggtaggctccggctccggcgacgacgacacgccgcccctcgccgtggcgtccgcgccgcgctcgccgtcgtcgtagaactcgtgcaccagatccaccaggaggtcgtcgtcgtcgtcgtcttgatcacgccggagggacgcggcaccgctggcgaacgggccacgcagccgtgccctggccgcctcgtccagcaccgccgtcgccttcttgtacgccatcggcgacggccgcgtcgctcccatccaacacgccaatcgggcggcgcgcgatcgccgggttgcctcgatcgaaacgagcactgcacgcggcggcgcgaacaagatttgttgccgtgtgccggcaaagccgtttccttttccgttgcaggttcgggtggattggcgtcttgtacgatacgaggcggttttatatatgtttcggtgtgtggacgccggggcgtttgcgcggctaggttcgttggtttttacaacgtccaggtgcaatgaaccttgtacgtccaggtgcaatgaacctttgtacgttctgtatgtccagatgcatctcgctataaggtttcagaatcagaattggttgaggcgtacggaagcatgtgagaaactaaggccccgttggtttttcagttggacggatattttcatagaacgcgaaacgagaatacatatactagcatatgattaactccctctaggttttttatatgacattggctagtttaacatacatatatatatggaggtaactaactatcaaaattaataaataattttacttggttttttaaacaacttctacataaaaactttttatatgaaaagcatgtgctaacgaaaaacgataaagttaaagtttagagttgagaaaaagaactagcctaagaataaactattggtcatatcttttcgcttatgcttagcaaccaaaatttaaatttgtaatcttaaatttaaaactgattttgaggtttttttttcatcaaagtttatattaaacatttgcttttatatcgttaagaacgagtacatataaattatattcacaaattactttatgtttgcaaatataagagtttcattaataagccaaacgatgggccgatgctggtgttaacactatggtttgtttgaaggtgccctgatgttaacgctattggccgatgctgcgtccagatacactatgcatgacatgcgtacgtaatagaagtttcaaggttattcatgggactgaaaaagcgtgccatcatgattaacttagtctattgcatataaacccacaggtccatttgccatgattggcagtcagtgcatataaccctgatcaattgccatcatttgccagaaccattcatcaattctagagaccatctaaataacatcccattttgcatatcagatatgcctggcagtaatatccattcactaatcactacagaggagattgaacatgtcaggtcctcttatgagttatgacttgttatgagctgtccatcgggttatcacctgaagttggtgcgggcgcgccattgtcgtccataggagtgttggcctccattgctccaaaagtaaaattactaggaatattacttgggttgactcgctcgaagatggacggcacgggctgctggttgaatacgggcgcttggatgtcacctgccggttttgggaaaccaaatccaagaggacgaaatgattcagttggaaccgacgattgagcaggtgcgccaacattgggtccgaaaagcttctgttcatactcaacgagctgattctgtgaagctgtatatataacaaataggttactgttagctcatgatcaaacatttggattaaccatcaattcataatgttacttgaaaaacaaaaggcgaaatctataagaacaaaaaagcttgagtagtagctatgcataagtactagggcgctactatgctaggtaaatgagccacagaagctttcaaagcttatctatgtaaatttaagagcctgtataaggtccccgtcaagcactgatgctacatcctattttgcaaagaacatctcgccaagcacctatattaatttgaataggggttggcaaagatttttcaggcatgaaagaagaaataaattatttggtatgggatcataccatctgtcagttgcacctgtggtcgccggtctttcacccattggtaagactgtgaaagtctccatcccctagatttcatcaagtagcctattacaatagctgcagacctggaaattttgtaccagagaagtattaatcgatcattcacaacaatgctaacaacatgaatgctcacaacactgctatcacacctgttttttccagacatgcaatggacaagaacacgtgatgtctccctttcacactgttctgcaatggcagataacgaaacaaatgataaaaacaaaaacatccaccatttgtttctagtttagcactgcccaagcaaactacagcataattcctactacaggaatgcatttccattggttcaaatgtcaaaacaagcacagagactatctactggagtacgaattcaagaaaaacttgaaatttcacagggaaaaaatagagatttcattccattccaaacaaaaatgctcaaagaatagaatggattttacctaaaaacctgtttgcaccatcaaaatccaagctcctctcatcctgaatgcagtgataagtgaaagaattccggtagagattctgacaatctggcacagtctgcgatatatgagaaaaatgcttacatgattaactaactaatagaggaccagtataatactaagatatcagtttatcacaataatgtattaaaaatgaagagggctatggtaccaacatttctaagctacaaaatgtccccaacttttctttactccgcattttgtcaaatctctttgtttctcttgtaggataaatcatgtttagtgaaaagacatatgtaaagttcataaaatacaaacatggcaccacagcggcacggtcatccctgataaaaagaaatatgcagcagaactacaacttttaggcctatagggtgtaaggagaaattactcaaccaacaagaaagaatacattatgagcatacgatgcatatcatccaaaagtaggaagataattagaatatgagcgaattaattacaaaggagtagaatctacttcaatctaacatgacccaattatcaatctacccagttgtgattgtgtgtttatctttacactttctttcgatcaagtcccctaccccaatttgtctcagatatctagtttgaagaaactctttacactaattgttttccttgtttctaaaaggctaatcattcattaaaaaaggccaaccactcagggggaaaaatatgcttgatacatttggtactgaaaaggcaggtcataagtaaggctccgtctgattcaattgtttggagggatattttcagcgtacgcaaaacaagaaaactcattagcacatgcttaattaagtattaactattataaaattgaaaaatatttttttaacaacttctatatagaaactttttgccaaacgcaccatttaatagtctaaaaagcgtgctaacggataacaaggaagttgaagtttggagttgagaaaaagaactggctatgagggcatgatataccatcaaacaaatgtacaggaatctgtgacaatgcaatcaacacatcccatccttcttccttgttgcaacttttctaccagcgataggagcgaccacattgtattgaccaatggatgataaccctttccctgtcaacatcaaaccttaccaacactctacaacttcttcgagacaacaagataaacttacaaccaatagtccccaaaccctagagatacttcacaaaaaaaaaatattctcacccgcagaaggggagatcatgacatcgcgcctcaactccatcacgcagaaaaacaagtcaaaataggagcgattgggatcatgagaaaggggggcaacacattacgcacgttgaggatgtgggtgatgctgagcgtcttgaggacctcggagcgggaggcgttgttgtagctgccgaggaagaggaagtccttgaggacctcggtggggaaggccgggtccagcgtcgccgggggctccccggccatcggccccgaccggtggccgcagaccccgcaccgctccccttcctcgctgttgtggtagtgcccgcagatctcgcaggggttctccctctcccgcttcctcatctcgcctcctccgccggcctcgccgcagccgccgccgcgctcgatcggccggtggtggtggtgcggtagtccagtggcggcgcgcgcgcttggagcaaaagaaagggttcggagttgggtttttctttttttttttctttttctttctaacgcaaagcttttcggctttctgggaatttttttttaaaaaaaacttcggcatttggttgggtaaaaggaagactgagccgtcgatgtggatttggacggctgggatcgtctcggcagttatggcggtgtcgtactcgtacaaggttggtgagattgcgtatgggctgatgactcttaagctaatcattttgatgaagtatagtgctagtactccgtactggttatttttcattgctatgggataatacacaagttttagataaaacaatatacactgtgttattttagttttaggtgttgggcgattaagaatttttttcaagaaatatcaatttaagatttctgcattgggaaagggttgaattagtgcccgcctgccaggttaaataagggtcctgtttggaagattagcccagggctaattttgagagctaatatttagtcatgaattggtagactaaacattagtctagggtggcatgtgcatgtttggatccatgggctaattcaaggctaaaaggtggagagagtagaaagagaggagaggagagagagagagagaacagggccaaggtcataccaaaccggacccaatgttgcactgaacagacatgttgtaaaaccaataaaacttacgagaggctaattttacttctgacggcaagattagagctaaacagctaatataaaccgcccatatgtttgaacaccactcaggcactaaccaccagtcaacagaaagaaacgacaggtctaaaacctaacaacaagatactacaacgaacacaataaagggtgtcaaaaaagacagaaatcaccattcatctgtaccacatcgagatcatgtcgagccaggaaccggatcagcgtcgaagttttcggtggatgagtctgcagcttccttgtctgcaggagctgcttcgttcagtgaagttgccgtgttcttcgacgcgcctttcttgtcatccttaccagcagaccggccagtactcttgctctcgttcagctgattgccggttgatagccttctactcggtgtcccgtttgatgcgccaccgtttggctttgtgccagccaccttctttgcactggtcactctgtagggattgacccgtgttccgaatggcccctcacggtcgatgtttagtagctgttccgtctggcgtttttgttcctggaatgtgaaagaaatagaacagatgattttgatgccaattgcaacatctgactcatcatttgattgatcgaagcgtggataagtagcaccaccatagaatccttgttgacaagggcatttggatgcaatatccagtcgatactaaggagcttctgatagtataagaaaggaagtgtcactaacccgcattcttttcttctcttcttccctctcttgcctaagaatgacatactcatccagcattgctagcagagaaacaccgtcatacataaatggcagcccgtgattttcttcccaagctctcgtcttagccaccagagtttcaacaagggctaaaaaaaattgctgtcattagcaacgaacaggaaaaacaatatttacaggagaaaagatatagcctatcctgcattatgcccaaatgcagagcttcttgagttggattgtgtaaagcttagaattatcatttactgccaaaactatttacttatgcatcacagtaggcacctggaatcttgctgactagaatacgggccttttctgcacgtttgagattcaggtgagcacctcggcctgagttatacctgttgtcatcctgcaaaaggaatttcatgctcagtacttcatagcttcagaatataggtgggataacacgtttcactagtagtcagaacaaccatactctgctatagtcttcaagccagctttcctcctcgcatgaggatatccatctctcaactttatctaatatttcttttctgctcagagcttcctcctttgctttcagtatctgactatccatgtcagcaatcagttctgaaggttccatgttccctgactcaatcagtgcctgtattttctcatgggcaactgctgtgtctaatacaacatgagtgctagcataaatatcttccagtatggcttgcttcttaaaagctatttctttcatcttgctgtattttagctgatccaacctttcaacctcagtctgtgcctgaaatattgggtaatgaagatcaaaatcaaacgagaagtaaaaaatatatatgaagggatgctgaaggtggtccaataaaagaccaattagtatattgtgtgactcacttgatcaatcacatcaacagcaagtgcaccaggaaccatgacctcctcaacagttgctgttctattgcacgaaacatgatcaaacaagctcctttcttccaccggggtgtccataagatcccatagatcatagagttgagtggcaagctcttgaagctgaataaacagtataaatcatacatgagatccaggataagaatggctcttggttgctaagtataaaactgaaagaaagaaaatatgagttaccttctcaagtctcaaccttttgtcctcattaagagtaccaatggtcctatcaagttttgacagggtttcattgcttatgttcttgtgttcgttaccaatagagtcatctagactgctatggacttgagttattgttctaaaaaaatccatcccaagcacattgcatagatcatgtaccataccaacatgctcaagaaccttttccagcctacgactctgtgatattcatggaaacatatattatagtctctatgaaaccaaaaacacagagatcaccaagcaatataaattacttatgaaaaccaaatgaaacagacaaagtttgtaccttctctttctcaagctcttgaagctgtaactggaactctcgaagcttccgaactgtcaaatcatcctcattaatctgtggtagtgccacttgctgtcccatctccagagtaccagcaatctcaccacgtatttgctcaattcttgactgtatattagctaattcctttattctctcctttttcttcttgcccaattgttcaagtgttggagctatagcagttagttgttccttgatagtccgtgctgttttctcaggctgtacagataaaaaattgtcacttttgcatccactaatatttaagcataataatttagcaaacatgtgaagtgccatctgacttctgaactacaatgccagatcctattaaccataatcatcagtttcaagaggacttgcacaccgttactaaaaaaccaactgcatttttactgaacttctatgcaagtactaatagtgccagcaatcaacaccaaacatactctagcatggcagaactggtaagtcaagatgcaagaaacacaatgacacagaacaacacgaaagtggatcagtagtcagtatttcaacaactcatatttgaatactgaaaattttagtgaatcgtgcctgcctcattctttccagtattaattcagactgaaattagcctatgcgtactggaagaagacgcgcatatttacttacacttatatctatggatttttcaccaagggcagaagcaagcctagcaagctctgtctttgagtaatccagtgcctggagaagaagatcccttgatttggttgcctgatcaactttccgcttgtagacatccaaacactcctggtccagctgaaatagaaccttgtcgcggtcctcctcgctttcaccaacttcatcccataccgactgataattcaaaaatagaaaagaagaacctctacttgaacacaaatacacaagcaaaaaaaaaaatctctaatgagttatgacatgaacaagtatggagcagttcacacgcatacctgcagtttttgcagcaatgatccacacgaagtttcacggagcaaagcagacattctggaataggtgaatccttttgtcggagctgtatggctctataaactcttgctcaagacaaaagcaacggtgaaatgcacttcaaaacttgcaaaggccaatgcttagtcgatcccgatctgccaggctgagcatttgaattggtcagatatgattataagagacacatataactactagcattttaaatcgttctagcatcacatctcccccaccaattgacagaaatactattaaatgccaatcgcagaaacagctgatggcccaagggaaaaaacattaattactgccgcacacaacaacaacaacaaaacagctcaatacctgggagtttcaacaggccaacaacatttatctcaaacctaaacaaatccatccgtgaaacgcaaccaaaatcgataattcatatggagatagctctgcatcgagatcatctccaccgagcacgcaactggaccaaatctagaactacaaacaacgccattggtcgacaactggatgaagttcttcggaaattcctaagaacaaaaccaccggaaccatcgagactaaccaaatcaggggtcgagagacagacaagcgcattccgccgccgcgacgcgccaatcccaccacccaagccaaggccatctcttagactccactaatccacgaaactctcagctcatccacacacatcaagcaccaaaataaccagatctccgttgccacgagcggcgacggcttaccggatcacgcgaagacgaaggagtgcgacgccgaatgtggaggcccggtggcaggagagccggaggcggcgagagagctcacccgcctcgccgtcgccgtccggtggagtggcagagaggtcaccggcgccaggagtgagtagcagagcgagagtagcattcactgctgctgctgctgctgctgctgctgctgcggtggagtccacgagtccggagtggccagcgtggtgacaagcgcgacgtggcggcttcgtgaccgtccgatgggacgacgcgatcatccgatggccttgttggcagtccgacgttgaccaaacttgactcgtccagaagcggggatgcattcccaatgacctttctggttcgttctataatggcttgtttgaagttgaacaacatagcgcggcatggcatctctcccaagcattttttcccctgtattcctctctgagacttcaatactcaagagtactagtactcgtgttctttttcaggtgtttgtctgctagttcatgtagcgttgtgagcatcgaacaaattggaattcgctggttagtcaaatactgcacattagctgcatagcaaatcaagcgccttgcatcactgggagaaaggagaaagcaggagatggccattaccagaacagaacagcaggttttaacctaacattctctccgtcttttttatggattttgaacctaccattctcgtgatcgagaggagagaggactggttggttcgagacatttgatccaatctaaagcagcgatgcgtgtgacgaccgtgtgtcatcatccatcgaccataccgcgcgtccgctcctccctcctgcgccactcggtcgtgccgcgcgcgtacgattcgttcgacgacatggccatcgtctccgtcacgactgccaccgccgcagctggcgttctcattctggttgtcgccgctggagcagcagcggccgccggagcacgtcgtcaccacgtcgtcggaggtgacccggggtgggcggtggcctccgacgtcctcgcctggtccgcggacaggctcttcaccgtcggagacaccctctgtaagtccatgacgaatgcatgcgtcgatctctgttcagtattcagtttcagagaacttgctgttgttgtcagggttcgcgtactcggcggaggacggcggcgtcgcggaggtcggcggcgaggaggagttcgagtcgtgcgacgccgggagccccgtcaggatgtacacggaggggctcagccgcgtcgacctcggcggcgaagggtcgaggtacttcgtcagcgccgacccggacaagtgcggcggcgggctgaagctgcgcgtcgacgtgcgggctccggtggctggtacgacgccaccgccagggtcgtcgaggaagggcgaccgagctgccgctccggcgcccgcgccgttggcgtccagcggcggccgcggagtcgccacgtcgcggacgtgcgttatgctgtgctgcctcctgttcctggccatatgaacatggagcagtggagcacggtgtgtttcgtctgatctgtcaattgtggtgttgtattctaccatgtatatcttcgcctagcctactttcgagaataaatttaccgactttctgatcttactagttcgtaggctcgtagcgagacagtcaggctggccgtaacaacggtagttaccttggccatcctatgggtgatatcttaggctcgtagcgagacagtcagaccggccgtaacaacgttagttaccttggctatcctatgggtgatgtctcatatggcgacatatatggtgtaatattgatgatataatatttgcaattgcacaacataagtctcggaagagtagaaatgcaaataagatagatgtgtaattgcagctatcttgtgacactaacctggcacgttgcgcgtcgcaactcgcaaccagtttacatcacaactcccaagtgaacgtgtccccgtccttctcaggtcgctcgtttcaggtaaacttcagaaccggccaaaaactggaatacttgagaaatctgggcgaaacactcggttgtaagacagctcagagattcacgggtatatcaaacaatcgagaacaccagtgcaccttgcactggccccgatggtgatgaactttacggtaaaaaatcatatcattacgacagaacctatgagtcactcaaccaaatcctatgtaattacagcctttataagatcagcgcagaggaagacaagacaggtaaagaaactaaatatagctaggagtgatagccgaaggaactacggtaaggtaacaacatccttcatgcgcgctacattgattccagcaagtccagtaggaagtaggcactgcacgagttaaaagaaaccacatgtcaacagaaatgcaaaaaaagataagttggttgaagtgattaaattgtgggctttgtctggtgagcatagtttctattatgagaccagctgcccatttaattttgaatgaaaggttttaagagatgtagaggcgtagcacaaacctcatgggaaatggccggcagcacatgatgaacttatggtgactggtccaaaagaatgttgacagcatggttaatcactgaagctacgctaggcactaaccgaactacaggtggcttcatcacgatcgcgtctgtaaaaataattgaatatagggtcaggtacaaattgttgaatttctgatatgcctgtcaaaggttttaactcttagaatttgagcaaaaactagcagcactgcataatggttagataactcaaggtctcgagcacaatattcgctaacaggtgacaggtccactaggcagtaaatatgttacggatgacatcgttgaaacgcataaaacagcattcaaatgtggagtatcgctttaaagatagcatcgaccctaagtcaaataaacagggaacaaccaatataaggctattttggaatcgaggaattcatagtgaagtactccttccatcccagaatcctgtgtttcaaagaagcctttactaatactggaaaaagaattattaatacagctagcaatctagcaccataaagtataactggttagattagaacacacctgcaaatggaattggatgcaatctactatatctgaatctaattgttttcctctgttgctgctgcactgatgtccacaatttcaccttcatggccacatgcagcttcatcttttgaatgcataactccatttgatgttatctgtggggctgtagacatatcaggcatcgtactatggtcagatttgtgtttatctgtttctcccaggggatgttcttttctgccattttcagccaatccatttacttcctgtctttgatttgttggtattccagtatcagtagtcatgtcagcatcctcagttgcagaaattgattcaggcaaaggaatttcttctgtagcaacattggtgttttgatctaaagtggcatcagtagtcatttccgtatctttggttgtacatacctcggaaattacagtagacttgggcttttcttcaatggcaacgttgttgcttggacatattggtgttccagcattggtagccattgccacatcattgatcatgtgtggaacagaagttacttcagtgtggagattctcttcagtgccagcactgtcaccctggcttatttgtattccagtattggcgctcacctccacaacttccattttatgtgcttcagaggtttcttgagtactgggtttgtcctcagtggcaatgttgttggtttgatcctttggtggtatatcattatcaaccatttccacatctctgcccgaaatgagctcagagtctgcttttgacttgatatttgcttcagaagcaacaatagaagagttgtctgagcatttttccccagaaatttcatgagatttctgctcatgcaaggtatcatttgttgaatccgcactgcctgaaactaatacactggacacttcttcattaggagatttccctgattgggttccagtcttactgttagcaggcagtccactgctctgtagttcatcagggggcttttcattacgatgtgcaatgctactgcaaggacccacattccccgtcttttcactagataaggctgcatcattatttaaatttccttctggaagtctggatatagaaagcggctgtgattgtgcaacagcagcagtaacacctagagccaaaacagtactgctctgagcaacactgccagcttgcgtggagttttgattcagaagattaccatttacagccactttttggtgattttcctttacagcaatattttctgccgctccttgcgaagaaacctgcgttccagctggtggtggagtagcctttggttcgacagcagttcttgtaaccttgccatattttggtggcaaaggcttgcccttactctttgtcaggcatgttggacaatgccactcagctttaggaacacctttattaccataatgctgaaggcatttcaagtgtgctcccttctcacaagcatcacaaacaagcaaactttccatatccatgatagctactttgcatatttgacagtccaaacgagaacgcatgtactcagttgatggcggaatccagctaggatgattagctggttggtgcagaacacgttgaacactttttgctatttcactgtggttagcaaaagtaggttttggaggaacaggtgccacgcttggtgtagcatgatgacctgtaagagggtttcctgctgtagcatcaattgatgctgtctttgtgtcctgatttttcgccaccggattggaactctgtacagcgttcagattggacctagcacatgtatcatgaaatgatttgttcaagttgccataggttgctgcagggggaaatacacctaattagtttctgagctaggagaatcaaagtgaatctctttttcataatcagaattataaatgtaaagtacttttgagacacaagaaagaaattcttctaggcaagagtgtttaagaaagatataaatgatacataaagaagagcttaatagtttctatgtccaaagttgaaatcataaaaactgttgaatttcaggtttgtttctgcgcttctgaataatcaactccaggtccaggaaaagggatacttctcttggtctggaatctgaagggaatggtagtagaacatttacatatgaggctttacccaaaagctctaaacaatattccagaagaccaagaccaaagcaagcatcttacttagaattagatggaatgaggaattaataaaaaaaagagtaaatttcacaaaactacatgttttatggttcaagttgcagaaaaccacacatattttgacacttgacacttaagtacatatattttggtagtttagtttcacaaaaccacactatcgatgaatggattcacccgtgagatgacgtggttgctccatctaggatgatgacgtggtatatcctattaatttcgtgagatggctggtaataggatgtcatgtcctcgtcctat
